United States Patent 11,001,841 (CCCTC-BINDING FACTOR (CTCF) RNA INTERACTOME) - sequence listing, part 14

SEQ ID NO: 34613 - DNA, 1034 bp, Homo sapiens
cataaccaaaacagcatagtactgccacaaaaatagatatatagaccaatggaataggttagagaacccagaaacaaagtcacacacctacaaccaactgatctttggcaaagttgacaaaaataaacaatgaggcaaggaaactctattcaatgaatggtgctggaataactagtgagtcatatgcagaagaataaaactagaccactacctctcatgatatacaaaaattaactcaagatggattaaagactcaaaggtaagtcctcaaactataaaaatcctaaaagaaaacctaggaataactcttcagaacattgggctaggcaaataatttataactaagacctcaaaaacgaattcaacaaaaacaaaaacaaaaacaaaaagacaattggagcctaattgagttaaagagcttctccacagcaaaagaagccatcaagagagtaaacagacatcctacataatgggagaaattatttgcaaactatgcatccaacaaataactaatatttagactctataaggaatataaacgactcaacaagaaaaaacaaatagtcccattaaaaaacgggcaaagagcgtgaatagacacttctcaaaacaagacatacaaatggcccacaaacatatgaataaatgctcagcattgctaatgatgagagaaatgtaaattaaaatcataatgagatatcatctcacactagtcagaatggctatcactaaaatgtcaaaaaataataaatgtttttgagaatatggagaaaagggaatgcttttacacttttgatggaaacgtaaattagttcaaacctgtggaaaacaatttgtagatttttcaaagaactaaaaatagaactaccatttgacccagcaatctcattactggttatctactgaaaggaaagtaagccattcaacagaaaggcacctgccctcatatatttattgcagcatgatagcaaagtcatgtattcaacctaggtgccccaaaatggtggattggataaagaaaatgtggtacatat

SEQ ID NO: 34614 - DNA, 1049 bp, Homo sapiens
ttcttgggatgcttgctcttggaatgctttattttggaattcatcttccatcagtggagcagcccaagcagccatgtggaaatgaccatggggagcagaactgaggccccagctcccatccctaactgagcttccactgaagcctccagatgactgtagccacctcaggggcttggccaacactacatggaacagaagaaccacccagtcaacgtgtaacttacaggaggtaatatgttattgctggaagccactcagttttgcagtggtttgttccttgcaatagaaaaataaaatagagccaaatgaccttccctagtgctgtcaacccatctctccccttcttcccatcctgtgctttagtcaatttgagtgacttgtcagtaatcaaatcagccactgggccttttcacttgttcctctcttggcccagaatgtcctatcctcccttctctacagagaaattttctatgcatcaagacaaatgtcacctcttctctgaagtccccttgacacattctttttccttccaggcagcattagtatccctactctgtgccccatggcagtttatgtgttctagaatgttatataacctatagttgaacctattatattttaaaaaatacattgaatggcttgtccatcctcctaggaagtgaataggagtcatgggtgtattagaaagtagcatgcgctctgggtaaagacatttctggatttgaattccagtttctaaactcagcagcaagagtttatttggatacctctttaagcttcagttttctaacctgtaaatcagggtaatatttgcctcctcttagggtcactgtgaagattaaattgtactgctgcatgtcaaacacctgtcacagcagctggcctatcagatgttaaggaattctagaaagattcccaccctgtcataattcaatgttaaggatgacaactcaccccaggcaccttctccggcctctccctcatcccacatacctccagttttaggtgtcctgccttgtgctcttgtaatccccctccttactgtggtc

SEQ ID NO: 34615 - DNA, 1041 bp, Homo sapiens
tgtgttaatttgtttaggataatcctgctgcatccatgttgctgcaaaggacataattttgttctttttttatggctgcatggtatttcgtggtgtatatgtaccacagtttttttatccagtccactgttgatgggcgtctagattgatttcatgtctttgctattgtgaatagaagagcacatgattttgagttaggatcttgttaaaattatacctcctccatatagtaattatgtgacgttgagactcagtttcctcacctgtaaattggaaataattgcaccatttactttatagggttgaaatcaggattattggaaataatgtctgtaagtaaaacacttaacacagggtgtggcatatagtaaggacttaatgcatagtagctgctgtcaatgaaatcaatgatttatgatatctgctcacatttttccctctacttcactaatccagttggaagagccatcatctgaaattcactgacagtttcactttagactgagctgatattacatgaccttttgcaagttttacagaccttgatgcaacttggcagacattatggaaaaagaaaactgggcaacttgtaaagcacatcatctgtatactttttaattgaggagccagaagctaggagagaggcatggagattctttctgacagctatcagaaggaaccaccctaacaacaccttaatgggttactcccacattggccagatcctgtcgaatggatcagttgaggtgggagctttagtttagttgttggatgagatgtgtttgttctaaaatagttactaggctgggccaccctttggaggatagaaaagttcaacctaagtcttaaacatgcatgcttagtctctgaggaataaagggctatgggtgaatgagagtttgaactcggttttcatggttttagggggagacctctccaggttaccctggtaatgggaggtttattttaaggaactcacagtggacagactttcacaggaatgctagtttagccaaataagcaagatgttcttgatcgcac

SEQ ID NO: 34616 - DNA, 1047 bp, Homo sapiens
ttccaagcacacagtttgggaaacactatccaagaatattattcccagagagaaccttagagatcttttaatttacaatcccttattatagggagactgaggctccaaaagggaaaaagacctttgtgaggttacctagcaagcaacttgcaggagcatcctggtcttctaatttttgagtcaaagttcaggtgcagtggctcactcctgtaatcccagcactttgggaggctgaggtaggagaatcacttggggccaggagtttgagaccagcctggacaacatagtgataccttttctctagaaaataaaaatcaaataattagccaggcatggtaatgtgtatctgtagtcccagctactcagtaggccgaggttgggaggatctcttaagcccaggaggttgaggctgcagtgagctatgaacatgccactatcctgcagcctgggcaacagagcaagatcctgtctcaaaaaaaaaattaaggtcaagaggaaaagttaccaaatttctctgagccttaactttcctatctgtaagatggttataataatgcctgttcttcctactacatgtgggataagtgacaataaaatgttattgtgaaagtgctttagaatatataaatatatggggggagagagaagagacatccacacacacacaagcacatttaaaaagactttatgcaaaagtacggctttgttaatgatttgattttgatttgttaattttgattttgatttgttgatttgttaatgatttgattttgatttgttaattaattaaccacagatttattgagcacctgtcagttactatttcagtgctggccataagtggagaacaagagagacatggtggctgccttcctgagctgataatctgaacgaggtggagctggatggcagagggagagacaaagaggacaaatatacaacagataaacaagagaacgttggaaagtgctgaatgcactgaagaagttaagtagggtgttgcaatcaagagagatgtggtgatttcagaccaggtggtcaggacgg

SEQ ID NO: 34617 - DNA, 1050 bp, Homo sapiens
cgaggtgggtgggtcacctgaggtcaggagtttgagaccagcctgaccaacatggtgaaaccccatctctactaaaattaaaaaaattagctgggcgtggtggcaggtacctgtaatcccagctacttgggaggctgaggcaggagaatcgcttaaacctgggaggcagatggaggttgcagtgagccgagatcatgccattgcactccagcctgagtgacagagtgagactccatctcaaaaaaaaaaaataaaataaataaataaataaataaaaataagcatggtcatcaaggtagaacttatagagaagatgacttttgaacaacgatttataagagataaaggaggaaatgatttgagtacctgagtaaagaccattccaggcagagggaaaagccagcgcaatgcccagaagaggaagagtggctggaatcttcaagcaacatcaaggagactgatgttgttggagtgcagtgaacaagagggagtatataagatgtagtcagataactgaaaggatgggtggacatcactgaagtggggcagatcatttagggattttgaggcctctagaaggtcttttttacttgaagtgaaatgaagagccattgaagagtcatgaccagaagagcgatgtgatctgacctatgaaattttagaggtatattttacctatagtaaaatgcacaggtttcagagtatcatttgatatattttgaaaaatgtgaaatctatgagaccattacctaagtcaagatatagagcatttccctctaaatttctctcattacccttcctatggtctgaatatttgtgtcaccttaaaattcatatgtggaggcctaatcacccaattagacaggaataataggttgggcctttaggaggtgatcaggtcttggggacggagttctgttgtaaaggattggtactttaaagaagaggctagagggagcttattcaccctttctgccttttgaggacataggaagtgccatttatgaggaatggaccctcaccagacaatctgctggtaccttaatctcc

SEQ ID NO: 34618 - DNA, 1050 bp, Homo sapiens
tcaacataaaataatcagtagcgtatctatacaccaataatgatctagctgaaaaagcaattaagaaagcaatcccatttacaatactacaaaaaagtctagtaataaatttaaccaaggaggtgaaatatttctataatgaaaactataaaacactggtgaaagaaattgaagaggacacacacacacacaaatggaaagatatcccatgcttatgaattggaagaattaatagtgtaaaaatgagcactgtacagattcaacgtaatcctattaaaatatggataacattcttcacagatatagaaaaaaatcttagaatttatatggaaacacagaaggctttatatagccaaagtaatcctgagcaaaaagaacaaggctggaggcatcacactacctgatttaaaaatatgctgttctacaaaactttaaatcacactacctgatttaaaaatatgctattctacaaagctatagtaaccaaaacagcatagtactggcattcaaaaagatacatagaccaacggaacagaatagagaacacagaaataagtccatgtatttacagccgcttgatttttgacaaattcaccaagaacatgcattagggataggccagtctcttcaataaatgatgctgggagaattggacatcacagaaaaataaaaatagactcatctttcaccataagcaaaaatcaactcaaaatggattaaaggcttaaattgaagacctgaaactgtgaaactactagaagaaaacataggagaaatgcttcaagacattggtctgggcaaaggtttttatggataagacctcaaaagggcagacaacaaaagtaaaaaatagacaaatggaattgtatcaaatgaaaacctgcacagcaaaagatacaataacagagtgaagaaataacctgcagaaagggagaaaatattcacaaactatgacaaaatattaataccaagaatacacaaggaactcaactccacaacaaaaaatcaaataatctgattaaaaaggcaaatgaactgaacagatattta

SEQ ID NO: 34619 - DNA, 1039 bp, Homo sapiens
tacagcccaccggatgcatgctaccgccaataaccttgcccccacaaccagtgtatccactgtgcctggcacaccccaactccaccagggcttgagaagtagcctgattgggagcccccagccccagcaaagccacaccgttgcttccacaaacacccacagtctaagccactgaggcatttgcagatactgctgacattgataacagtcaagaaatcacagggagactatgctactgcacccacccagaaccaaagccaaagtgccttacccaatcaacagtgtaggacacatctataggaaaaagtctttccctatgaaaactactccataaaattggaagaggcaacttccaccagatgtgcagatattgagagatataaaaaactatgaaaaatcaaggaaatataatacatccaaaggaacacaataattttctagtaccagaccccaaagaaaagaaaatcgataaaatgcctgaaaaggaattcaaatagtgatcttaaggaaactcagagacatacagagaaaataaatagacaattcaatgaaatcaggaaagcaatttatgatctgaatgaaaaattcaacaaagaggtagatatcatttaaaaaaccaaacagaaatcttgtggctaaataatatcagtgaataaaatagaaatacaattaagagcttaaacaatgactagatcacacagaagaaagaatttctgaactttaagacaggtctttttttatagctgcatagtattccaaggtgtatatgtgccacattttcttttttcaggctatcattgttgggcatttgggttgattccaagtctttgctattgtgaacagtgctgcaataaacatacatgtgcatgtgactgaagctggaaaccatcattctcagcaaactaatacaagaacagaaaaccaaacattgcatgttctcactcacaagtgggagttggacaatgagaacacatggacacagagaggggaacatcacacactggggcctgtcggtgggtgggagtctaggggagggata

SEQ ID NO: 34620 - DNA, 1034 bp, Homo sapiens
acattcctttgagcttcctctgaacagattctggatagtgccctcagaagtgcttctgagtcagattttactcagcaaccatttggatctgagatgagctttctttaattttcaaaagagtcctttctggcagagtgggttgtggtgggaagagtgtggattttggagttgggcaaacctggtgtccatcctgtcaatgtccttgcttagtcctgtgactttggggaagtcatttctcctccagctttattgaggtgtaattgacaaataaaaattgtatatatttaaggtgtacaatgtagtgacttgatatatgtatacattgtaaaataattatcagggtcaagctaattaacacatgtatcaccattttttgtgtgtgttatgataatgcttaagatctactctcctagcaaattatacgtgtacaatacaacattattaagtatagtcatgctgtacattatatttatgctgtacattagatgctcagaacttactcaatttatttctgcaagtaggaaagtcatttctgaatggacaactgtaatagagccttctggtgttatccatatctagttattagaccatggaggcgaaacaaaaactgagaagctttaaaaacacagtaatcagaagcacatgtttcttagcggtcctagtgctcatgccatcacatgtcatgtggctcctgggaaactccactatacccttgtgaggagatgagaatgaaaaaggcaaataacatgtcagtattattaagaaagaattttgaccttgcagactctgaaaggatcttcagcaccccaaggagtccccagatcacactgagaaccactgttgtaatatttcaaatccgtgttttaaatacagatacctccgagcctttgcacaggatgttctctctgtctgcaacactcttcctcagacattttcatctcccactcctttagcacctttgcataagaaaggtctttgctacctttcttaataaagcttatcctgaccaccccattcaagttgcagttactgcc

SEQ ID NO: 34621 - DNA, 1047 bp, Homo sapiens
cataggtggtagtcagccttcaagatggttccaatgatccttgcctcctggtattcacctttgtgaatcccctctcacattaaatcagaactaacctgccatccatagaaacggatgtggtatgtgattttcgaggcgagatcataaaaggcattgtcaacttcctccttggccccttcaattgccccttctgaggaaagccagacaccatgctgtgaggacactgaagcagcaatgtggagactgctatggagagaagacctcccaccaacagctaccaccaacttgccagtcctttgttaacagccagcttggaagcaaatcttccggccccagttaggccttcatgtgactgcagcctcaccaaagacccagaactagttgaactgccccccaaatttctgatccaaagaaactatgagataataaatgatcattgttgttgtaagcccctaagtctttgagtaatttgcttcacagcaatagataactaataccatgggtatttgtattatctctgacagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtcaggttcagagtaagtgcttattacacagtttcaagtgaacgaacaaactgttttcatgactgaatatataaatctgttacacaagtatatatttagaaaaggagcccataaaaataaagaatgaatattttcaatctcattaaatcaggttgaattttcctgttgcttaggactaatttcttcaaaaatgttagtctcctaaaatgaaaactttatgctcaagaataaaataaagaacaaaaaaattttagtctccaatgaaagtaatcctattatttgttctgattacataaatattgtaaaataatacacagaaaaataaattagaatcaccccctctcctgctcaatattactgacgttttggttaaaagccatcttc

SEQ ID NO: 34622 - DNA, 1084 bp, Homo sapiens
tattagtggttaactaatgagttaaggtgctgaccacattgtttggcacttctttatttaaatccttttggagcctctattcaattttaaaacatccttgactgtagtgatattagtttttgatgttattttattgtcagtttagtagtgttattaattagtaaggatttctatgttttttcactattcctagatagttttcttaggctaagaaaaaaacatgcatagcggcagccaagaaatttaaagtaccactataatttcccactaattcatatgtttgatagaatgaaaaatcagagtaagagcctataaagttatgcttcagaagtggtttggttagaagtaacaaactaattacatttttgctcaatttcttccaccccattcgcaccctgtgcaactaaaaaagtataattatcttttcccatccttaaatttttcttgaattcttttagagttagttctgtatctttttctcatggtctctctctctctctgtgtgtgtgtgtgtgtgtgtgtgtgttttaaaacaattgaagcaaatatttgaaattgttacactgatatggctgtttctaagacttgattaaaacatttgaaactctaaaagtttgctagttttaattcccatcattcaaagacatttgttttagcacttggtatggccaaatacagtgctaagatactttgtgatgtttaaatagctcccagacacagaaaaagtggttacttgttttgggcctaggagaatataggaaagagaagtcaccatgatttgcttgatcacacagaccttggatcccagaggtcaagtaatttgtttgctttttagcttctctgtctaaataatgtttgtctctgcttagttagagagtctatgattatcataagtgatttattggtcatacattgtaaactcagtatagtggtgggtctaaaaaagaattaaaagactttaaaatgtccctgcttttagtaaagaaaattaataggttatgtgccagggggactgtgttatctcagttatcctcataataactccctggatcaggtgaaattttatcattttatgatcaggaag

SEQ ID NO: 34623 - DNA, 1799 bp, Homo sapiens
atatgtgttagttgttattgtccttcccattcttgcttcaaatcctgtcttctcttatgggtaatgggaggaggtcctgctaaatatatatatttttctaatataaagatttaaaaataaaaaacttgacaaatattatgaaatatctatgaaatacataaataatgattaaaattttggttataattaatatttagaagccaagccttcatttaaattatagtttagaagttttttttttttggacatttgcttaaattctgctgatggaggtgatataatttgatatctaatctgaatggtgaaagctcttgtgctattgccatgaatttttatctcaagtttattttgctatgcagacacgtgtgtaataaaaaaaaaagatgctgcataaaccatcatttgagtttgaatgtgcttctgtttttggttgaggtacaaatgttatttctggctgtgtccttcatacttagctcttcttacaacaaatggaaagtccttaattgtacctgagggaatagttaatccacagtggacatatggtggacaaaagctgagtctactaaatgaaataaaattgtaaatggtgaacgtgaatgcctacaaagtcttgcagccatgtaggattgactatttgagattaccctgttttatgtataacatagttcttttttggtgagtttgtgtggtatatgtattataaatttgattttaaaacgtgctctcaagttatgtataaagcatatttatcttttttactgttcattgagttcgtgatgtgactgatgtcaacaatagaggacgatgagctcacatttttggaaagttactgctcttttgattgggggcagttaattagcattaacccagaacagctcttgggctttatggatttgggtgttatgtggttgcactgctccagctaaaggttaagtattaatggaaaatggtcacagcccttttacttaaagaaaacatgttacttgtaagttttcttttgattttacttttacagttacattgaatgtcttcattcatttagccatccataaagcaaatattgttgcacatgcaatggataataagtctttttaggattacttgtgtggtatgtcacagatcattaactgcaagtaaccacctgacttgagggaagcctggaagcatcattatagtgaaataagcttttatttaggtatcactgtagcacattgatttacagaattgtcaccagtggctactttgaaaatatattgtcattatcatttaaggaatggtagagattaattgctgtagactataacaaagttatgttgattacagtggaaaatataagaaatattgtggtctgtatttaattactttttaaaggatttttaggtaattaattaggctaaatcgagtgattctttaggatgctttcaactttgtgtatgattgaatatatgtattaaaggcatgttttcagttttccctactttgaaatgcctttaaattaagaagcatagcaagggcgtagcaaactttatgtaactatttaacacagttaatgcgtattaactttcctttgtgagtacatggcattatgttcatcttacttccacaacaagactttaagtctacaaaagaaagacaacatctaatttagtacttttgtatcacagcgagggaaaaaatcaaggattttttccttccttcccacttatgtattcaaaccctaccaattttgcaaagctcccatttgagttccacattcctaatcttaatccttattccacattcctaattgattggtttca

SEQ ID NO: 34624 - DNA, 1114 bp, Homo sapiens
caaaaaccttatccacagatcaacagcctcaaagagcaaaggtagataaatccacgaagatgaggaaaaaccaatgcagaaacggtgaaaattccagaagccagaatgcctcttttcctccaaatgatcgcaacacttctccagggcacagaatggggctaaagctgagacggatgaactgacagaattaggcttcagaaaatgggtaataatgaacttcgctgagctataacccaatgcaaagaagttatgaacattgatgaaaggttacaggagctgctgactagaataaccagtttagataggaacattaaagacctgatggagctgaaaaacacagcatgagaacttcgtgaagcatacacaagtatcaatggctgaatcgatcaagcagaagaaaggatttcagagtttgaagaccatcttgtggaaataaggcatgcagacaagattagagaaaaaagaaaaaaggaatgcacaaaacctccaagaaatatggtactatgtataaagactgaacctacgattgataggattacctgaaagagatggggagaatggaaccaagttgggaaaaacacttcaggatattatccaggagaccttccccacctagcaagacaggccgacattcaaattcaggaaatacagagaacaccaccaagatactccacaagaagatcaaccctaaggcacatgaggtctagagataaaagttggggaatatatttagagccactgggattggatgaccttaaggagtgagtttaaaaagagatgaggtctaaagattaagctttgggttacacccatgtcttattaaaaccacaattaaatatcaccacacacttcttagatggctgttatcaaaaagacaaaaggtaagtattggcaagaatgtgaagaaaaaggaacccttgtatactgttcgaaatgtaaattagtacagccattatgggaaatagtgtggaggttcctcaaaacatatgatccagcaattctagttctagttatatatttaaaggaaataaaatcagtgtgttgaagagaatctttactcccaagttcattgcagcattattcactatagccaagatatggagtctgcctatgt

SEQ ID NO: 34625 - DNA, 1032 bp, Homo sapiens
tatgtccagtttgaaaaccattggaatttatatgaaattacttgcctatactgtgactcttttgagtcttcaaaaattctttatctgtaaaatagacatgtgaaactattaaattggtaatatttaatttattttgaaggattcatatcaacttgtataaaatttatcacctataatattataccaaagtgaacaagtcattgttaccaatttgtttaagagagcttataatttatgaagcataaacagaaactttttcggggatttgaaaagttcattctctttatacattttaagctaaaacattctgcccttttaaccatttcttttagtactttgcttcttttttgttccagataatactaatcccaaagtatcagaaccaagtgtctttttcagatggagctaatatttctgtctctattgctgctgctgctgctgctgctttttctttttttaacttcttttcacatgtaaatttttcaaatagaagtgtgatcatttacttactggaacatactgagatcattctatatattgaaagagaaagtattttgttatatatacttaaagctgttccctcacatgatacttcacactccttattgtattttaaggacatgttgatagcatttcaagtttaattggctgagtagtatctccaaatcaaatgcataagcttgccttcagactgttgttgttactgacaactgttggggaataaaatagcaaatgagtgctgtttcataatatcaatcaaaaactgtttttcatctgacagttgttgtagtgatgttattttgttatttcatagttacttttttggatagcctgccccaaaccattttgacagtactgtaatttactttgtctaagcaatattatggtttttgtggttatgttttcattggttttggaggagttgtataagcattttgatataacaatttgtttatatgatatctctccatctttttgtcataatagagaagatttattaaatgctaataaaagcataattcatcttatttg

SEQ ID NO: 34626 - DNA, 1055 bp, Homo sapiens
tgatactgtgtcacttgttgtattgttacttaatttttttggtattcttatttttatattcattttttatattctaggaaacttgaatgttacccttcaaatttgggatataggagggcagacaataggaggcaaaatgttggataaatatatctatggagcacaggtatgatatgaattctgattattccagtattgaaagtataccacttacaagcacacatgcaaatctactcccaaatgcacacacacacacattctttctaactttttatctgatacgtagagagaataattttatatttgtgctagttctttggtttcatgctctcctaattatgtttggagtgatttgggtgagggaacaggaaaactctgaacagctttcgtatgttatttacattactaggtgttattgttagcagttcaataaatgcagtgataaatgatattttgatatgtattagctggttttgttatagtgactgctttcaaataaactgaatgaaaaacacagggatgaaaatttaacttcattttaagttacaaggactgaaagtatatctatatgtctatgtttttgtgcaatgaatattgatagcttttcagatttaatagacatgtctgtattttctatcagataactaaatatgacagtgtatatgtgaaacacatacaataatttactatgataatgctgtattttcagaagaaaatccatgtagagcaagaaaaatgaaaatgaaaaatgacctgaataattacataaatttcgcaacatgagcttatattctccatgagcttatactgatataatttataagattttaaataaagttattatacaaatagaaaatatgcagggtagtaatatactttaaaagttaatcatttctctctgagcatgttcagtgaagaattgtctttttaatatttggcagattgcttttgattaaatgacagactttagaaatgcagtaataccattgaaagtaatcatctgatgaagtagagaatatggtatatagccgaatattaagtaggttgtgcttact

SEQ ID NO: 34627 - DNA, 1064 bp, Homo sapiens
gcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtg

SEQ ID NO: 34628 - DNA, 1044 bp, Homo sapiens
tcctcgggtgacttttagaggaaaaatcagtttctgagcctccatttcttgttgtataaaatggggataataagacgggatgataatacaaaggcaaacacgattccaaccctcatctgatcataggtttgcagtatttgtttgttcagtctgttagttcctttgaatcaaaggagcatgttatttttaactgagcttatttttcaggtgaaatgagtttctagtttagaatatatttgaaagtgaaaagaaacatttttccctgctgacagattttggacagtgctggtcttttagaaatagttaataactttcaaagatattatctcagtcatgccttataccgtccaacttcagatactttataccagtccagattggagaaaagtggacagtgacactttaaagcatgacaattgcatagactgggattaagcacaggatgctgtaggaacaaaagggtcctcatgggctggacttgaagggacagaggaattcttttccactctggctatataaattgtagcatcctggacttttaactgaaatagaccttagccatcatctaacccagtctcaggaagctgaggctaatagatttagtcttgttcattatagagacttaggagactttaagaaatgctccaagggttgaaacaagtaactttacaagtttctgttgaatttagcctggagtaaattgaatgctccagaagtttttatgactcaatcattgctacaattactcattcctccttttttcctgaagaagtgaaaatagaagggtttccacagaagcttctacacaatctaaagaaggatataagaggcaagaccagagtagaactgaatctctgcacctgagaaaattttttctttttgtctacctcacagtttaactttgtgttcaatttttctgtgttcagtgtgaagcaagtaaagtgaatctgttaataaatcacctttactgagaatagaccttagtgactcagaatatttttaaggacaaacttgatggagatcactgcagaaaaatacttggaa

SEQ ID NO: 34629 - DNA, 1709 bp, Homo sapiens
gaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagt

SEQ ID NO: 34630 - DNA, 1035 bp, Homo sapiens
aaaagttataaacacctacctatatatacttgatgttcatagatattttcacagctatcattttaattgaaacaaccagcttatttaatcacttttccccaaaattatacctttccctttctttaatggcattcttaaagagtaatggcaaattttcacatctgtttcttctattctggtagcttctagattgaaacatacacatacatatgtatgtatacacacagagataaatgtgtgtatatatatgtagtgtatgtgcattttttcagagcccgttaatttgtaagaacatctgaagggtaaactaaaactttaaaaaaaatacaatttttcagtgtgtttttgcctttgcctaataatctgttagggtattttgtggttttaggccaaagaaaaagaagagaggcttttaagaaggcaaatcaatagagaaaaacttgaagaaaaacgaaaacagaaagcagaaaagacaaagtcttcaaaaaccaagggtcaaggtatagatgtcaacttttaatattttaaactatctcatatatttcattattttctgggtactcttatattacttatgagacatgaatataaaataaaatgatctagtctcaaatgtggaagatttccttacgttttaatctcatgtgtttcatcatttttcttttttattaaattgctaaatctaaattaaacattttaccagaaaccagcttatgcaactcatttgttagcagtatatttttctgtaatgattgaatcactggaaagtagattgttaacacatgagttatcaacccttgctggtgattaatgaaattaatctatgcttatgttaactaaaatgtcaaacatttccctgtaatattgtgttgaacaaaattgtattccctctgggcactaatcctatgtaatatatgaaatcacacatacacacacttatgtgatcatttgaaataagagagataagacttcttcatccaaaatattatatctattccagcacaacttaagaatattaaagccattttggcttta

SEQ ID NO: 34631 - DNA, 1071 bp, Homo sapiens
gttaggttctgccaacaagaggtgcaggtgggagatgaaagggcagaagagggaggtctgttttcatccttttgctccgtcccatgcaggttagcaggctgcagtgtgtaaggtggaatccttctatcccaagccacagattctgtctgggctgtctcctagagttaacttctccttcttcctgcccctttggagtggtagaggtggtaatggctcccctccgtggctagccgtagttaatgcaccaaatcattgttttattttaacctcacccaaacctttggaaatatgtgtatcatttattaaatgtttctcagggacttcatcctaatatgctttctttgtcttgctgagtctctaacagatgcaatagatgtttaataagttttcgttacatgtattaaaatggaagaaggatcagatgaatttcataagagctccagggtggagaactgagatcactgggtagaaatcagtgaaacaggctagtggcatgtttgaaggagaagacatcagagaaatgtgaaggcaattgtcaaggaaggtgaatggctcttgtattgagattgcaatagatgcttgctgaatgaaatagttttagccattaccatgctgcatagatcttgttaaagtttgctttttaggtggcatctaaaagggtgtgtttggggatatagtttcctgaagcacgtagaagcggtgtttggattcaaactccatgaatggcactatcaaggccagttctggagaaggcagagctgccattggctccaaatggtagttgtcctgttctgacagcctgcctgatcttggtgtccaagtgagtctttggggctcatctacatacaatacaggtcagtttttccttctcccctgatgaaaaacaaaaaggctggactaagtaatttgcacaacctctttcaattctaaaattccccagttcagtgtttccatgatgtgaactgggtatggtgtgacttgggaattcttacaaaggaagacaagagtatcaggagtgtattttgccttgagtgggtggaggcatcttagtggctgctaaagctgacattt

SEQ ID NO: 34632 - DNA, 1038 bp, Homo sapiens
aaaagaaagaaaccctctacattaaaaaagaccagaaagaaatatcatgaaatgttacttgttttatgttatgatcacagatttgtttgttgttctctccctttctgtattttctgaaattcttaatgatcatgaatttttaaaataataaatggtttatttattcattcagcacatagcttccaatcattaagtttgagcttcaaggatgattaaactatttatctgccctgaagaagcatacagaactctaggagagacataaatcgacacaaagtgaatagctgccatgagtgaggaacgcttgaggtctaagtgtgaatcaaaaagatagtgcccattatacctgtgtgcagagtcaaaatttaaaaacaattaaatacacattgtgatgacaatgttccatatacatgaaagaaaaaatactgtttctttgactctaggttgctctctccagttacatttgtgtttgagaggattggaactaaaaactgagatgaccctctttgtaggggctgagtaaggatcacgcggtattgtggttgtcaacttgagaaatgcaatcagtcagtctctctgaatccttgtctccatccacagaggctgtaactttgctgatgcatttttgaatgctattgtatttgctgttaccttgcttctgtggctcatgtgttttagaaagttaatcttcctttttaattttaactacaactgaagcatattccttttagcaaaaagtacagcagtaaagagctcaacaaattggttagaaatcagtttttaaagagggaatacgagctctagattgggtctcacagggttttccaaagagattgtgcattaacttggactcattgctgtttattttggctgttaagaaatctttttggagagtttgccaatttttagcatctcatccatgttgcaagtggttgggtttattcccctcgattatctccgggtcaaaggagtgttatccatttcttacacaaccatttatttagtgcctactaggtgcctggcctctactcagagcta

SEQ ID NO: 34633 - DNA, 1070 bp, Homo sapiens
tacacacatacatacacacacactcacacaccatttttctaggtggtagaagtattttaaaaagaaggttctagctgatatgtaatgagcatgtacaacgtgctaagacatgacaagcatcactttctttaatcctcatcataacctcttgaggtgagtaattgtattatcctccttctacagatgagtaatttagacagtctgatccacaattgacacacctaactacttaccatatttcctccctaggttgttgctaactttaaaagaccatgtttttgcatccaaacaacttgcagttgcataccctctgtttcttcctcctcctctccatgggtgccctgggttctgttaggaattgaatcttctctttgtaacctcagtgccttgcttatatcatctccagtagctgcaagccattaccaaccatgtctcccctatgcctctttctccatctgttcacatttatcttctgtatgcatcactttctacagaaagtctccctgatattctcaagcaggcacaaccctgtcttctcctgaacccttctagcacgtaatttggatctgccatgcactttagctcactggctcttaactagatctactgaatgagcatatcagtagattaagttaggcattaatattttttaaaagctctatgggtgattccaatgggcagccaggctctaggaatctttgccttatctactcttgctcaaatgatgccttatctgcttgtccttacaaaccggggagttgtagtgatacaaatctggtcttctttgtgtctcatcctgttcttttatttattacttcatcacttatttatttagctgctactatatgtcagatgctgaatgcttggtctgggtattcagtagagagcaaacaaagagaccttgtagagacaaaatctagtgaggaagagagatatttatgaaataatcacagaactgtgcttaacaggatatgaattgggaattcccatccacttggaatttcagctgagaacacaaagcagagaatgataggcaaccaatgctcatacatcgacttagaacttgttaa

SEQ ID NO: 34634 - DNA, 1076 bp, Homo sapiens
tcccatcaagctttgcaggaaaccacagagggattatctgataacgaaatgtcatttttactctaattgtttatgaattacagtgtatatgactaagtagctttaataaatgtatactaggcaatgggaggagatccacatggaagacagaagaccttgactctagtcccatcttagcgaccactgacaaggccctcatcgtttatggatctctgtttcctcttctggaatatgaggtgggcagagaaagttgatttctaaagtttctcctagcccgcacttggattttacataatctctggaaatggtctctaatagagtagttattgttgctggccactagaggtcagtaccttaaaaagtaaactggattctcctgccatcaaagtatgccttgaagcaaaagcaaaattactgttttcttatcttggttaggaagaaacattcccaaagaaacagttttctccttgacatattagagcttgtaagatgacatttccaaactctggctgagcattcactgcagagttcactaacaatcttagtgtgagagatgaaggagcagaaggtctggccctagctagtgaagaacgtatggtttctgcacagacctgaatgcattgatagctgtgtaacaggaggaaagaggaactgaaaatgactcttctgtagagcaagcccctcactgtatccagtggtgcacttgcccctatctggtcactgagaattaaaaggtaaatatgtttttagatcagctcttttctcatagatgtggtagggaaggcacaatttttgttcctttccctgagttcctgctgctctgaaagataggaacttccactctcttaataattagtggcttacctctccatggctccttctggtggagggaggaggagggatttctctgattggtgagatggcaagagtctggtaccccctgggctctgtgttgggagtgggctgtgtgtaaaaagtcacttgcacatgtggcctctcttgggttctatgagcttgatttgaggggagggagacctctgttctctttgaggctgaatggaaaagtttctgttgtg

SEQ ID NO: 34635 - DNA, 1052 bp, Homo sapiens
ttctgtattcttgatgctctggcatttggagccttgatcctggagaaactgattctcctatgttagctaatttctagagatagcaaatgattcccctgaaatatgcaaagtctcctttgatatacaagccaaccaatccagagcccacacaaccatctccattatcaaactctcacacactaagccaatattcctcctgtcctaagtcaccccaggtccagataccagaccactatagcccagagaacaccacgattattcaagctatccactcctaaatttatgcagcaccctaccctgcttcacctattccttcctgggaaaaccctagtaaaggctctgtgctgtactctgctgtctccgttctgccttctgaccaacattggttcttccctatgtggtcctgtgtggcatgccatgttctatgatttgaatgtgtcttcccaaaagcatgtattggaaacttaatccctaacacaatggtgtcgggaggtggcacctaatgagaggcaattaggctgtagggctctgccctcataaatgcattaatgccattattgcaggagtggattccttataaaagaatgaatttggcctcgttttctctctttctctttcttgctctcatgttttcttgccttgcaccataggatggtgcagcaagaagacccttgcaggatgccagccccttgatcttggacttcccagccaccagaactgtgaaaaataaatttctgttcattataaattgcccagtctgtgtattctgttacaacaacagaaaacgaaccaagacaccatgcttcttgtttctagggatctgttaagtataaacttcttcttttgtgccaatcatgtttgtgtctgtgtgtcttaccatacctaattaaaacaaatccagagtacattttttgacacagcctgcatgcatgtgtatgtgtcaatgtatttgtgtttgtgtctctgtacgtgtatgtatgtgtgtgtgtgtctgtgtatgatggggtgtgcacgtaggcatgaatatgaggaaatgagctgatttactgtgc

SEQ ID NO: 34636 - DNA, 1911 bp, Homo sapiens
gttcagcattggatagatcatttagagagaaaatcaacaaactaatattggacttaatctgcaaataaaacaaatgaaactaacagatttaaagaacatttcatccaacagctgcagaatacacatttttctcttcagcacatggaacatgctcaaggatagactatatctcaggccacaaaacaagtctcaaaaaattcaaaaaagttgaaatcatatcaggtatcttctctaaccacaataaaataaaactagaaatcaataacaagagaaactctgaaaactctacaaattcataaaaattaaacaatacactccagaacaacaattgggtcaatgatgaattaaaaaaataaaaaattgactggaacaaatgaaaatggaaacacaacatatgaaaacctatagggtatagcaaaagcattaccggaagggaattttatagcaataaatacctacgtcaaaaatgtagaaagattttaaataacctcacaatgcatcttaaagaaacagaaaatcaaaagcacatcaaaactcgaaattagtagaagaaaaataataaagatcagagcagaaataaatgaaagtgatacttaataaaaagtagaaaagatcaatgaaatgaaaagttgttttttgaaaagataaacaaaattgacaaaactttagccagattaagaaaaagagaagacccacagaaataaaatcagagacaaaaatggagacataacaactgataccacagaaaatcaaaggattattagagactattatgagcaactatatgccaatacatttcttctagaaagctagaagaaatggataaatttctagacatatacaacctaccaagattgaaacatgaagaaatataaaatctgaatagacaaaaaacaagtaatgagatagaagcagtaataaaaagtgtttctcttcaaagaaaagcccaggacctgatggctaccctgctgaattcaacaaaacatttaaagaactattattaatcctactcaaactattccaaaaatcagaggagggaatacttccaaacctatggtacaagggcagtattatcctgataccaaaaccagacaaagacataacaacaaaaaactttacaagccagtatctctgatgcacactgatgcaaaaatcatcaacaaaatactagccaactgtattcaataataaattaacaacatcattcttcatgatcaagtgggattcatctcagggatgcaaggatagttcaatatataaaatcaataaagtaatacatcatatcaacagaatgaaggaaaaaggacatgatcagttcagtagatgtgaaaaaatatttgcaaattactcctctgaaaggggactgatatccagaatatactaggaactcaaatatctcaacagataaaacataaataatctcattaaaaataggcaaaaaacattgatagacatttctcaaaagaagacatacaaatggccaacaggtatacgcaaaaatgctcaaattcactaatcatgagggatatgcaaattaaaccacaatgagatatcttactccagttaaaatggctttcatcaaaaagacaaaacagatgctggcaagaatgcagagaaaagggaatgcttgtatactgttagtgagaatgtaaatttgtacagctgttatggaaaacaatatgaagtttctcaaaaaactaaaaatagaactaccctatgatccagaaatgccactgctgggtatatatccaaaagaaaggaaagcagtatatcaaagagatatctgaactcctatttttactgcagcactattcacaacagctaagatacggaattaacctaagtatccatcaatggataaatggataaagaaagcatgctgcatatacacaatggaatattattcagcca

SEQ ID NO: 34637 - DNA, 1033 bp, Homo sapiens
aaagcacttactagataatgattctctaatccacaatgggaaaacggtcagatgcaaaatacctcctatcctggactagtcaggtgaaaaatgcttgattacttatttccaggttttagaggccagctcttttttgaatatttgaacagcaaaatgaaagactgggagttagaaaagaaaccatttcaatcttgctttcctaagtcttttaggtttcattacttgcctaagttgtagttctaatctttttcatgcagactaccttgtttcttggaatcttgggttttgtagctggtgaccttgaaattcttttactgggaggagcatagattctagttcaaaccgatcattatttggatcctggacataccccatgtatttacattttaaaacatgtggagaaggcttcattttgtagatagcagcaagggacatctacctaactgagcatcatgctggcactcagtcttcatggggaggagggatgttggtttgcaaaataagagtgggggctgtgcagctgagccaagtgtgtagaaaacagaaacagaagtctccaataggaatgtcttggatcgtttggtatataatgtatcagatacatctctttgcttttcttccttaaaatcctcaagatatttactttgattactacagctactgtgggtgggagctcaagggtggagaggagacatctttgattttgtgcctttattttttctcattataaagactgactatagtaaggatatggtggttgagacatcacttgatccttcctttttgcagagatgagctatttatctagaaaatgataatgtatgataatgataatgtggcataagtgaattatttacaaatcatgagcttaaaggaaaagtgtaaaaattctaatcagaaaagaagcttttattctccctaaattatgggtaacatgttcagcaaactcttcatttaattcttttgcatggtgttatgtaaacatgctagatctgggctaggagacttggattctaggcctggctctaccttg

SEQ ID NO: 34638 - DNA, 1028 bp, Homo sapiens
gccattcacacgtttttagatatttaatgctattttgagatttcatcatccagtaaactccccttggtgcctaaggtagttcaaaattggcttttatctcctgtgatcaaagtccaaactaatacagagaagaaccaaataaccaaccatattcttcaagaatagttttgccatgaaaaatcttcctggtactaattcctgatggctctccatttaccttgttaagtattaataaaagtgcatgtgtctacagctcatgaaaagcagggaaaaagaaaaaaaaagtgcatgcatctggtttcactggcctgccccacctacacaggcctgttacctgcagttcctcaaaggctcctccaccccacacctggaggtgcgatctgccctcctctgagtctttgttcctcctgctgcccttgaccaggatggatgcccagccctgttcctttacctccttcatgccccacccatcccatggctattcagatcctatccctctagttttccctgtagtgctttaccagtgtgctgagtacatgacacttagtacatactgcattaaaatggaattgaattcctgactaaggcattcaataattagccatgttaataattaactagccatattattagccatattaacctctaagatatttttcaaccctacaattctaattgtatgcagttcagttgactcagaatcctggttactgattagtttatatatcattatattgaggcagagagattatttaaatggtgaattcaagaaaaagcatggaaaggttatgtataaaagtgaaataaaagagaaaccgctattgctagtgacaacataacaaaaacaaaatacatatacagtagtatacctaacagcacagtaggtactttattattttattaacccctctatggcagtttcttacctggaataccttttccataatttctcggtcatagactggaacttgcttataatttcggaattctggcacctcttggcttctaagatgaagaagcctaaatcg

SEQ ID NO: 34639 - DNA, 1050 bp, Homo sapiens
aaattgaatcccttgtaatcatgacccattaaaaggtaactgctgataataaaccagaacatagcctggttgtttcatatatttgaaaggtgatgatagttgtcaatcaattatatatttgtgtttatgaggaaatttatgcaagctaagtggcttgcataagctcacatagatatttaaaagagtagaggactttccaccttagggtgctggctcttttctccctatgaagacagttttatatgatttttcttacctgctggaggtacttggctactatggccctatgggtgtctatgtgttccttggtttctattacatttctgtctcgtaaccgtttctcatagtcctaaaattaaaaagaggcaatgattttaaagcactctctggtgcttttcttaagatcaggtaattatttatcacatatgatttaagttataacttgtggttttaaatatttcttccaccttcttcctaacttttggttcagaattggtctttgatagagtaaccaggattctgagacaggtggctgaaatgccttactagtagaagagaattctgtatagtagttacaagttaaaacgttaagtcaggaagaaatagaggccacagagaagctcttccaagcaatttagccaaagctcctgcttaagttttgccttttctgttttaagtaaagtttcagttaacacattaccataatcatataacatctggctgtagctgagccaggtcatctgcttggaggagagtgatgcatacatctggctttgtctgctcaggcctctccccttttctgtcaacaaaattatgtgtgtgccctgggaactgctatgttctcctctaatcccactctttggtcacagttgaatgcctggtagtggtacctaactcaggctcgggggacacacctctgctggctgaagatactagatgtgaacttgtatgatgttggtgaccatgtggtcaagtagagaaaacctgtctgcaaaggaggagcatgatgccaacacatcaaagaagcctagagaggatggagaagggtcc

SEQ ID NO: 34640 - DNA, 1025 bp, Homo sapiens
tttattgtaattgctcaatactgacttctttagctgatcgattatagttagggctgttttttgcctttattacatttctagggaggatgttcagattataagaatctttttataagttagcttggcaatcttgcttctgtggattgtctcatttccattttggatttttatattgtaagttgttgctaaaaattatttttttcccttcttccacttaccttttggaccatgaaggatatattaattaaagtcaagctgctattgagttttgtgtctgaataatttcttatacacttatcatgagatttacttctatcatataagtactgctagtaaaaccaatgaatgtttaactccttcataagcaaaattatttttatgtgatctctaagaaattcctcctttcacatttttctgttttcatacaggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttcttt

SEQ ID NO: 34641 - DNA, 1034 bp, Homo sapiens
actggtgcaggcctgcaggatttggtttcagcatgtccttctctgaatgatgaatacttttactactgtgacaacattaacggtaatgccttttaacagtgcgataattttgaaggaattaatttaaaattttttttagcagttctaataatttttccatttagttttctagatttctaattcccagactatcttactttcagatttagttaaatttgataaaattttaaaattacattttcattaattaacatcttgaaaggtaagtttttcttgcagatgtatattctaaatatccattgtgtcagatttttgagggatgtaatagtgtaatcaaaaatggtaagttaatagaaatactaaaattcttgttaaaagttttaggtattcctctagagttttgtagcactcattaagaatttagaactatttatgttctagatacactgatttcttagggataatagagtcttatttcttgtaagacagctttatcaaatgtagaaaaatgaggactttggtaatgtggacttccagagtttctggatctgatgacaactcttagcaaagattgaggggagaggacagtatgtagtattgagaagagtctgagatgctttagacatgactagaattcctgtagtattttggaaattgattcctgaacctactttcaaaaatcacaagaaatacttcttgattttgttcttttaaacatattctaccctacagtggtcttattgaacatgctttttcaaagtatgttcagtgcctttttgcacatttgatagtcactggtagagactgaatttcccagaagcataaaaagctgctcttctgttattagtaagcaaatcaacctcctgtatttataactggagaaaattttagatggctcagactactatgtacctgtctttttatactgcgccctattgtctttgagtgcccagttcaccttaagatgacaggaaaatcaacaaaatttttctcaggcagaacaattgacaggagtcaggaagaccagagggagt

SEQ ID NO: 34642 - DNA, 1032 bp, Homo sapiens
tttagtagagatggagtttcaccgtgttgcccagtctggtccagaactcctgagctcaggcagtccacctgcctcggcctcccgaagtgctgggattacaggcatgagccactgtgcccggccttgtaccacattttctttatccattctatgacttatgggtatttaggttgagtccatgtctttgctattgtgaatagtgctgaaataaaaataggcatgcatatgtctttataatagaatgatttatagtcctttggttatatacctagtaatgggattgctgggttgaattgctgcttcttggtctttgagaaattgctatactgtcctccacaatggttgaactaatttacactcccaacagtgtaaaaacattgctttttctccacaacctcgccagcatctgttgtttttttgactttttaacaatagccatcttgggaaagaggcagcttgccactgcaggctctgtgagacagctgaaaaactgagtgcccaaagtgtgacagggaaatgtctgcctctgaacacaacatcctcactggggaacctgaaggtctagataacgggagaaggatttgagcttacctggagctgagatgaatttagagagccgggcaaaatacaggggtagaggaagcagtggggagatccctgtgggcattcttggtccccagggaagtcatttctgactttttcttgcagaggtccttggggagggctgtcactggaattggggaaagaccatagggagaaggaaacgtccagctgaactttgttgtaacagtttcaattgaatgggatgtttcctggacagaatctgagggaagggatgaaaggggagttcagatacgagcacagaagccatggcagatgggcaggcatgaaacttgaaagccctgcttgctttctcagtggggaggcttgtagtctgggcaagatcttagccctgctcaccagttgcctggttgagggggcatggtgctgttgggggtgagacctgccttttgggctgtgtgggaactgggt

SEQ ID NO: 34643 - DNA, 1035 bp, Homo sapiens
cttaaaaatgtaaaaatcctggtttagtctcataactgctaaaacagatacttgggcgggtgcggtggctcatgcctgtaatcccagcactttgggagaccgaggtgggtggatcatgaggtcaggagttcaagaccagcctggccaatatggtgaaaccccatctctactaaaaatgcaaaaattagccagatgtagtggcgtgtgcctgtagtctcagctactcaggaggctgaggcagaagaatcgcttgaacccggaaggcggaggttgcagtgagccaagatactgccactgccctccagcctgggtgacagagcgagactctgtctcaaaaaaaaaaaaaaaaaaaaagagattctcagggatttgagcccagaatattttattatacttttttcaagtattcaagtgatttttttttatattcacaaaagtttgtgaactagattatgtttactaatagtcatctgttacttagctaactgaagttctgcagatctttacagtgacaatttcttgccttttaggttaggcagattttagagctttgtcctaacctggagcatctggatcttacccagactgacatttcagattctgcatttgacaggttagttattttaaacaatttaaatataatgaaaaactattttataaggtttcatttatgtaattgcagtttaatcatactattattttttactatcaaatctcagtcatgtctgagtataatttgatagcaccctccagttcttcacttcttactcataggtcccagctgatccaaaaatcccatctgtattatcttgcaatctctgtagtcctatattttgtctaggcccttgagccctgctgtgcaaccatgtagattggtattatatgtttttaagaagttttagttttagttgggctctaagtgccatttggcaaagctccctcttagattcttcacagttactctgaaatagtatagtgtaactttcttcaagccaccttcttcccagagtatatctccttgaccaccaattctct

SEQ ID NO: 34644 - DNA, 1041 bp, Homo sapiens
aattttatttctgtagtcataggtatctaggtatcctaaggaaatacagatttaatgtgttttcttaatcagaaactttttagtagaagcaaaatattgaaaataatctaaatatccagaaataggagttgtttggggctttgttatttgataacccatatagtgatgttataaggccatttaaaataatgtcactgaggaacattaactgatatggaacaaattcatgatacagtgttatataaataacaacaataataacaaaattgcttgccatttctgtgtgccaagcactgctctaagcaccttacctgttgctctcctttccagattagctgattaagtagcttgcccaggtgcacacaggttctaagcagtggactcaggactccacacagacacacttcaccccagagtccatgctctgcctcctgactccactcgcctactgccttgtaaaatagaccatttctatacagcaagaaagtacaaatagaggtgtactcagagaaagcgacggaaagataacatactaaatgtcacagtgattatcataagggtgtggaatcatgtaattttattatgttcttttttgttcaactgcatgtgctaaatgtatttgttgtgtaataaaagaataaatgttataatatttaataccaggaaaaatttctaaatggtataatttcttacaagagaactaaggaggccaggcatggtggctcacacctgtaatcccagcactttgggaggccgaggcaggtggatcacaaggtcaggagtttgagaccatcctggccaacatggtgaaaccctgtctctactaaaaatacaaaaatagccgggggtggtggcggatgcctgtaatcccagctacttgggaggctgaggccaagaattgcatgaacccaggaggcggaggttgcagtgagccaagattgtgccactgcactccagcctgggtgacagagtgagactctgtctcaaaaaaaaaaaaaaaaaaaaagagaactaaggaattccgaagtttttctttgtgac

SEQ ID NO: 34645 - DNA, 1050 bp, Homo sapiens
taatgctaagtgagctaagtgggaaatgatcaatttctcaggtatctcaagtaatttagagtttttgtttgaatgtctgacgtttttgttggaatctcattcttaaaggatgcaaccatgttttggatttcatttattactcccagtattatatatgttataggcatttattaacttcttaatttattttaattcattggtaattttcaagtaactgtgaaaaatcaaaaacatataaaatgagagatacggtcttggagatacattttcagaagtttttttcatagagaaaccataagattaaatgacatctcacagcagctcgagcaggctacctggcttgtggtggaaaagcctcttcctccacacacacagctagattctttgtgtacccaaatttgttttagtgaatggtggtatatttctttataactaagtcacctaacagggtgtccatgaagggcagagggggtatgtgtcactggttccggtagagtacatgtaagatcagcaattcccaaagctgagtggttaaaccaaaagacaaatagtctttatgcctcctagacagctggatatttgaagtcatattctcatttatactgtgacttttaataaattatcttgcctcctttgttagtactatggcagataatatgataaatggagcacttgcttttattgatgaattcaccattttcactcttgttttaggttttcactctttttttaggtttattaaaatttcttaaaaaaaaaaaccaacaaagtgccatttatggaaggttgctctaagttctcagggtcatgaggaacataaaaacagcactagccattttgtatgccaggcacattgctgtgcaccattatctcatttagttctcataataattaagtgtagacacttactatccttaaccttgtggttgaggaagctggaatttagctcattaagaaacttgccctttgctagtgatgtggattaaaaaaaaaacttgtccaaggtcatatagcagttagtagcagagcttatcggcgaaagaggtccct

SEQ ID NO: 34646 - DNA, 1051 bp, Homo sapiens
gctttttaaaattgaaaatgattgtgcagtaatgtgtttctgtatctctttaacccagatggcattcttgtgggctgcgtaatttctttccttgcacttagtgtggacaatgaggatctccttattcccaaacccagggcactcactggctgtgactgcatcatggtaccctgttccctcagggggtttgaggttcaggtacccgttgggttacctttacagtcacttagctacacatacagagtagaggctcctgaatcagcagcagctgctaccttgagtgaagcttttcactccttccctgctaactccccaagtctcagaacaattctgtcacaatcacaagttcttttctcaagtatctggaatgctcttcttttgtcatgtctgatttttgttttatattggtacgttgttatttattaagcaattccattactattgaacattttgattaattccagttttgttttcatatagatcatctttcaatagagaaattcagcggtaaagaaaaatgagaaaataccagaaattatcatatcagaagggacaaatcacccacatgaaagtttagctcagtttgctgttcacatcacttcctcaattctttgtcggttctgttctttgctgcctgactcctaaagagactaatttggccactccgttttatgtctaattctttcttttcttagtcacttccctttccatttcatttttagcttctcactgtctgattctgtttttgttctctatgatttttcttcttctcctctgacctgtatattgttttagcaaagatttgttgagtacctgttatgtgctgggtcccagtgatgcaaaggtgaatgagaaaaccagacaagaaaatgaatgtagtatactgcagaaaatcataggcaggtgcaggtactgtggaagccgagtaggggaaaggacagactctgcctgagaaacttagggaagtcttcacagagagggtaccgtctgggcatgttcactcctggaaaattggtaggggattctcagaccaaggagcagtgtgaaccca

SEQ ID NO: 34647 - DNA, 1040 bp, Homo sapiens
ccgcccggggcagccgccatcgctgtgctcccgtaagtgcttggggttccctggctgctgcccacctctgccccactgctgcaggtgaccgtttgtctgactgtagctttccacaggcgacctgggtgtgctctcacctctggttctgaaacacaccaaagtctcttaagatacttattatcttaatctgtttgaattgctctaacaaaataccttagactgggtgatttataaacagcagaaatgtattgctcacagttctggaggctgggaagtccaagatgaaggcaccagcagatttggtgcctggcgagggctcattcctcatagatggcgccttctatatgtgctcacacggtggaaggggcaaatgggctccctccagcttcctttataagcatgctaatcccctcctaaaggcccccacttgtctcctgcagaccccacctcttaatactattatgttgcagtttgtgttttgtatgtgagtttgagggggatacattcagaccatagcaatacttccagttttgggttctcctgggctgtccagaatgtttgattggctggttggatgggtctgtcttttttgcctctttttttcctctccctttcttttctcccttcatttcttcctttaaaattagactacacattttacttttttatatgtagttctgtctttcaagtcattatatggggtatgtatgtgtgagagagagagaatatgggaaactgttggaggtgtttctgttggtcatcgggggactgtcccccatcagctgtcccaggcagaggcagctgctttggagggaggctactccttctcgctggaaggcttccagcaccagcaggcttgcctcttgcctgtggtcctataaagggatgctgagactgtagggactgcactgattgactttctggttcccttttagttgtgaggttctgtgattctgtgacatgattcccacagctgttttgaatgattcgaatgattcctgaggccttgatgttcttgggagattcatgcatatctgaat

SEQ ID NO: 34648 - DNA, 1079 bp, Homo sapiens
ctacttttggctccagtgttagagaatatgtcttttggagcagcctgttagttttaaatatctcttgttagaaatttagccattcatccaatattgctatggagaagtgcctactctagtgcagacactgggaatgcaaaactaaataagattactacacataggaaattagttttaaaatatatgaacctatatgttaccccaagccatttctgctgtctagggtcatattaaataaacctaaaccctaatccatatgttggcccttcacatattgaaaatagcttatagtggagaatcatataaaagaattgaatggagcagccatccaagtataatgaagattcatctggagggcagacttcaattaaacccccacaacggatactcagccaaggaaatggagaaaatatatagatattttgtatccagatttaaattatatctgctaatcacaaggtagtggcacaaagatcagggccaaaagtgttttgctcaggtagctaggacatatagaacagcctgagaagtatggataacttctcagacttcatgagttaactgtgcaagctggtaacgtatctgtccgccagtgatacccattggactgagggagttacattagctggaccaaccaccagtacttctatgtcaacttgctgttgctaaaagaaaaatgtctatgatgtgtctcaaataattttaaatacagttgagttaatgactacatatttgagtctgctaattccatgcagtttgccaagctcttcctttcaattagcagccgcagtgagacttaagtttgcaactgagaccaagaaatggaaaggatgaggatataccacagtgacctgacacttgctggcttcccatcttctgtgagagctatgaccagctattctcaatgagctctggaaaatgaatgcctggttttcttttattattattattatttttttatttttttgacacagggtttcgctcttgcctaggctggagtgcaggggcataatcttggctcaccgcagcctcgacctcctgggctcaagccatcctcccacctcagcctcatcagtagc

SEQ ID NO: 34649 - DNA, 1033 bp, Homo sapiens
aagtgccgtttacaaagtggcatcaaaaaattgaagcaggccaggcatggtggctcatgcctgtaatcccaacagtttgggaggctgagggcaggtggatcacttgagatcaggagttcgtgaccagcctggccaacatggtgaaagcccatctctactaaaaatataaaaattagccgggcgtggtggcatgtgcctgtaatcgcagctacttgggaggctaagacaggagaattgcttgaacctgggaggtggaggttgcaatgagctgagatcgcgccactgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgctgaacagagtatggtcatttgtcctcaacaaatgaaatagatcctactttgcttaaggcatattctacattcactaagtactgaatagagttaatagatacagtacctgaatctatatagtatgtctgacaggagatgacttggcgtctctagagaagaaacacacttgaagaagaaaatgtctgatattcagtcaagattcaaagtgagcttatttgtttatg

SEQ ID NO: 34650 - DNA, 1173 bp, Homo sapiens
ttttattctttctatataaactttaaggtttgtttatagagttccttaaaaatttgattggaattgtataaattaatagggagaaagttgatatctttatgatatttgttccatccaagagcatggaatgtctgtattttaaattatcatctatattgtttattaggtcttacatattcatgattagttcctaggttctttataggattaggtttttgttgtttgtttttccttctgtgaaatgtctttatatatggtctagttagtattgctggtataaaagttagtattgctggtataaaagttaacagtgcctgagttgaaacactggccccgtgacttactagatgaatggctttgatcacgtaacttaatccacaggtaagatggggacaataaaagtaccaacttttagggttgttagaagaattttaaaatagttaacatttgtgcagttactagagtagtacatggcaaatagtgttatatgagtaattaaattaatgaatattcataggttaatttcagatcaggaacattgttgaactctaatagtttgtatggttttttaaattggatgatatcatctgtaagctaatagttttatctcttccaattcttaacgtatctttttccaaaaagagaaaaatgttgattagaactttcagtactgtgtcagacagtatcagtctcagtcaacatggttatctttagctaatttcactttttgctgttgttgttgttgtagagaagagtctcattctgtcacccagactggagtacagtggtgtgatcatagctcaccacacagcctccaactcctgggctcaagcagtccgcctgcctcagcctcccaagtagctagaactaaaggcacacaccaccacgcctggctaaatttttaaaatttttttgtagagacagggtcttgccatattgcccaggctggtcttgaactcctgatctcaagtgatcctccacccttggcctcccaaaatgctaggattacaagcatgagccactgtgtcctgcccctgacttcacttttaaaggaaatgtatctcatcttattcaggataatgtttgcttaaagattttggtagataacctttaccaagttgagaaagttacattctctttctagtttggtaaaaatgttttgtcttttaaata

SEQ ID NO: 34651 - DNA, 1032 bp, Homo sapiens
ctccctggagtaaaatagaacatgcttgtggtagttacttactgcaggcctttgccattctctgactcttttatttactgagccactcatatatgccagacactgtgctaggagtgtgtgaaagccagagaaatactcattagaggaaaattgctgacctgaagccataccatatgaccttattagcacaactcagtgtattcgataatgaaaatgttcactgactttgattttggaaatcccccctacagagtagcataaacgagacattgatattgtctcttttctcatttaaagctatgcctttaaaggccacccatgttgctgtatatacttggaatgtgtttccacattttaccagtccgcttctccagcgataggaacctagaatgcttctaattcctgtcatcacagatgtagcttcagggtatatcttcatacatgttgttcatacgggaatttctttgctatctatgcccaaaagtaggattgctagatcatgagatgtgcaaatagtttgcctaagtagtgctgccggactgttcttccgaacagttactccactctgcaatcccaccagcagtgccagttccaaaaaagaactcactgacacttggtgttatccagctttcttattctaccaaactgatagcataatgtgatcatattgttcatgccttgggattttctcttctataatttggatatctttgtccattgctcatttctttattgaagttgctttcttaaaaattgatttaactttgtccttggtatctttagttcagtccagaaatgattaattgtgatgtgattaaattcattttttggtctggtgctttatgcttttttgtttaagaagtctttccctggcctcatttcacaaagatattctgtattatatttaactaactatatagttttaccatccccatttaggtctttaatccatcatgaatcctcccttatacatgtcattatatgtatatgtattaaatggttttacttttcatttttttcttaaccttgttc

SEQ ID NO: 34652 - DNA, 1062 bp, Homo sapiens
gagaagggagacgacgctgctgggtccgctgagcggggcgacccgaggttagtggagacggatgctgtcttttgaaggccttagtccctgccctggtgaagccgactgcgaggttccacagggcgtgcaggcagtccggggatcgttgcgaaggggggtgcgggctaacttagctgctgccgtttctagatgtgcagctgtgtaggccctgtttacaagtgtgcataaggacagtgtattaagggagaactcaagagaatggaaaggtctttcgggtagtggttaaaataaagaagagtaggaactaggtttttaaattttaaatgaaattatatcagacagaacttctgttggatctcaggatgcaccatccaaaaataggactgtaggagaccaaaatatgccaccctacaatatacttctagagtatattttgagctggtattctgataaaatgcagacacaggagtcgctctgaaaatctgtcctgttgtaaaagaaattgacatctacagaggaaatatacatcagtaaaggatctgtatcagaaagagggcagctctgcgataatttttgttacctgggagatcttatctgcataccaagacaacttttattcaccgtatatttcctcccctcacctttccacaactttgtggccaccatcccccagaaagccgcaagcccccatttcttgagtagcgtaggatgctgtataatattcaatcatctgaccatggtgggactcctctgcgtatgtaattaagtacgggttttttttcttgttaatgtctatgtcaggttaatttgtaacccagccaaagaacctaggaggatggagggaagccgtttttccctctcctacacctcagtaacctactgccagctgaagaaatagaacattactaaagccacctgtacatctttctccttttgaattacctgccctccgaagaagtaatggattttctgaatttactgttaacttttaccatgcagctttctatatcttaatgacatattttaatatattaatgacatgaataaatccctgaatgagga

SEQ ID NO: 34653 - DNA, 1050 bp, Homo sapiens
ctcattcgcaagaaaattagtttttttctacttgtagaaataaaaagtgaagataggcctccatatattctagacatgcatgacatacctttcagagtcggcttcagcagtctgacacctcctgttcgtcctagctgaaactgtcacttttctctgtccttgaagatagtataattcattatcaggatttattatcagttgctttttgtttttaatctagtttctaggctaactaaatcctttgtcttcaacacaacaatcctttcaacacatgtatctcctacttgttctagccatcttggtaccagttatcactgccacagaaaaaggaacccaagcaagattaaaacttaatttattttgtaagcactaataatgagtaagggaaaataaggaaatttcaagcaagttaaaagaaggcaaattttagttcaatgtatttgaggacagtatatgaaaaatgtgttataatgaagtacctctattattgctatagcacaaagtctgtggagactcatgaaaattaagggttagaaaggtaggttaggtgcataaacaggtgctaaagaaacaacttttttttttcttggaaggtgataaaacatagtaaggtaataatggcttcttgtaaaataacatacatgaccaattcaaatgtgttctaaaatatatttcaatgtaaaaactagaacctttatatactggggattataagattctacttactagaaatttacaaggttaaggagtaagacaaagtttggcttgtgatgtttctcatttataaggaataaaacaatatgaatatatgaagtttggtctattaaaaaggatggtgttctcatggtgtgatataccacaaaaaaaatctgatcaaaaccaaactgttcaatgtgacagtctgaaaattatatactctacttcattcatgttacacttttttctactccttacctgcttttactaatgcatttatccccaagaaaacatccaacaatatgggactaatttggaacaatatccagcaattggtatttaaataatttactg

SEQ ID NO: 34654 - DNA, 1050 bp, Homo sapiens
ttctagtcacctgggacttcgtgaactccagtcactgtctccccaactcaggaatatttccaagctctgttggggttctctccgtatcatgcagcctgaaaactctccaggcagtaagccacgtatctggtccctgctaccctgttacttcatcatggccagaagcagaaatcatattttttctttcagcaaatatttgtccagtttctatgtgccgagtactgcagataaaatgctgaacaagaacaacgaggatctctattctcaccagtctgtattttagtaagagagaaaaacaaacatagaaaacaaagcagtgataaattgtgttaatgaaattggatgatagaaaggagtttctagggggagctactttaggttgagttgtctgggaaatcctttctgaataagtaatgcataacctatgaatggagttgagacatctaggctatcattgatgactgaaactgtgagtagggatgaggacccccaaagagactgtgtagaataaaggagaaaagaaagactaggactcatccttgagaaattcgaacttttattatccaagtaaagtaggatgacttgggatggaagaggcaaaaggaaagtgtgttttgtctcaaaagccaaaagaaattagtttcatgaaagagggtgctttagtctccttgggctaccacaacaaaataacatagatggcatggcttaaaccacagaaaattattttctcaaagttttggaggctggaaggtccaagatcaaggtccagcaggtttggtttgcaagctgatagatagcttgcagatagccaccttcttgctgtgtcctcacatggcagagaggaccctctggtaccccttcctcctcttacaggaacaccagcgtcatcagattagagcttcactcttacgaccttaattacctcctaaaggtcctatccccaaatacagtcaccttcagggttagagcttcgacatatgaatttaggagaaactcaagtccatagcagaagaaatggtcagcaatattgaatgctgccaagggggcaaa

SEQ ID NO: 34655 - DNA, 1078 bp, Homo sapiens
ttggacttatagagtttaattaaaagagaaccataacttcacagaggaaaggcaagaagaagagccttttaagtgtgtgcgaaggacttaagtgtttatcagaacaaaggacaatttaggtagcttttgttaatatggactaggaatagtattgtcagtctttgaagccataagaaaaaagtcatcattaaatttgattccagaaggcagtgatgttagtttggggctcttaagaagaatatactagttaggccaggcgcgctggctcacgcctgtaatcccagcactttgggaggccgaggcaggtggatcacctgaggtcaggaattcaagaccagcctgaccaacatggagaaaccccatctctactaaaaatacaaaattagccgggcactgtggcacatgcctgtaataccagctagtcgagaggctgaggcgggagagttgcttgaatccaggaggcagaggttgccgtgagccgagatcataccattgcactccagcctgggcaacaagagcgaaactctgtctcttaaaaaaaaagaagaatatactagttagtgtttgaagatacagtcttttcagtgtgtaaatcagattaaaatttagaggggctgaaatatgggaataattattccttttttgttccctaatactaggttgcaagtatttatgtgacaatatctgacagattttaagataatagcttataagatagggaaagaaatgtcaaaagataactatgatatcgcatgggtgtccaaccttttggcttccccgggctacaatggaagaagaagagttgtgttgggccacacataaaatacactaacacactgactatagctgatgagctttaaaaagccggtgggggggttccctgtgttatttttatgatatctgccaccacagatgggtaaaaaaaatcctcacaatcaaagggttggacacctgtgaaggcttaaggaaaaaaatatcagtacttagaattttggaactcggaaaatagaggatttttagaattttttttatttgcttttccatgccttatattcccttatatctcctctccttttgg

SEQ ID NO: 34656 - DNA, 1054 bp, Homo sapiens
ggattaaaggcacccgccaccacacccggctaatttttgtgtttttagtagagatgggatttcaccatgttggccaggctggtctcgaactcctgacctcaaattatccgcctgccttggccttccaaagtgttgggattataggcatgagccactgtacctggccttgagcccatatttaatccatatttcagctaaccaagcaaataaactattagaaccttttttaactccccaagctgcaacattaaatgcagaattcctgcttagtgagcctaaatccataaattcagcctgatccaactttatgtttcttccaccattatctcacacccttaatattttcatttccatgcctgttctccagatttctgcttatataagttagaaaactcaagcagttattttggagtgtagcacacctcatcatggatcacactttgaacttcacctctaggggcctgccgggactttagttataggtctagaagcaaacaggggtgttggggttgggtcctgaggagaatcgtcactgtctttcctggaagctgccttgggggggccatcacttttgcctcaggcagtgcacgattaatctcctcagacaaaggtggaaatgctgatggctgcccaggttggggaagggatgtgttggggatgttgacaccactgggagtggggaggctgtttcctctgactaaaagctcatcagaatttaggagctcagtgttcccagcctcatcaggtttctcccacaagtccccattccaatttgcaaggccccattcttttacagtcactgccctcactttaacactagataccttgcgaggctgtgtgtgcaccttttgttgaaggtcagccactcgcatgataagagcttgtgtctgattttccacaatttcagctctttcttgacaggagataaaactgtcactcagggcaatcttagaagattgagactcagtatgttcctcttgagccgggagatagaatccctgagttcatagttttctttcatcactttctctagtgaacttaggagcaaccaacc

SEQ ID NO: 34657 - DNA, 1046 bp, Homo sapiens
ttatttttttccagatttcatcccctctcctggcttcaacacttcacctctgtttagatgaaccaccgcctctttcattattcttttctagacaccttcacatatatattatgggaagaattttaagtcactggatctaaaactaaacttactttgcttttaaaacttgttcttttttctgctgtgttctcctttaattagtgccattgacactttcctactcacccagagttaaattgcaagaataattttttattctttgtaccttcttactactttctctgaaaggagttataataaatagctagggattattaatgaggctgctatgaacattcttgtgtaagtctcttttttagacatctgttccatttctcatgggaaaatacctatgagtagaattgctgggttatgggatcaatgtatatttaaaatataaaacataaaacctatttatattatctaatatgaaagctatttatatcagaaactgccaaactgttgtagaaaatatattatttgagtcttactagcaatatgtaagaattacagttgctccacatgcctttgagcaattgatgttatcattccgttactagctgttctagtgggtgtgaaatggtatctcattttgctttaaattgcatatctttgatgactaatgatgttgtgcacattttcacgttcttacagacaattcatgtatcttcctttttaaaggatctgttcaagtcatttgctcatttttaattgggttgtttgctttctgttgatttgtaggtgtttgttataaattctggataaaagtcctttgtcagataattactaatgttttatgtttgttgaataatgctttagcctggttgaagtgcttttatagactttgtccctaattagttgggtagattaaccttgtgaggttgaagatgtgttagttctgatgccctccctagggtaggtaaagaaactagacatacaggagaaactaaattaagactaagacaactaagaaaataagaaaggggaactctgaaacagattgagag

SEQ ID NO: 34658 - DNA, 1031 bp, Homo sapiens
attctttatgactagtttggtttctacttgttgcataagtataaattagggaaatcagtggataattaaagtgttctttggatttttctcttttagtatctatttagatacattgatccggtttctttaatgctgagtttctcagccttggtgctattgacattttgggccggtgaattctcttttattgtgaattgttttggatatttagcagcacagttggcctcttcccacaagatgccagtagttccatttatatgtttgtgtttgggattaaggagaccaggaccttgtaatagcaacacctttattaatggagacactgtagtccttaagtcatagcagaaaatacatctgacatatgcctaaaaaaaatgactgaacagaatagtaaaaaaaaaaaaaaaatgcttaaaagaaaggtagtggttaccctgaaactaaataaattgaaaaagcactaaacaaagccagacaaaaaatgggttgtctttcttagaagaaagtaggatgtaagtaaatatggcactgtggctgtgaatttcagaaagctacctgatgtgaggaaagataattattaataataggcagtttttaacttgcaaattgggctgtattctaaaagttgttttgaggatgaatagctttggtttcagagtgacattttccctcaaacatttatacaacaaatatttgagtgcctagcatggaccaggcattgggctagcatagccagcaggatgacaggatccttgcttctttggagcttatagtattgtatggcatttatcaaataaaaaaatcacataaattaacatttatgtgattttttttttccctattactccccttctcccagtttgagttgagggcgcaactcttttctctttactcactgctgtatccccagagcacctggtaaacagggaaatctttgttaaatgaataattgattagttgaaagagacattaaaaaattacaggtgatgaagtagagttgtgatcagtgttccaaagggaataatacaggg

SEQ ID NO: 34659 - DNA, 1066 bp, Homo sapiens
cagttacttttgcaccaacctaatatgtaacatacctaaaagttaactcttgatctctctctaccaaatacaaagtctatttctctggtgttctttatctcaacgtaccttaaatttcacaagtcaaacacctgaaagtaatcttttacttatcttccttctcatctgctatgccaatccaccaattatgttttcaaatatatcttaaacccattcatttccctttattttcactccagttgaagtcagcctcatttcttacctagactgatgcaaaaaattcttatatggcttcctgtcttctccttttattctctctagtttagtcttccatggtgcaaagaaaaatctgtttaagtactttgctctgctctcaacctttaatgacttctgcaccaacgacaaaagcacggagatatggatatattctgttcttggaaaattatagcacccccaaatttgcagtgtggcagaaaccatggctgtacaaaagttggcttgaggtcagattgcgatttaaaaaaatatgtattgtcctgtggactttggttctttttctgttgctaattgggattaaattgatatttaagtttgtttttaagcagtgggattgatagagatgccactttccacattccgtttagtgaattcactggtgcagttctgttttataccaaccccatgcaaactctgattactctttctttggagaaatcaaaagctttcctgagagaataccttcccaagagaatatatgaagacttgggctgagttttaaaaattatcatggacaattttaaatatgtacaaaaataggagaaagcataatgaatctcaatgtttttgtgacctagctttaacaatataacaaattctggcttaatttttaatataaaaattatcaaaacattttatatgttggttgtctgatgtactgtaattcattccatgttctcatctgaataaacccaaattacacattttcttggagttgtaaatttacaacagaaagtgaaaagtattaacatcatgacatgttgtcttactgttgcttttagcttaatat

SEQ ID NO: 34660 - DNA, 1054 bp, Homo sapiens
attttgtattttgatgtaatttcaatcttaaaagttggaagaatagaactcctatgtacctacatttgttgttttacattttgctgtgtttatcattcttgctttatactgatctctctatattttttcagaacagtttgagagtaattcagagacatcaacctctttacccctaaattcttcagtgtatatttttaaaaaacaaggatactgtcttacctaattacagtgaggttattaaaaccagaagatttaatgctgatacactgttacccaatttatggtccatattcagattatatctgtttatctattttttctgttagctttttttcctcttattctgggatccacttcaggatcatgcattacatttggtaattatgtctccttagtcactttcaattgggaacacttcgtcaaccttactatttcttgaccttgacatttttaaaagtacagggcagctattttgtagaatgtccctcaatttgaatttatctgttgctttctcatgattagattggttatgcattttggcaggaataccacttaagagatgttctgcccttcttagtacatcatatcttgagattcatgatgttggtgtgtaccaatgttggtgatgttagctttgaaaattttgttaagctggtattcctcatatgtatccctgaaagttattatttatctcattgtaactaatatgcaatttgtggaaaaattattttggggaacagtatatttacatagtataatcaaagtttcacccacaagttttagcatcagttgatgattatctgacttcattccttctataattattagttgacattcagacataaggtaatctttcccatctccattatttactcagttgtttttatctgtatgaactcatggatttttaattttattcagtggttaaatccattgctgtcattattttgattcacaaattgtcccaggtttggccaatgggtgtctcatcaagctggttccagtgttatttctgcaaaaacaagatactccagcttaattttgtattttatct

SEQ ID NO: 34661 - DNA, 1068 bp, Homo sapiens
taaatatgctatatatctgtagatgattttcagattactcaagcaatgtataaagcacttatttaaaaacttaattgaaatcatacaactgagacaaatctatttcggcaattccacgtttcttcagatatctaacgaccacctacatattttcatagcaagttatatgcagttttgtaaatcatcaatataaatcagggcaattaactagttactgagcatcactctgctgagagtctaacagaaaatattctcaatatgatttcattctcactagacattggtaattctgctttggtagctgggccagtacaggagccaaggaatcttgatttttaattccctgacttacatgaaataatctttctctacaaggtaatcttatcaaaataatatttatatttgaaataatacccagaagtgttgttgttattgttttaattaggagaaatagcaattcagcaaaactaagaacattacatctttaaaatgtggagtagtgatcaagagtgtagaattggaactggacagcttagactcaaaattctcgtttcgccagtgtcaccttggccaaaatacttaacttctctgcgctttggttttcttatctgtagaatgataaaaataattgcacctttctcattgggctgttgtgatgattacataagttacatgtttgaaaacaaaagttaagtgtttaaagcccacatagtaagcactaaatagagtgaaaccattttattattattaatctgtttaataacctggcaagggtatgtctcaggccattaatgtttgttttctatgtatcttcctacccttttttttccctctcactagtatcttgagagttttttgcctacttcagccacaccaatgctgaaaaaaagattcaaagaaattattgacttaaatgctaaacagatttttgggtcatgttttgttttgtttcttttcccatagaccacaagattgagggcttggagctggagaaagggaaaagaaaaagcagactgtgactctctggggaaagaactgaaagatgacactaggaattctcaaagcgag

SEQ ID NO: 34662 - DNA, 1046 bp, Homo sapiens
aaacttagtgactctcctatgctctgcccgggttctttcttccagcatggattgtaaagtaccagcaggaagaaagccagagtgattgtattgtccattttgattatttatcttaacttagggatcatagttctttgaaatatatgttccaattagcaaaaacagttgtttcacatatgtagtccatttttctagttctttatgatgggtggacaagtctatcttagttactcctttacaactgggagtaatgtcctccactccattagattttaagataacttataacatggtttattaattcccccagaggtaaccaaggcatataaaactgtttgctcaaatatattttctattaataagatagaaattttatcactcttacaaattaaaggaaatgattgcaaaagatctagagaactgatggttgaaatagaggcttcagtagctaataagaatgtttctcaattagcaacataaaaccatgtaattaagcatcatttgatcagtcaagcatcgttgttgaggatctgtataatttcttactctcttctgaatttggcagaacattttttcattgtccatacatattataataatgtcattggtttttatcattttctaaagactgagtctgattatattttgaggaactattaattcttggcttacatggctcttagaaaacctttttttctgattcaatttgtccaatgcaaaatgatgtaaatttcttctctctcctctctttagccctaaagagtcttgggacattactttggaattattcattcatttagagaaatcaaagaaagctagctaagcatttggtttcttttcattttcattatggaaattccattttcacagattttgacaatattgggttcctaataagtaaatacttaaacgtcagagttatcggataaacaaagaagaatctttagaggtgaagtgtcccatattactacagatgcgaataaaacacataaacacaaaaacaaaaaggctaataagtatgccagattctatatttcctatcctgc

SEQ ID NO: 34663 - DNA, 1060 bp, Homo sapiens
atatttcttgtatcaaagtctatttgacttctattaatatagcctttccagttttcttttctttttttttttttttgacagagttctgtctgtcacccaggctggagtgcagtggcaggatctcggctcactgcagtgtctgtctcccggattcaagcgattcttctgcctcagcctcctaagtagctgagactataggcacatgccaccatgtctggctaatttttatatttttagtagagacgcggtttcacaatgttggccaggatggtctcaatctcttgaccttgtgatctgcccgcctcggcctcctaaagagctgggattacaggtgtgagccactgcacccggccccagttttcttattattaaatttttcatatatccctttttccatctttttattttaacccatctttgtgtatttaaaatgaattcttcaaatatatcacatatagttgaatcttgctttataaaaaatacagtctgaaaatcactgccttttgttggagtagtttataatttaatattattaatattgctgggttaaaatcttactgtttgttttctgttgtcccatttctagtttgttccttcttaccattattcctggctctttttttgatagggtatttttaatatttctttttatcttcactattggtctgtttgatcttttttcttttttctagtggatatctcagggtttgcaaaatacatatctaatttctttcttttttttaacttttattttaggtttgagagtatttgttatataggtaaactcatgtcacaggggtttgccgtacagactatttcatcacccaggtattaagcctagtacccattagttattttttctgcttctctcctttcaaccaccctctactctcaagtaaaccccagtgtctgttgttctcttctttgtgttcacaagttctcatcatttagctcccacttgtgagaacatgtggtatatggttttctgttcctgtgttagcttgttaaagatgatagcctccagctccatccatgtttgcacaaaagacaagatcttgtt

SEQ ID NO: 34664 - DNA, 1051 bp, Homo sapiens
tttcattgaatttggaggaaaatatgtctcttctcactagcatctaactggttttcattatcccaacatttctttgaatttccctactaatattctggacttttaacagagtgcaactattttgaggccatgtattacaggctagtgttacgggcatctcacaaaggcaaattgctcagaattggtcctgacacgcttttctctggtcttttcccttttgtgtacttaatttacagactgcagggcctccaagggttggaactgtgttctgtctatccctgtatatccattacttggtactgtgcctgaccatggccggcactcaatatttgtcaagtaaatgggtgaattgtaagttagaggctcatcatagtatagttgagtagtctagctggaattcagtttcctctgttctcatctctgcttcccacttactgtggtttttgtcattaactgttcatcatttgacaaggtgaggagtttgttaggcatcctgataccatctttttagatctgtaattgtagattgtgaacttatgattctaccttgggaaaatttgccccttcccttcctactctattgaggtcatcttccatttccttgtctggttgtcacttattctcttcctttcttttttttaatctagcttttcttgtttcagatattttattaataacagcttcctaattggaggtatatccactgtgggctccttcgcttattcagtagtcactttttagctataagagtcagtgcagaaagagaatttagtgaagggatgtggttcttacaacccaggttatctggcatggtggccagggtagaggtgtctttccaacttgctttggtcttttataaagagagtagcattaagatgcccattgttttcatttcggagaggcagtgtctgcattgtttttgggagcaaggacttggcagccaagctcctttgaatctaatccttaaggcacataattttctgtgcctcagttttttaacatataaaatggggctaataacatacttacctcatacagttatggtgctgga

SEQ ID NO: 34665 - DNA, 1031 bp, Homo sapiens
attgcagtgtagcagtccattgtatcaatatgccaaagtttgttcattttatcattgatagccatttctgtttctaggttttgggtgtcaagaaaaagctgctgtgagtactcatgtatatgttttatgatggacatgtacactcaggagtgaaattgctagattgtaggctttccatgtgtttagctttaagtagctaaagccatgcagttgaccaaagtggttatgttggtttacagtctcaacagtaatgagagttccaggtgctctacattttgaccatgcttggaattgtcaatcttcagttttagtcttctggtggtagtgttgtgatgtatcattctagttttaatttgcatttctctggtgactattgatgttgagcacttctttagctttttattggcagtttggatatccccttttcctgacgttcctgctcaagtcttgcctatttttaattttgttgtctttcattttcttaattatttataggacttcttaatatgggtactgaatatgagctccctgttggatttatgtgttgcatacatcttctcccagttcatgcctttttttttcctcaatattgtctttttatgaacagagtttcttaaattttctgaagtacaatttcttggttgttgttgttgttttagttaatgctgtttaagaaatttttctaccccaagattatgaagatcttcttttttgttctcttcagaagctttaatatgttttaccttttatatttagttctgtaatttgactggaattgattttttgttgatgatgtgaggtagggagaataaaatctttaaatttgtattctttgttccttagtggggaaaaagcaacatagaagtaagtcatagtcgtcttttaacatttttgtttttttacatttctgatttcaatctattttaaaattttaatggtaaactcttattataattctttattcccttacacacaggatgccctgatatattttctttggattcctttccattgttcagatcctggtactt

SEQ ID NO: 34666 - DNA, 1050 bp, Homo sapiens
aagaacttgaaatatcctgtctcttacaacatttgacattgagcactttcattgccattaatgtggtgcatttgtttcttccccattttatcttcgataaagtccatttgctcatgctttcggttgttcctcccactttagtgtgacaggtgcaagaacaggtggaggagtccttctgacccttttgtggctggagtggccttcggggaatgaggccaaggagaaatctgatgcatgctccttacactggttgcagtttttaaatgagctttgtgtgtcaaatttcaggaatactttttttaatccagtgtaatttttcatgcattgttaccccttttgtgtcactttttgccactgtgacatattcagagctacttctgtaaccaagctacagaagcatataacattttctgattatctgctctagggaatattttggcaacaaatccctttcctccattcttagccatttggagtgaaataatgagaaaaatagcttgttctcaactaaagcaattactgttgttcgtcctgtaccttcttagagatatttgttgtttttttttttataattattaacacaagttaatttctttactggcattatctagcagggcatagcagtagttctttgatcatgtaataatgatgaatttttcaagaaagatgacgtgcccatcagatctcatgtcaggtccctataaaattcctacatttaaaacttcagagaagtattaaacaataagtttagttgtaactttgctaatctgtaagcactgcctatatttcagtggtgccttacaataaaatcaatatttttgtgtattttaaagttttgcatccagtgggaattttattaatatttttgttagccataaagcatatttcaccatgttatctcttttacctcttttatttttgcataaaatcttcaaataacagtaagtcagaataatagacaaaatcttaactaagttattccaactactgtgaattcccattaagactttggacttactagtttagcatctgtataaacggctgattgac

SEQ ID NO: 34667 - DNA, 1024 bp, Homo sapiens
gcaacatgtttcagtgttcttaaaagactgatacaggcagggcgcggtggctcacacctgtaatcccagtggatcacttgaggtcaggagtttgagactagcctggctaacatggtgaaaccctgtctctactaaaaatacaaaaattagctgagcatggtggcaggtgactgtaatttcagctactcgagaggctgaggcaggagaattgcttaaacccaggaggtggaggtttcagtgagccgagatcgtgccattgcactacagcctgggtgacaaaagtgaaactccatctcaaaaaaaaaataactgatacagttagatctagtaattctgtatcttatagttaattcttaggaaatgatcagctttgtatgtaaatcttcagactctgtgtataagcatatcctaaattctcaaaaataggggattggtttaattacttgtgacatatccattcagtgaatgcagctattgaaaatcatgattttgaagaatatctggggaaaggagggaaataacatatttgccacgtgttaaatgaaaaagaaacaaaaacaaaaacaaaaaacaaaaaagcacacctacacacacaaccccataaaacaaaaacagtcctaaagtgatggggggaggtcccagtttagtctttgtttggaaataagctatcatatttttttccttttctctttattattattgttgtatcacaagtaaaatatgctcactgaatgaaaattaagatttgtgcaaataaataaaagaagcagagaaacaaagaccatgtttatgttcatgactgaaaatagctagtgttaagacctttttgtatcatcttctacgacttttttctattttttaaccaaaatatcgttacactctaatgatattttataaccttttttaagttgaattaatgtaaatgtattttctcatttaaaatagatgcatatcaattcattgtatagatgaagccatagtttaacaacttctctattacagcatatttagctcgttaataatt

SEQ ID NO: 34668 - DNA, 1034 bp, Homo sapiens
taagttagttaaattaactgcttcttaactcctttgtaattgccctgcaaacatttctatctcagtgctttttaaaatctcttcttgagctttttgtatttttactttttctttctttttttttttttttttgagatggagtctcgctctgtcgcccaggctggagtgcagtggcacaatctcggctcactgcaacctccacctcccgggttcacgccattctctgcctcagccttgcgagtagctgggattacaggtgcccgccaccacgcccggctaattttttttttgtatttttagtagagatggggttttgccatcttggccaggctggtcttagactcctgacctcgtgatccactcaacccagactcccaaagtgctgggattacaggcgtgagccaccacgcctggctgtatttttactttagaggactgcgttagaattgacaaaaccatacatctgtgaagtaggcttttgttatgtttttggacagctatgactgaagtaatgaaaaacaaaatagtaaagtggagcctactattttgttgattttagttttagattgatttctagctttggcctagggatttgacacatcagcaaatgttctttaggcaaaagagctgggtgagacagagcttctgttagggcaggttgctattttcttagtatttcctttgccttcttcgtcaagaactaaaatgtttggtaggtttagaacttgggttgtctcttacatttttaccagttatcttatacctgttatgagaatgtatacatcatggaacacaatgaacatcatccaagtaaaacatgaaaacataaaaataatattgccaagcttcccactttgagatttgattgagatgatcttatagttcatgtaataatagattatagtggcctttaaatttgatttatttgtatttgtatatagatttctggggtacaggtgcagttttgttacaggcatagattgcatggtggtcaagtcagggcttttaggtatccatcacctgaatcatgtaca

SEQ ID NO: 34669 - DNA, 1032 bp, Homo sapiens
tgaaatgagggaggatctgtgtcttagaaccaaggaaacagaatttgaaacttaatggatactcattgagtatgtcatggtttttctaattccttctactgttcgtgaggtagattttattcttcccattttatcaataatggaactctgttactgagaggaagtgtgactcgcctaaagtcaacataacttgaaagggatagagctggagtcgaaacccagttatgcttcactttaggaattcctaaaagaaaaggctctgatatgttaatctgcagggattttaaaatttcacttagataaaagaaaatcagatgccaaatggctgttttgtattaataccaggaatccaagttgtttttagacaaaataataatacctaaaatcttctgatccagaggtatgctccatttacatttgtatatacaaagaagtgctgtgttgcattgtctcaaaaaacactagctcacactgtacccattgtgaagggtgcccctgaaagttatgcaatgctgtgtgtgatggagaattttctgtcccagatgcctgtagtgtgcctcgtgaccaacattagtgtatgttgaagaacttggcgtttggagtaggaactcctgggtacaaaatctgggtctgccattggctagtgtaatcttgggccctttacttaactcttttgtgccttggttttctcattttcttaccttgatattcccactccccaattcagataactagcattttcacctcattcatggatgctcattattgatattcaggctccaaaagctacataaagttacaaagcctagaaagagtgccagataatatgaagtctcttctcaggcaagtccgacctttgggataggcgcaactatgacttctttgagtcagtttttgttttcaatttaattttgataaacattgcccaaaagcatgagatatattatgattcagctgcctgtgtttgtctgtgagtgcatgtgaaaagcatatttttacacaaatggacagtagatttgtatattgttaaat

SEQ ID NO: 34670 - DNA, 1063 bp, Homo sapiens
ccaatagagacagaagtgggaataactagaaaaatggattttcttaacagcatcctggatgattcccaagaactgaaaccatagggggtggcaacaaaagtgactaatgagagcgcctggccaggaattaataacctgaaacagctgctccagttctgctctcagtctggctctgaggggatagtggtccagtttgcttctgcaacaaggccatttagcttagttttaaataatctgggagatttgccaaggcagaatatagtgggcgactgtatagcaggagggagaagttgtagcaggtgccaggtatcttttgtgtctccatctccacggatatgaggtttctgaacctaaaagtaaaggcagttcattacccattattttcatgtgtgctaaagaaatcctctgcagcaactaatagtgagcgttctagccccacatttgtaaatatgagccagcaaccaagaaggatcatcagacatttgagaagaaatcaacagaatgagaggccaccaaaccagtcccatggaaccactggggaaaagttaacacaggaaaattctaattcatagtctcagatccaagagcagagcaactgattaaagaaaaaaaaaagcatctaatgggaaaggttgagcaaaggaggagttcttacaagttaagtgtgggattataatgttaaaaagctctggtgtgggccgggtatggtggctcacacctgtaatcctagcactttgggaggccaaggcgggtggatcacttgaggccaggagttcgagaccagcctggccaacataacaaaactgtcaagtatggtggcccatgtctatgatcctagctattcaggaggctgaagcaggagaattgcttgaacccaggaggtggaggtttcagtgagccgagatggcaccacttcacgccggcgtgggtgacagagcgagaccctgtctcaaaaaaaaaagtgctggtgtggggtcagtaggtgggctgaagggagaaatggaaacaaccaaggacttaagaaaattagtcttctggaaaattaagcagaggatttattcca

SEQ ID NO: 34671 - DNA, 1031 bp, Homo sapiens
tgcacacaggaagaacttaagggaaaaaaaggaataaataatagtagttaccaaaaatataataaaaactaaataacacaaaatattaaaacattgtgtcatctggtttaagtggtacttaaatagaaagccttgacaaaacagaaagccttaatgtatgtattagaaaacaagcaaacttcaacgttattgagctaatcacgtaagagaggaagaggaagaggaaaaatagaaggaagagaaagatggtaaagaaaacagaaggagaaactaagaaacagaaagagaaaaactaaggtaagattagaaataataagatagaaaaaaaaactcaggggaacgccccggtggagaagctgaggtcaacatcagatttgaaatatttaaagtggatacaaaactatttcagcaatgcagacaattaagtgtgttgttgtgggcgatggtgctgttagtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaatgtgaaagaaaagtgggtgcctgagataactcaccactgtccaaagactccttttttgcttgttgggactcaaattgatctcagagatgacccctctactattgagaaacctgccaagaacaaacagaagcctatcactccagagactgctgaaaagctggcccgtgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcat

SEQ ID NO: 34672 - DNA, 1069 bp, Homo sapiens
ttgtttaaaatacagtagtgaatagaacagatatggtctctactgtcatgaagcttttattatcctggggaagtggacattaaacagtagataaactattaattacaattggaaaggagagttttccataagagcaactaataggaattctgacctcactgcaagtctcagaaaaaatgtgattgttgagcttaaggttgttgtagacagtgtgtgtatgtgagaggcttgggagtggtgcagtgtgaatagggtgtcccagtagcagggaaagagcatgtgcaaaggctttgggaaggaaggtgcacagtatatactagactaatagaagctcagtgtggctggaaaagagagtcacagaaagaatgcgatataagagataaagcccatgatgacaacaggcccagaccatacagggccttgtaggtcttgttaatgatttaggtctttcattaaaagttatgagaagccattggaatattttagaagttaatggacgtcattggattcctgtttccttagcaaagactatcctaacaacaatggaagaatagattggagaagaataaacatggacacagatccaagttaggagattgtttgttatactagtccagaaagagaagctggaggcttggcttaggacaatggaataaagaaaatagattacagagagatttaggggataaaaattaataggacttgagtggttagacatgtggagaggaacaagagaaaggagtaaagggaggtagttaaatttctgtcctaaataactggctagatggtgttcatttcactaatacaagaacattgggaaagaaccaaatggggagagggcaaggctggagggtcgggcttcggtaatgttggtgtagtgtgaggttcctcaggcacaaccaacctgagatgtcaagtagacagttgattatttgcacctgaggctcagatgaacttactttcctaataaaaaatagaggcgagcatgttacatgtggtagaataagaccagacattggtaagcttatcatccaggaagataaagggtctgcaaattgttcagttacat

SEQ ID NO: 34673 - DNA, 1033 bp, Homo sapiens
atcctcatgaagtgtttcaaagaaatagagcacctttctgtaaaaatagatccacgtaaagttttcaaaatattcctgagtctggcaagggtgggcctacctgaagtttctcctgacacactgttaattagctgctttgtaggtaggcatgtattcttcagtttgccagaaccccttgcatgccttcatttagtctacctgtaggcattgttgggtgagaaagggttttgaagtgggaaagcttgcaaagactgcttttaacggaaagttttcatgggcaggattgagaccaagaggaaagaaacttcaagttaatggactaccttgaaattttaggcaaaacctgtacctgtgtcatgggagagactgggattatggccacacttgatctgaagttgaggtcaaacttggtgatgttgccttgaaaatagagattttcatagaccaggacgaagatagaagggaaagttacaagggacttcagcttaaatttagtctctcttatcttggcacagagggatgtatctgttaatctgaggtggatcaagttcaggcttgagagagggagtaatgcatgagactttgaaagtagtttgattgtgagtaagcaagagatggtgaaagagatgccttagatcatgggcatacttagatcttacaattttgatgatgaattcacgctagcctgagaactgaagtggaaggctacccctggttgatgatgggtagcagggatgtagaaaagtgctaaagtctttaagatcttgccctttaaaagaatcatcaggtggggcagatgattaaagatcattacttagggtttaatgcgttcagtgtgtttagatttgcgtggcagttatacccataaactcatcaagaaccagtggattttctgtatgtcatgttctgtggtttttggttagtagcattgatgaacatactctacactcaataataaacatgaagactttgctgagaggtttcttcatttcagctcatagatttgcaacttatgtaaagaattgttaggcag

SEQ ID NO: 34674 - DNA, 1049 bp, Homo sapiens
gcctgctcttggagcataataggtatagacaaatgggcatgcctgtgttctaataaaactttccttatggatactgaagtttgaattttacatgctactcatgcttcacggaatgttttttgtatgatattttttctttctaattaaagataaataaaccattttggattcacagaccttacaaatagaggctatgagttggatttggcccacaggcagcagtttgcttatctctgcttttatcagacagtgataaataagtatagccatagaatgaaaagtaaaagggaggcctgcctcttcctaattatgtaggtagctttacaactagcaagtcagaagcattgtattaataatatactgggttttggtttcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggtaagtacaccttttgttctaacagttttttgttagtactttgctcaaaatggaacctgactgttgctagagtcatggccttgcattcactcattgagaatttatatttcagtgtgtaggtatgagggaattgactggatggtgtgattaatctttcacacccttcctttgttaagtggacagtgggattgttgatatttatgggcaggatttgaagccaaatgtgaagttacatttgaatagcatgaaaagtttcttcaggggctgggcatggtggctcacacctgtaatcccaggactctgggaggccaggatgggaggatcacttgaagccaggggttcaagaccagcctgtgcaatatagccagaatccatctctactaaaagatatataggtgtgtacaaaaattagctgggcatggtggtgctgcacgtctatagtcccagctactggggaagctgggcaggaggattgcttgagcccaggagtttgaggttgcag

SEQ ID NO: 34675 - DNA, 2278 bp, Homo sapiens
gaaattagattttccctaaaggagaagaaatattgttaagaaacaaatgaatagctattcttacagctaaaaatagaaaataagttcttactgacgattaaaatattctctgctactagttttagcacgggagagaactgactccctattgctgagtggtttattgaacttaatgctgcaaatatttcaaaatattctgtggaattaaaggataaattgaaaaaaatttaaatgtaaaattatggcttagtttagacgtatggtatattctaatggtgtgaattttttatttaagaagtagctaaaatgttttcttgcagagttatgactgatcagactcagagcagatgggcagggcagtattgagtcactttaattaaattgtagcttcatttgcggaggtggtggtaggttgttgtctgcctttcttatatgttgttttatagattctcccagttgtacttctcccaagattttagtttttagagaaagtgtggggcaagaactaatggattgtgtacttacttgtctatctgcctagtttttatttctctaggttctcttatcagatatacttacatgattactgttgtttgagtttagaatattagctctttaagaagtttgttgttgtgatgtagttgtaatcttccaactacatctcagttttatttgtaattaaaaaaaacttatttttatttattacaaataaaaacctttagtttgtcaggagaatgagcatttatgtgcagcaatgtaaatggactgtttttaaatggtccatttataggaaaagtgttgaaataagaggcaagtaagaagtcagggaataaaaaatagtttgctgagcttgtaatgctttgtttgacattaaaatagtttttgaagttttgaggtcctgatactaacagtgcaaatctagaggcctttgagagcactacttatttattcccacttaactctagtggctagttcacattaaaattcacagctgtgagaagtttgtgtgcttttatgaattaccttgcttcaattaaattaagcaagagttttaatatttattatgatcatgttttgttgtcactatttggctattttggcatctttttaaaggggaaactgtatgggaaagagtaatatgatactgtattttatcttgttgttgattattcccattatcttctatccgaaccgataatttatgaattttttcattgacaaggttttaagagcttttaaaatgtgttgaaaaagtcccaagctgttaagtatttttattttcatactgcttttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacg

SEQ ID NO: 34676 - DNA, 1042 bp, Homo sapiens
ttgattcttactggtcataatgtaaatcccttgacaaattcaaggtcattttgtctcctgatgggttcctggttgtatggtgtgccatttacaattagaacatggttagggcttgcctcactcaactgctgaagtaccaaagaagcttttatcttgtcatttattagttcgcttttgcattgtgtgtgtgtgtatttagccttagctatttttagtccttgagaaaggcctaaaacttgtgcttttttgttaaggactcaatttaacacttgtattttagggtttgacttttggctggcaataggctcttactaatatcaataatgacgagggtttgccaagttggcataaatcatttgattcttaaacacttgcagaatcatgtatccgcgaattgttaagtattacagaatttaatacactcacccagacaaaaaacatacacacaggatgaaattattttgtggagaaaaattaactttttataatggtaactaaagagttggtcacatgagaaatttttatcacattgtattatgttatagaagaaatatgtgaaatgtattttttcccagaacaacttttttaaaagtgattttcttcataaatattttcagaactatggttttcaccccagaattccagaaagccagaagacgtcttctgtatttacaggcatgtagttggttctgtatagatttgagatagggtctcagtctgttgcctagggtggagttctgtgccatgatcatagctcactgcaacctgaacctcctggactcaagcagtcctcccaccttagcctcctcggtagctgggactacaagcatgtgccaccatgcctggctaatttcttttatttttttgtagaggtggggttttactatgttgtccaggcttgtctcaaactcctggactcaaataatcctccttggcctttttaagtgctgggattacggatgtgagccaccatgcctggcctattctgtatagtttatagagcatttccacatccttacataatttattccctacaaccctg

SEQ ID NO: 34677 - DNA, 1034 bp, Homo sapiens
gatatagatatatatatatatatatatatatatatatatatatatacacatacatacatagagagagagagagagagagagagagagacatatatgtcttaaatatttatataataagttaatgcatcctccaggcaaagctttaatttttttttttttttaaacaacatggggtctcactatgttgccagggctggtcttaaactcctgggttcaatcagtcccccctcctgggcctcccaaagtgctaggactacaggcattagccactacgcccagccctcagcctgcctagttttcatttgtcttgaaatcatgtgtactttgtatatctgtatttgttttatttttaaaacgttgtgtttgtttaccattgagtgaaactggtgtacaacaaagatgtcctgtttgtgcatccttttgtgtacttctcgtttcattgagttcttctttgagatatatgggcccatatttactacagttacacatctgagctcttgctgtcgttgaagtaaattaaagtttttgtttctgttttgctttttgtgttttaaatccttaggatgctgaggagaattttgtcttactgaaaagagtgactcagcagtggctggatatgtgatgatggccacagctggtgatgggctcactctgaggactgatcatgagcttataattcaaaactaggggctatattgccactttgccatccagtgatggtgtttcagccgaaactgtaggacctcttgctgggaaatcatgttatccttgccttgagtcaatttcatcttagaggttgagaaaagcactgatgtagcttccctggacagtcctagggagagtaaaggaagacttccttggcagttgctgcatcattttcattatgaggaagaacattctgaggcgcagcatgttaagcacaaatttaaagttttcatacaagcctggcttatagaggagggatctatacaagttttactgttcatatgtaattttaaacttactgtttgtgtctaattgtgaaaaaatatttg

SEQ ID NO: 34678 - DNA, 1778 bp, Homo sapiens
tgtatataaagataaacctgaaagatcagttgtaaatagaaaaattatacctggacatttaaatataagacctataggttcatttattgttaacattaatcaacaccattttgttgagtatgggttcatttgtttggaattccatttaattctaaagctggaatttaaactcaaacatttagaaaatacacaagttgtttttctggaatttaagacagttcaatcttttggaatgcttggtttctaggctcttttaaatctttcagaattgtctcacagatttgatagttctgtgtgtgtgaaagattcatcttgttctaaacttctgaaacatatgacttggtgttcatatatatgactcttttctatgcttggggtttatcatttcatgtcaactgtaattctcttgacccaactgatggagacaggattatgtgtatattacactatgttttataaagtgtatggctatcccaaggatttatgagttacatggaggctagttaagagtgtggtatagaaccgtttattgaatatttcccaagtgccaggcagttagtgtactgaggactttatatatgtacattgttttattttaaacaatttttaccctgttcacatttttacaaggggaccattacggaagaaattgtccaagatcagacaataataggaaaacagggacttaaacccagttttgtcttgcagcaagtatgtattcttaacctctgtgttttatttccttcatcattgttcctcatcgctccatgtaattctctgagtgtattgtaaagctttcctaggtaatatggagaacagtaaatctaattactcagattaaacagtgccattcatttataatagatgcctttttcaggttgctttatttatgcttttttaacttttaggttcaagggtatatgtgcaggtttgctgtataggtaaattgcatgttgtaggagtttggtgtacagattttttttttttttttttttttttgagacagtgtctcactcttccaggctggagtgcagtgacccaatctcagctcgctgcagcctgtgcctcctgggttcaagcgattcgattctcttgcctcagcctcccaagtagctggggctacaggtgcacgccaccacgcctggtgaatttttgtattttttggtagagatgggatttccacatgttggccaggctggtcttgaactttgacctcaagtgattgacctgcttcggcctcccaaagtgctgggattacgggctggtgtacagattactttgttactcgggtaataagcatagttacctgacaggtagtttttctgattctctttctcttcccaccctccatcctctggtttgttgttcctttctttgtgtgcatatttactcaaagttgagctcccaactgagaacatgaggtatttggttttctgttcttgtgttagtttgcttaggatgatggcctttagcttcatatatgttgtcacaagaacatgatctcttttttatggctgcatagtattccattgtgtatatgtgctacttttaaaaatgaattctacttttaatggacatttaagttgattctatgtctttgctattgtggatagtactgcagtgaatatacacaggcctgtgtcattatggtagaagggtttatattctgtatacccaataatgggattgctgggtcaactggtaattctattataaatctttgagaagttgccaaactgctttccacaatggctgaactaatacaatcccaccagcag

SEQ ID NO: 34679 - DNA, 1034 bp, Homo sapiens
acacattcattctagctttctgtgagttctgttgaggatgaaagaatattccctttaaaacttgtgaaaatttgaggaataggcaatatatttttagttgtctttattttctattgttaacttaggcattttttcgtgattaggtatctaactctgaaatacataccaaatgtattttagctgtttacactaacaaagctgtatggtttgattgtggtcttaaacatttcagctctctttaagagtccagggtttgatgtttcctttttgccctgtttgatgtattgaacattgaaacactgtagattctaaattattcaaaatatgttccctttccttgtgagcatttacatctagtagtttgttgtcattgtaaccagtattttgctatatgtagtgctattgtgattacagtaagttagtgttgctcatgttgtgtaatatggttgctaagaacataccaggttgaactagagcctgtctttgtttattccttcaccaataaaagaaacattatgtaaggactcggctaatatcactggctcttcactgacttggttggggaggggaaaactgtcaagccaataaaaggtgatttgaatgtatagagatttcacagaggaggaggtatttcatctgagttgagaaggacggagagactttgataggcagatggactagccagtagcaaatagtatcaatcctttcctgatactataggtagatgagctggtttctattaaggttgaagttctcacactgtcttaattgacagcacacgtaatatctcaataatttcttcgtagtaccccagacctaaagaaatatttcagaattccatttactaagtagttgggtcctaataacctaagtatttatgtttcttttaaaaaatactacacatacgttgaaagaaaaattatttcattcataaataaccaccattatttattaagtgtgttaatgctatttgatcactcacagtttctcaaaccttgataacagattgaacactacctcttttatttcctgtt

SEQ ID NO: 34680 - DNA, 1081 bp, Homo sapiens
ggccaggagcagaggctcacacatgtagtcccaacactttgggaggctgaggcaggaggatcacttgagtccagggtgggtaacatagtgagaccctggctctccaaaaagatttatatattaaaaaaatgagccaggtgtggtggtatgtacctgtagtcccagctacttggatgaggtgagtggatcacttggacccaagagtttgagactgaggtgagctaggattgtgtcactgcgctccagcctgggtgacagagcaagactccatctctcttaaaaaaaaaaaaaaatggtggtttgtgaagagaatcaaaaggaaatagatcctagagcatagcctctagggtcagtgtctgagttgtcctagctctgcccacgtattagctgtgacattaactatgtgttaagtagccctcatgtgcttgtttctttttcaaaagatggagctggtactaactacctgatagggttgttctgagatcaggtatagttgtctgtgtacaactcttcgtcatttatggcactctgtttaggggtgcatcagtcagcattgctgattcttgctgctgttggtgatgatggtagatatccagttggagaaattattggatctttttaaccagttaacccagttagagagggactcaataaaaccaatttaataaagttccttttggcacaataattgaattacaattggggatgtaaacttaaaccttgacgtgacttgtcaccggaatgaatcaattcaagtattcttttagggctggaggtaaaggtgaaacagatgtggcactttaaggaccattaattatacaaacaattataaactaatttattgaacatctgttatgtggcagtcttggttctagttcatgtgtagcacataagttaggtaagggtaattttattggactcttaaaaagaggtgggaataaaggataaatgtggttatttaacactgaggcagtttctgccagaggactaaaaagttactgtggtcaccctagaagtagaattctattggcttttgctaattcctagaaagctaacttggtttgctgaggctctacatgtt

SEQ ID NO: 34681 - DNA, 1050 bp, Homo sapiens
agcagtgtttgtgctaacttctgaatatacttttagtgcacaaaatacctcttcacaaattgaaggagaatttgagaaagattgagatgccatcttcttttactcaatttggacctatcctttcttcatcctaccctcagtatctgatttctgttgtctaagtaggaggggttttacttgcagcagactgagttcttgtgttacctcacctaatgttaaaagttaaggaaggtggggcatcagcaaggaagggaaagatgtttgtggtggagaatgggaaacccttgattgtagggtattttttattatttctgatagttacataatccattggactttttattcatttgaacgttggacatttactctctttgtgattataacgctaccgtgaacattctgcataaaattcagaatctgaattctaaatttttgtttttaggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacaggtgagttattgtataccatggtacatatttcatttatgtttaagtttaccaaatgttgcatatttgattctggtggtcatttcccttgtctgtcctatagaacatcttgaagaatagctgatttgatgtttaattggcactctgaatttcagagtggaaatcctatagagaa

SEQ ID NO: 34682 - DNA, 1055 bp, Homo sapiens
atagtcatggcctgaaaagtgttatatgattctcattcttcgctgccatccccttctgcttctgcttctcccagaccctgaacccactgtcagaaccatgcaaagagagagcacctgtgctgtgcaagtaggatgttgctgctgcttgccatagagtgcgtgttggtgttcagggcagaggaatcaacagatgggcaggcggatcacctagaaaccatcccagtcagggcaggtttcaggcctcagttgagcgttcatgaatttcaagggcactattgatgcggcagggcaatcagaggccttttgtagacaagcgtgttgcgtaagagcccaaaggagcagaacaatgatttgggggataacattgctgcagagatggaaggcagaatcccagcagcagtcgggtgaaacacacctgggaagactctcaggcaggcttgtgttttctagcacttagcttttctttaatgccatctgctccaaaataagagaaagggaaggttttgttcagacttaggcagaatgcttccacaataattgcttccagagctctctagatttcatttttctaaagttaatttctttcttgttccaaaattcagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaagtgagtaggacttgagacccactctgcaactagtcagtcacttgatcatgaagcatttgttgaaggtacactgtgtgcaccagacccaaccccagacacagtccctgtcctcgaggagctcagagggtctcgtaggaaaacaagatagtgaagaggaaagggtggcatctagccaagtgccaagtgtgtggcaaatggcatgacccaaagctctggagctgggaaacagtgaaagccaaagcagccaggaaggcttcttggaggagggaggcttga

SEQ ID NO: 34683 - DNA, 1033 bp, Homo sapiens
ttcacggaatgaagaaaaaaagaaacatcatgttggacatagtttttaggcaggtgaaattttagtcaagttgacatttaacttaacatttacatcaacgttatttacatgtacatttacatttaactcacatcctaagttaaatgtaagtcttaagttaaaagttaagtcttaagttaaatgtaaatagtatctttgcaatcctatatggccttttgtaacacagcatctagcatagtgccttgcacataatggaaagtaaacattcgttggctgaattaacaagagatatgaataacaaagatagactttagaagactctaacagtacatctagggccataaaacttgcttgtttgggcttaaatgatgatcagcttatagattcatgggagaattatgtaaaaggaagcatcatatagcttaaagcagttgtgtaaacaagtctctatccgcgtggtaaagtacttattaaggcaactgattgacttttcattgagggtacgtgcatcagggtgactgtgaactctggctttagtgacctttgaagcagggctcactgcttggctctgcctcttgccagcctttgtaactttagacaagttattcttctccaggcctcagtctcttcgtgtaaaaaatggggatgctgaaaatagtaccgaccttataaaagtgtaccaattaaatgacataatttacataagacacttaacccagtacttggcatgttgtaagctctcaataaaagttgactcattctttttatttggagacccatgagaaaaactggggacaaaagatgtctagaaagcatctaaaactaaggttcttttgctcaactttttagagcagtacctaagaactgtttgtgagataaaacacattcttctttagggagtcttagagggggaaaaggtccctctggaagtttcagtggtcctgatttggtgatgagttacactgagtaaattactctcttgaggcgatttctaagctacatacagcacatcatttccccaggatactaggct

SEQ ID NO: 34684 - DNA, 1036 bp, Homo sapiens
ataccaaaagcaccccccccaatatccctcctctccaaaaatatttcctggtattgccaaatgctcccaagtccccagggaggccaaatcacccccagctgagaaccactgctatgtcaatgttattgctcttattactgggcagagataattccaggtttccgttggatggttgtctggaggtgacgaagccccatgccccaagacccgcaaacaggagagggagacgcatgttggacagtttaggctaaatggactaagaccacatccacaccaaaattgtctttacaagagttctgatcctacttaaaaatagttgtgctgattgggaacaggagtgcatcctttccacaaaacattcttttttaagtaaatactgtctatgagaatgttttcatgttattgttgcagctcaaaattctgtttataagaatttagaatgatttgttttccatggaggcctggcaatgaaatctaattaaaaaccccaatcataagtccccttaccttaagactccctgggtatgggcgctgcagaaccgctagattcccgcacagtgagcctgttctgctgacctccgttagacttctggggcccccatcagtggggagagagggggacccaaagctggatttgccactttaggacccaccgttcatgactaacctgccattggggtcttctggtgccaaattagaacagcaccaaggagcttcccccgagggaccatacctgccagcctccccggccaccacagcctctgcttccagaggcacatggccagctgccttcctcttctccctgcctttccctggcctaggagatggcagggagggagaaccgaagtttaggtgaatttctagaaccaagccctgggccccatttgccttcagcacctctttctctaggtcacattggaaggactggggagccttctgcagaggtggggcatacactccttaaggtcatctctctacctggcacagtgcccttgcttggggctatcataacatcttccagcaaccctgggagaaa

SEQ ID NO: 34685 - DNA, 1050 bp, Homo sapiens
attagaaagaatactttttttaaagttgaatttttatcgatgtgaatcatcctgttttcttcacccactggactttgtgtctttgaagcggattgggcagacttggaggccgagggtggggaggccttgggatgtagctggctccttctatatgcctgcccggaagtgctcagagcttttgttcttttctttcgtagacgaaaaagtaatacgtgtacacggtaacaataaaaaaatttaaatagcgtgaaaaggtttaggggaacgagtaagtttccacacccctccccctcgaatcttctggtccttttcccagaagtaaattcattagcaacagtttcttgtgtttccttctagaaatgttctctgcacatacaagcgttaagttgtgtcccgttttcttcctgcacaaatgagaggattctagaaacagacctgcgctcattaacaatacagtagatttttctgtaccaggacatgctgccgacctcattcttttcaacagctccttagcgttgcatcgcctgacagaccgtaatttatttaacctatcttttgctgatgatcatgctgttgcttttaaccacaaggcttcactgaacatccctgtacatgtatctctgtgcacactcataagcatgtttggaggataaattactaggagtagaactggttttattcttaagattcctgccatcgaatgttccacagacttccttaggaacctgcttcactgcctagtatcctttctggaggaagttctgacctaaatcatatctgctagaaaatcgagtttttattctcagactttggctttaaagaaaattaaacaccttattggccactggcttttgaatgtcctgtgtttggaaagcattattgagctgcctgtgctctggctttatttctccaggttgagaaatcttcgcttctttccccgcagattttgcttacagacttgtagtcattgtgattccttgcattgagaccatcttcagcttctctgaaggtgggctgatgatctcagtggcttcattgctgtgtgttcga

SEQ ID NO: 34686 - DNA, 1066 bp, Homo sapiens
gtttaaacagatgatccctgtacacagggccctgctggctacccacagaagcagaagtgatgtagtagagtgttgcgtgaaacattcatatacaaatgggccgggccgaaaagttccacgtggacatctcaagacctggcaaggagggggactacttctggacagttcaggaagtcagagtcaggagagcaaagcctaagggcctaagtggactctggaaacagagacagataatgatggagcaagtattcctgtgaaagttctgtgtacaccaagggggattaagagaacagagggaaaaatgatgccatggatagactcaagtgagatagtgaaggagtgaggaagggctccggaaagagtaattttagaaaatactgtgatgtggaaaataactagagcatggatgaatgtcttggcagatggggaaggaatggatttggggacctcatggtggggggaaatgtcagtgcttcctgcctttgtatgcttccttcagatggacttctgatacgcttactgtacaagacagactttgataaacaagagagccattttgcaaaggacacaaaaggccgacttaaaaggtagtctccacattttgttctgaagatctagccgtttactagggatgttgctcttgggtctacactacccaagatactactgaaggcaaggcttcttgatcttggagaagcttggtgtgagaattggggaaaatgtaaatatccatatgaaacacttgaaaaacataaaacaatagagagaaaacgcaaatgtataattgtgtgcattttgctcaatcaaggaatgctacctggaggaagtggttggtcagggggatggggctgggcaggtgcagggtagagatggagcagaatagctgggcaggatcccaggaatatgtagactctagaggaggaaaggtctttcataatttgaaagcctacatggtaataacgatagcttacattgtgctatacattgtgctaaatcgtttataggcattatccagtatttatcttagcaacagccctctgaggtaggagctactataatctccatt

SEQ ID NO: 34687 - DNA, 1025 bp, Homo sapiens
atggtgaagcccctcagagagctgccttcggtggaaacgctgttaggtatcgagttttcccgctgactctcgacaaacgctaacaagggactcgaggtgctgagaactttggaaacacctctaaagtgatatagacaatgtgatggctccattcgatcaatgaagccctagcataaaaatggggtcctcaaattgtttaataaagcactaggaatagaagtgacaccgtggaagtaactcattagcaagacccttcctccctaaacccaataaaacatgagatagtcctcaagtggtgtagtgaaggtggaaaattttattgctgctttctctgggagcagaggaaggaagtctttttaagtgtcttgcatccaggatagggagttaaaaactctagatttaactaacatagttttttaaaagccgctcaacagaagcgagttaactttgcccgctaaagcccggtgcaatcagagggcgtgtggggtgagtcgtttatattattaaataggatgtgtttgctctatactgcttaatttgaggtgttacatgaatattattgatcacatgataactgacagatgctgaagcagcaggaatgttgacattttccacaaaaagaggactagaattgtgatggagctaaagtaaagatcataacaattgaaaatggtgagaaaatgatggctattatcaaaaagacaaataagtgttgatgaggatgtggagaaaaggaaaccctggtatactgttagtggaaatgtaaattagtatacccattttggaaagtagtatggaggttcctaaaaaactaggaatagaattatcatatgatccagcaatcccacttctgagtatatatccaaaggaatggaaatcagtatgtcaatgagatatctgcactctcatgttcatttcagcattatttacaatagccaagatatggaagcaaactaaatgtccatcaacagatgaatggataaggaaaatagggtatatatacacacagtggaatactatagagc

SEQ ID NO: 34688 - DNA, 1020 bp, Homo sapiens
agggccatcgtcctccagaccctggaatgatagagtcactggaagcttgcaccttgcacttgtaaaagctgcaagcactcaacactagcccatgagagcagctgtgggggctgaaaccttaaaaccacagcagcagagctactctaggccttggaaggctaactgttgtgtcagtgtgccctggatgtgaaacatggagccaaaaaagattattttggagctttaagatttaatgactgccttgctgggttttagaattgcatggggcctatggctctatttttggctgatttttcccttttggaatgagagtatttacccaatgcttgtaccttcattgtatctttggagttacctaattgtttttctttttttttttaatagtagaagggacttgtcttgttctaggtgagactttagactttggactgcagagtaacactggaaagaatgaagattttgggggactgttgggaaagcatgcaatgtgagaaggacatgagatttgagaggggctggccagaatgatatggtttggatgagtctctgttttcttctagtatctttatagatataaaactataaagatacttaaaaaaataggaaaaactggaaaaactcttctggactttggtctaggcaaataattcattactaagactcaaaagcacaggcaccaaaaccaaaagtagacaaacaggatttaattaaattaaaaaacttctgcacagaaaaacaaataattaattgagtgaacagatagtttgcagaatgggagaaaatattttcaaaatatgcatcaagcaagggtctattatatagaataaatagggaactcaaaccagtcaacacacacacacacacacacacacacacacacacacacacaaacccacaaataatcacattaagaagtaggcaaaggatatgaataaacatttttcaaaagaagatttacaaatcaccaataggtatataaaaaatactgaacatcactaatcatcagataaacacaaatta

SEQ ID NO: 34689 - DNA, 1044 bp, Homo sapiens
agcattcagggtccctgatgtagttcaagcctcaagaaaagacagtaagagaagtaactacaacaaaagtttatggttaagaatacaaagtagatgctggagatgtgatctcagggggcctttcatttataatagacgctgtattcacaataatatgagaaaaaggttaaatacagtaaacacgatagccagttctggaaagataaaaacagtttgacagaaaaggagaaagtaactcaagaactccaccaagggacaaacagaggaaatgacactcggatatctctaaatccattgacctttcatctttttaaaaagggtcttctatctgtagacgtgttttctaggcctttatgatcaaccatttctctaacccctttcgctaaatttgatacttcagtcttccttttctaaataattactacaaacgattgtcctttaaacatatattacttgaaagagtaaacatatctgtgcataactattccaagtatgattctgatccttgagactctgagaaactttagatatattttacagccttaaatccatgcttgtagtattaacatgtttagtagactgaaatgactaaattattcattgcaataacagcctttttgatagacattaaaactcatcagtttaaataaggaaaccacagatttccttttaagcaggtaataactgcttgcatcagtggttatttaattggtttctagccaagacatagaataagttgtgctgtttaaatcaagaaatcatatgcaaagctatattttacagtgtatctataaaagaagcacacagaaactaaactaagttgattcatactatctactggataactataaacatttccacaaggccgatatgaaaatctcatttacaaaaaaaaaaaaaaaaagaagaagctttgaaaaataaaattttaagtgtttattagctcacacgctgtctggttttcagatttcaatagagtgttttaggttttaaaataacacagaataaatgatttttaccttaagtttagcacatattgacagt

SEQ ID NO: 34690 - DNA, 1072 bp, Homo sapiens
cctttactccatcagtcttatttccattcaggtaaatgaaaagtcaatattattaatcagattagcatctgtgtatgaaagtctcagcaaatttttaaaagcctgtgagatgattacggctttatgacataatttccatttcccttgaaatgtataaatcaggacaaaatattccctatgatgtgaatacttccatgaccacattgatcataataaatagacttagactattttaaagtactttaaatatataatagatttttctaaccttgtgatttaaagcaagaaattttgtcgattattagttcttaatgggttcttgttgtcagttgttcatttggtgtggaataacatagaaataattgcagcccttatctggtggtgaggacctatgttttatatgacatttgaatttgaaatcaatatactattgatgctttacaatgtaatggcttgtagagatcctaaactggaaggttaaatgtaaaatctactgactatgacaatgaactgaagtcactatttattaaggtcttcaaagaaatacaaagacattcacactcttaaaaagcaaaaaagcaaacctcaatagtagttttgcaattgcataattttaaatgctcaaggcaatatgggagatacttttgaattaaaagagactgctctgtttgttttccaaatgactgtactacctttagccagtcaggggtgattttaagtaatcttatcttggcagcaagccaatgagcccctgcacactttggtgttagacacagggcactagtgcacgcttggtctgtcagatcactcatgagaccaacactgcttagtgcaatttttaaatttctacagcagcttttatcccagaaacatagaaatgataaggatttcaaagacagtactaaaaagtgaatgctgcttgctggtgatccaattagagagaagacataagaaatttaggaattgtctctaattcctgatcattatgtttcatttatatgctgactagttaataaggatttttttattgttaaaagagagttgccataaatctttcctcattaataccaca

SEQ ID NO: 34691 - DNA, 1028 bp, Homo sapiens
aatatacccatttcttctagtttttctagtttatatgcatagaggtattcataatattctttgatacttgtttatatttctatggggtcagtagtaatatcccccttattgtttctgattgtgtttatcaaatattctctcttctttattagtcaagctagtggtctaataatatatgtaaaaattctttttataaatataatgtaataataatagcatgctcatccaaagataccactaagaatatgaataggcaagtcccagattgagaaaaatgtattaataggtgtactaatagtcccagattgagaaaatgtgttaattaacatatatcagaaaaagacttatatcaggagtataaagagctcttctaaatcaacaataagaaaagcagttcaataaaaattatggcaaggatagaacagacattacatgaaggaagatgtagaaatgtccaataacccattgattcaaaagtgttcaatatcattaataatcgggaaattaaaactagaaccacaagacactattttacactcattggtatgactaaaatcttaacagtgataacacccaatgttaaaaaatgatgtagagtaattagaactcccacataaattgttggtggaagggtaaaatcacacaatcactctgtaaaactgtttgtcagtttttaaatgaagttactaacataatctaccccatgatccagtggctctactcaagcagtacaactacttgtactcacttgtacaagaatgttcataagcagatttattcataaaagctgataactggaagcattccaaatgtccaccaataggaaaatattctattcatataatggaatactactcagcaacaaaaatgaatattaaaacaagccacagcattggtgagtttttaaaacctttgaaaccaaagaaacttgacacaaaatagtatcatataagtctgtgcataagaagtctaagaacaggcagaaccattctatggtgatagaagtcagaaagtgtttgcttaggttg

SEQ ID NO: 34692 - DNA, 1051 bp, Homo sapiens
ctctttactggataggaagcaaacatctggtaatttacattggaaacagacaatttattttcttatctgaaactaggaattgttgatgacttctgatatgatatgttcatagcaggggaaaccagtattagggaggatgtgatatatttatttaaacttgtgattttattatcagttacattatgatggatcatacaagtatgatgcttttgatatgctctttcctgtttgtctttagcctcattactttaaccgaaaacaaaaagctcaggtggtatgtgctttatgttttggatggtgtgaaagagttgaattgacttttacatggctacaacactaggaaagcagcattgacatcttcatgtcacagcttcttttcttattattttcaattatgctattttcagtgcactgagaaaaagtttgaatttcctttattccagcatatgtttctgttgctacattttattaactgattgacatattttgatcatcaaaaacttttctgtgagactttgattgtaattctaaaacttgttctttttaactctatgctaagaatatatgctgcatttaaaattatgattgcctaaatcaaaatgtgtatggatgaatattcttcagagagatatattgaagatgtcatgtaatttcttgctagttggcctattatgtcaatagttagtctataatattgacacatcatgttttttatattcccactagtagttaaatatagactcttcagtactattttgtaaatgattttagtgttttctatagaagttacattttataattttgtattgattatgaaaatattagctatgaggtatttactagtgttgatccaaaattatgagtttgatcttgttgggataaacaaaggattatgattaatttatgattattatttagtaacggacaatattaagtttgttagtccttttaaaaccatttaattgcatataaaaataagaaggtttccctaaacaaaccagtatgttatctacaaaagaggttagaggatggggatggtggttcatgcctg

SEQ ID NO: 34693 - DNA, 1051 bp, Homo sapiens
taaaatattgtttattatataaaataattttaagagcagcagaagcttcattttttatttttcttttttctatctttagtgaatcacatattttgttgtctttcatctccaagatgcctagggatgaagggagcatttaaagcaccttgactaccccaacagtcaagtgctgaatgagcttaacattttaataacaccatgtggtttcaaagacctccagaaaaaaaaataatacacagaatgtctttgtaccttcaccatctgtctagctgctacctactaaggtcttgggacactttggagtatagctgccaaactgccaaaaggaaaatcttgccacccgcaagcttaggataaaaattaaaattcaatgtttaaaataccccatagtgtgttattaggagtgttgcaataagtgataaaatgaaacgggattgtcagtactttgtctttatgtttttattcctgtattatgattgtgcacaattctttaaaatttaaaatgtttcaatgttatttttaaatatacattgccaagatctaatgactatggtactttgatgtcagttcacagtgtctccctcaatcggtctcaatcctcctcgtgcacagaaatactctggcaaatgactcctatgacctcccaactgtcaagttcccagattcacatctgggttcactttacctaaccttctgtggcatttattgttaatgactattccctttttatttgatgatcttcactctgttttccatactgcctggattctctttatgattttctgttcattttacctcttttgtagattctccttattctgttttctaaacattgggttttccttgctgcaacatcctttgccatcttttctcatgttacctgttttattttttattattattagataatctcttctattttttgtgcttggctaacatgtattaactggtgtttcccaaatatacctttgttcttcctccatctggctcacactcttacctcttttaaaacctagactaaaattttcattgtactttgtctcatttctct

SEQ ID NO: 34694 - DNA, 1035 bp, Homo sapiens
gttttatagtttgcaattgtttgaatatggtcagccctttctctaaatcaacaattaagtatgactttgtaacttttactaatctatttaacagtactttttctgatgttcttaactatcattataagctacttagaagaaagaaccatatgcttttaagtcaccactgtatcttttatgtcagagaattccaatattgctgtgtttaaaaattgataaactggctttctgttctatgaaatttccaaataaaagtgtatcataataaactatgcttttctctgacagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggtaattattttgtatcctgcccttgttaaaatggttataatgtcactgtttgccaacaaatatttatgttgtagggtgttattattcagatctttattcatatttagaaatacataaaataaggaatagtcatatttttttaaattatagatataagtagcttttaagctatagtcattatttaaatttggttgcatttaaaactttttaccatctgatatctgtttgacagaatatttctatttataggatttttgcatgtgttttctttttcttcatgtgtatgaattatatctacttagaagtgtgaagttataaaatgaacaattcattaataaataccagactcttaaattctgcagttgaaagccctttggttttttcttttagttgtgtccccagttggaaacaaataacattctaaaatattattattctatggtgttttactaagtcatctgttttaattgactttttaaatttccattttataaagttaatattttcatgtttcatcagaaaactgttggagtagggatgatttcttggttcaaagaagtaaaaataggggaaataagcccaggattcaaattggtgga

SEQ ID NO: 34695 - DNA, 1050 bp, Homo sapiens
acttagggtgattctgtggaaataaaaaggaagaagtcctgtgttggagctttgatgactatacatcattttgggttaggggaatttgtcagggagaagtagctgcttgtttcctcagagagtgaggccagaaactaagagagagtacaaagtgttacaaagcccaggaagagggtgtctcaaaaaggaaggatcagttaaaaatgtcaagtgctgacagaaggacatgcctagtgagaatacatactccataagataagtgatttggagtccctctggtgacttgggggagagcagaagtgaacaggcaggtactagatcagattaagaatggaaattgagtaaaccaagacagctagtgaggtcactttgtcaaagatatctggagggaggttcataggattaacgaggtaaggggtttgacccagaaagggcatatatgtgcagtttgttttcagatggcttaaacttacacaagtttaaattttgatggaaaagaaacagaaaatgggagagattgaaggtctaagagagagtacaaacaagagagcaagatccctcaactgcaaaagtaagaaaagaagaattgatggatgattttggatgttgatagttttctccatgtggtagtgggatgttgagagagataccagtcaattttcaattgctttgtgaactaggagataagagtgatgatccctgagcttctggcatgggtgatgctatgaatgatagtatcatttgccaagatagagaatatgcacttctctcccagtactcaaacatagctagttaattatagctgtgattgttgaaaagctgtttcagtaccatgccaaaatgagaaaatttcattgtaccacccttgttttcatctcccttttgatctattagccctttgggaaatgatgactgtcagcaatggtagattctgttggacttgtcagtgacagataaaattgtggcttttggaagtaacacaacttccaattatttatactgttggcctatagagatagtgtgaatgattgaaagaaagagaaaccaacc

SEQ ID NO: 34696 - DNA, 1065 bp, Homo sapiens
tcccgggttcacgccattctcctgcctcagcctcccgagtagctgggactacaggtgcctgccacctcgcccggctaattttttgtatttttagtagagacggggtttcaccctgttagccaggatgttctcgatctcctgacctcgtgatccgcccgcctcggccttccaaagtgctgggattacaggcgtgagccaccgcgccaggccgtgtagtttttttttttttttttttttttttttgtcagtgcagatgctgatgatgattgctgctgtttttattgtagccagctgcgatttgtctaattctcaccactactgttagtgctcttgtcatcttgttattgaggaaagcaggtattggtgtgttttaagttgagaagatacgcaacgaacatacacagacatatgcactttctttcaaaacaaggtaaaataaatttacatacaaattaaaatagaaatgcaattgtgttttgactctaggacagcatagatctttaggaccaaaagattccaaggttagaagtctaaaaatggatgctagcatttggagcaatgaactcatcgaggtgagtcctatttaacctgaatggggttgtgataggggttcagtttgcagagactgggaggaggtttgctgtgggtttgggtggcaggaatttttctcggggctgtttgataaagttctcaccacattatggaagtggcttatagcctttttgatagtagtaactctttgagaatgcttcctaaatgagatagttattttaaaagtatagaagatccttaataagtacttagaaaggtttgccagcttgtttttttttaatgctagaactgtatatgtgtgtgtgtgtgtgtgtgtgtgtgtgtgtgtgtgtgtgtgtttgtgtgtgtgtgttttaaacccaacatgggtaaaataataggagagtgaatgaaaacatttggaaaaatttactgtttttaccttggccgtactctgtcattaactgtgatggaggctactttgctgtgtcctgtctccatttttggctccttgttccaccaccaagcacttca

SEQ ID NO: 34697 - DNA, 1030 bp, Homo sapiens
tgaagttgtttatgaatccagccttgcttattctccataccagttgttttccattattatgttattgtttagtaaattttaataacaattataatgaatataattaccaggaagtacaagactcttccacatcttaaacatgaaagaaatactgaacagattcctaaattcaaaagcagaactttaacaaaaatttctagtgtaaaaagtaggtcatttgcatatttttctttgacttaaatacctaattgccaggtcatttgcattttcatatctgattttgccagcatatccaattcatctacatgtattccttagtctagttgctgaaaatgggtggcctttcctacctataattagaataaacttcagcttcaacacacttcaagaagggggattttacagagtaaaaagaggaaccattttcagacttaaattttgtcaacctttctgaataatgagtagttattttgatattcttctcctccatgggggcctgaggctgtacacgtaggattcatattgaaggtaccctaataacacattcacacatgaacttggaggtgaataaagaggatttatatttcaacgtacaaatattttaacccaggtattagacactaatgagttatacattatttctcaattcccataatatatatgcccttttgctgatgctgatattaaatctctaaatttagaaagttcaaagaacagaaatctgatttattgaagagtctttcaacctatgtaattaatgttccaccagtgctcacagctggaccttagggattctctgccactgtgctcgaatgacactatttttatctaagagaaaatgaatatgaaatacaaatcatttggccgttaactcattgtccccacagtccatgtgcattgcagttactttaactttcatcttaaacatgatgactaagatggccttaacgttccattcagcttgactcaatctgagacaaacttcttcctgactgtaggctcctgactcccttttcttagagcatttact

SEQ ID NO: 34698 - DNA, 1041 bp, Homo sapiens
tcaagttatggagaacatcaacctttgagtttcagagcagactgactcaaatagctcatcctgttgtccatccaacatattttgcatttcactagaaaattcagtaactatatgtcataccaagaataatataagtccgatagattattgcttggtctgggcatagctgaacgaaatgagaaacataaaattttccaggtacttctgagggtgcacatatacagtccaggtctgggttatatagagataataccaactcttttaataaccctccagggcacaacaatcttgtcatcttggaattttctatgtgttgtcttgtaattttctgattctaagatccactggggtgtggttcagtcacattccttcctgttctacttgcaatgagggtctactggctgctcttccacgctttctctccttgactactacacagtctctatgtgaagttggtattcaagaagcttattgagaaataaatttctgcatttgcgaaaagaacaatgtaagcttactgaaaggcagacttacagctgactgaggagaaaataattagtgctttaaatttctccctatatcatttagtcattcattgcttaataatgggaatatgttccaagaaaggtgtcgctaggtgattttgtttttgtgcaaacatcagagtgtacttatacaaacctagatggtagagcctactacacagctaggctagatggtacaacctgttgctcctaggctacaaatctgtaccgcatgtgactatactactgaatactgtaggcaattgtaaacatatctaaacatagtaaatgtacagtaaaaatacggtattataatcttaaggcaccaacattgtataagaggtatatgacccaaacgttgttatgaggtacatgactgtatatcaaaatcctagtttaatacaatttaaaggaatatcatagttatgaggcttaacgttttttccgaattttaagataaaaaatataaatgcattacatggatacttaaatatttaaggcattgtgaacccgcaca

SEQ ID NO: 34699 - DNA, 1032 bp, Homo sapiens
aaagcatttgataaaattcaacatcccttaatgatgaaaacccttaagaaactgggtattgagggaatgtacttcagcataataaaatccatatacaacagagctacagctggtatcatactgaatggggaaaaactgaaagcctttcctctaagatctggaacatgacaaggatgcccactttcaccactattgttcagcatagtactgcaagttctaaccagagaaattaggcaagataaagaaataaagggcatccagatttgaaaggaagaagtcaaattatccttatttgaagataatatgatcttatatttggaaaaatttaaagactccaccaaaaactattagatctgataaacaaattcagtaaagttacaggatacaaaatcaacataaaaaatcagtagtatttctgtgtgccaacggtgaacaatctaaaaagaaattaagaaagtaatcctatttacaacagctacacataaaataaaatacctaggaattagccaaagaagtgaaagagctctacaatgaaaactataaaacattggtgaaagaaatggaaaacgacacacacacaaaatggaaaggtattccatattcatggattgaatcaatattgataaaatgtccatactacccaatgcaatctacagattcaatgcaatccttatcaaaatacctatgatattcttcacagaaatggaaaaaaaaaaattttaatttatatgggaccacaaaagacctagagtagccaaggctatcctgagcaaaaaagaacaaaactggaggaatcacattccctaacttcaaattaagctatagagctatagtacaaaacagcatgatagtggcataaaatgagacacatagaccagtggatcagaatagagaacccagaaataaatccatacacctatattgaactcatttttgataaagttgccaagagtgtacgttggcaatgaatggtacttggaaaaccggatagccatatgcaaaagaatgaaacaagacccctatctcttgcca

SEQ ID NO: 34700 - DNA, 1034 bp, Homo sapiens
attcttcaatgtttataatgctgctttgtcattattttactactttaacatattgacagcctcaaacacaagcacaaagaatcatccaggcctcttttcaacctctgagacaccttgctgatgttctagttgttttagaaaagccagattctaggtacaccatacatgtaatgcaaaaggaaatattagggacagatttctgtgcaattatttaagggaaattctggagggcagaacatacctgtgtagacactgcactctctgtgagtccttaagtatctatatcttatgagccttaagaacaatcttatgggttacatatgttacattggcacaggtcaagcaatcaattactggaaagatgtaattatgatgccactggcccttcagcttccgggcctgtcttttcttatggcaggcaagggccctgctgccatgagtccgtcactctgccccaaagctggccagccatgccaccagtgactaagactacatgtattaccaaaaagaacctgaactgtcagttaagttgtcgtcccctaaatctttcccattctacatgaggtttgtaatgtattttgatatcctggttaagctatcagttttagtagagagcaagagagagaacaaatacatgtctattggaacacaactaggcccattcatttatgcattgtctgtggctgcttttgagctacacagcagagttgagtagttgcaatagataccataactggcaaagtccaaaatatttactatctggttctctacataaaaagtttgctgactccatctctacaggataaagaaagtacctgatgagaaacctaggcatgctagcagtcacacgagtgagcttggaagtgtaccttttcagacccgccaagagacacctgagtgagcttgaaagcggattctccatgccccagtccagcctggagatcactgcagccctgactgacagcttgactgacagaccttaaactagaggcaccccattatcctgcgcccagattcctggcctacagaaactg

SEQ ID NO: 34701 - DNA, 1050 bp, Homo sapiens
tagtcccagctactcaggaggctgaggagcagaattgcttgaacctggaggcggagggtgcagcgagctcattgcaccactgcactccagcttgggtgacagagcaagactctgcctctaaataaataaataaataaatatttctaaaggatctttaagctctttgtattagtccattttcatactgctatgaagaaattcctgagactgggtaatttataaagaaaaagaggtttaatggactcacagttccacgtggctggggaggcctcacaatcatggcggatggtgaagcagatgcaaaggcacatcttacatgtcaggaggcaaggcagcgtgtgcaggggaactgccctttataaaaccatcagatctcatgagatttattcagtatcatgagaataccacgggaaaaacccacccccatgattcaattacctcccacaacacgtggggattatggtagctacaattcaagatgagatttgggtggggacacagccaaactatatcactgtatcaaggtggatagctctgatcactttccgtcttggattatagtacataattcatttatacaatgttccctctatcagactataaaccctcagtagagaaagccatggtttcatcagtgtttatctgcacattgtgtcccttggcacagtgacttgcatataggtggtaccttgcatgttttaaaaaatttgacttaaaaatatcattggcaatttaaagatgcctaataccaatgcataatattataacacaacaacgctcacattttatcgattctaagatgtacgtgtattcatttaccttttaacatatctggaattggaatgtatctagcaatcattggcacatcatggttacattggcagcattattttctatctttgtgttacgtaagataatggtacatgttacaatcaatggcatctaatatttaatgaaatgtggcattaatcccatattatagtttatttcagcaatatattatgcaaaaattttacaaacaataccctatatcaaacaagtgtctacgtt

SEQ ID NO: 34702 - DNA, 1034 bp, Homo sapiens
accttcatgcgtttttattttttaaaaaaactagttggatcatattgcatgtaaggttttgaatccagcttttgaaattcaatattggatcatagtgttttcctgtatcttcacaaaaaatttcatagatctttaaatagtgcatattatttcatcaaatgaaaccatgatttagatatgtttttactatctcattgcaaatatgcaggtgttgctattttttgacttttataaataatgcaacaacctttgctatttggactaagtaacttgttcgtgattcagacatgattcagctaggggtgaaggagaagaagggatacagtgtttctcagcaaattattagtgtaaattgaaggaaagctaaacctactgaagtttataaatgttttagacattatgtatgaacagttactttgttatttaaaagctatttttcattgaattgttaaggtagatcacaatatattctccactctgcatctttcttgttagctattctttataatgcacaacagggctgtccaaaaaaactttctgggatggtggaaatgttcattatctgggccgtccagtatggtagcagttagccacacatggccactgggcacttgagatgtggctaatgcaactgaggaactgaatttttaattttatttaaattcatttggcttaaatttgaatttaaatagctacatgtggctagtggctatcttactgaataatgcaggtcttttatgattatgactaaaatacagtgcccacctttttgtagacactcttctgaatgctttacatattaatattgtttaatcttcacagtgacaccatgcagcaggcttccagttactattgctgtatgacaaataaccccaaagcttagtgggtgaaaacaacaatcatttcttttgtttaaggatttgttatacaatttgggcagggttcatcagagacagctctgatgccccatggagcatcagttgggactataggatctacttttattatggctattactggctgataagttgatg

SEQ ID NO: 34703 - DNA, 1031 bp, Homo sapiens
atacccctaatactcagtgtatcttcctcaaaatgagaaattataagaccaaaatacaataatcaaaatctggaaattaactttttttttttttttttgagatggattcttgctctgtcacccaggctggagtgcagtggtgcaatctcggctcactgcaacctctgtttcctggcctcaggtgatcctcctgcctcagcctcccacgtgtagctgggactacaggcatgcaccaccattgttgggctaatttttttgtatttttgatagagatggggtttcaccatattgcccatgctggtcttaaactcctgaccttaagcaatccacccacctcggcctcccaaagtgctaagattacaggcgtgagccacagtagctggcctgaaattaacatttatacaatgttattatctaatctacagaccttgtttggattttatcatttgtctcagttacgtcctttacagcaaaagaaaatccaagatgatgcattataatagctgtcatgtctctttagtctcctataatctggaacaatttctgaatcttttttatatttcatgacactgacatttttgaatactatagacagataagttattttgtagactgtctctcaacttagatttgtttcctcctcatgattagattcaggttatatgctcctggcaaggacggcatagatgggcggctaagttctccgtgcaacctatcttgcacaatgctgctgcttagtctgatttctgtcaacattatctttgatcgtttgcttaagtgctgtgtgccaggtttttctactgtaaatacactattttactctttgtaactagtaaacatgtggctgagagacacttttagactatcttgttctcaaacttttcccactagtctcagcatccgctgataattcttgactgaattggttattggtggttactaaatggtaacttttgtaatctcatctttccttctatattcattcgttggcattcttctgtaaggaagagctttcctttctcccttgttta

SEQ ID NO: 34704 - DNA, 1041 bp, Homo sapiens
gtttggatctgtgatgttttctcatgattaggttgaggttatgccttttttctaagaacaccatggatgtgatcttgtgtcctcagtgcatcctatcatagatacaggatgtcaataacgtcttattattagtgaggataatcttgattatttggttaagatgattcagcatcccactgaaactagtgctgggttccttcactagtaaagtgactattttttcctttgtaatcgataactgtcttggcaggagaaggaggtacttatgcttatatcctgtttgtccttaaacattcatccactaattttagcatccactgctaaagaggcactaatttttttaaaaactgagatattacatactataaaatccacccttataaagtatacaaatcagtggtttttagtatattaacaagagtatacaaccattagcactgtgtaattccagaacattttcctcaccctgaaaagaaaccctgtacctatcagcagccactcattctatccaccccgtggcactcactgctctgctctgtctctatggattttcctatgctggacgtttcacgtgtgtatggagacattagaatatatggccttttgtgtctggcttcttccacttagcatagtggtttcaaggttgacctgggttgtagcatgtatcagtgcttcagtccttgttaggggtaaataatatttcattgtgtggacacatcctattttgtttctttttcagttgatggacatttggattgtttccatcttttagctataatgtggttatgaacatttgtgtacaagtttttgtcgaggcattaacttttaattaggaaactttgaaacaaaaatctcaacactgtaccttgtttttttcaaactaaaattggagtacttattacttttaaaaatcaacgtgttgtcacttttagaaattgcatttggtggtttctggtgtgtttgttaatttttatagtttagaaggtggtgatttccacaaacaggaaagtctgttgtgaaaagaccagcccaggttgagta

SEQ ID NO: 34705 - DNA, 1068 bp, Homo sapiens
tagcacaagtagcctaggtcaaactaggaagtaatttttaggaacctgacttctcctgatccaaatactagagggttacctaatcctttccaaaccaggtgtggtactttgtatcacaatcctctatttttccatttttatcacattctttcagaatcttgtttgggtaatttattaatctgattaaggacttctaggtgtcagtaactgaagatgtctttactaattatccctgtaagagtttttcctcccttttttttcacttcacttttaaaagattgagtggattttgaagtccttttctttgtttgaataatgtagggtgttttttattgaatatcacgtaaggccattttaccagggagcatacagccatttggtttataatgagaaagatactccactgctatatattctcttttggaagagctccattttgctgaatgtgaaagtattttgaaataactgagataactagaatgtctctgtgttacattagcatgttagtagaactcctgacatgatgacttaaattttcaaaagtgagaacagatgcatttgaattagtaattgaaaataggagtttgatagtaaaagtgattttacatttgtatatagcttactatatgtgccaaaaaaatactgtataatttttttaaattcttagattcactatttttgtactccccagatgattgtgttttcctattaggttgagattcctttcagaggtctttttagataataaatagaaataagaaagctgtgttgcataagaaccattaagagaaaagtacagacctcatgttttataagtaagaaatatgactttaaaaatatgctcactttatctgtcatccctgcaaaaccagaactgtatgttccaaaatctgattcagcttagtgaaacaaacctgtgatacttcactattaatgttgagtgggaaaatgtcataattattttctggaaaatgtttttctagtttcttctaaatatatgaatcagacatttaaaaattctatttacgaaaagaaaaagagcaactcaactcactttgctgacacatt

SEQ ID NO: 34706 - DNA, 1024 bp, Homo sapiens
ggctgggtgtggtggctcatgcctgtaatcccagcactttgggaggccgaggtgagaggatcacttgtgcctgggagtttgagaccagtctgggtaacatagggaaatcccatctctaccaaaaatacaaaaatcaactgggcatggtggtgcacacctgtggtcccagatacttgggaggcagaggtgggaggattgcttgagcctgggaggttcaggctgcaatgagctgtgattgtgccactgcactccagcctgggtgacagagcaataccttgtctctcggaaaataatattcagttatggccttaacaactgggtgaatggtgatacgatttactaaggctggaacacaggaagcagaacaggtttggtacagagagatcttttggacaagttaagtttgagatgtctaatagacttccaaatggaaaggcagagtaggtggttgggtagaagagtcaggaactcaggggagaagtctaaactgaagatggacatttggaaatcattaccagttgagtaatatttaaacctgtgtaactggatgagatcatggggagataatgcaaatagaaaagaaagaaaggtctcaggattgagccctgggccactgttagaggtcaggaaaaggaggatgatccagcaaaggagaggagagagtggctagtgaagtaggaacatcaggagaggttgatatcttacagaagccaaagaaagtatttcagggaggagcgctcatctctgtcagaggttccaggcttagctgccggctgttagaactcccttcctcttgcttagcttaagtgtcactttcccagactacctcaactatattagaaacccctccgatatactctgtcacactctgtcatagctactattatcatttattatacttgctatttaattagaatggcaagtataggctctaaggtcccctcaccaggactctcactcaaccatttgtctcaaccatttatgtctcactcaaccattgttacatcagtgcttatcttagtgt

SEQ ID NO: 34707 - DNA, 1029 bp, Homo sapiens
taaaggatgaggaagttggaatgttacatatttaattttttaattcttgaaagcgggaaaagatcatttaagccataagaaaaaatgataattattcgaatttaaattgagttctcagaatggaaactcattttactattgacctcaaccagtcaatattagcgataaatttgtttccaaatgagataataaatagattccttataaatagagcatacctatgctacacttgtgaccttctctactttggcagatattggattcatctgtttctggccatttaggaaacagacataccagataaattatggtgaaagtagtcccctgagttaaagaaagcctgccccatagtgtgtgtttgttgattctatcacttcctccatagaacaatgtaatcattctcacatattggtttgccaatgttctgggctacttgtcaagccaagacattaatctacaggattgggtttttttatttttatttttggtacttctcttgaacatatcaatagaactaagtgagacaggtctgtctataggatatttattagggattggatatggtcagggagtagccataaatttgactttctggctggtgtacattgcagctgttactgatagatacacttatctctcactggtgtatttaatcagcaacagtcaagaaaaagtgccttatttttaacttaaggtttatgctgattttgcttgattttctttgaaatatagctttcacaaaatacagatgagtctggattaaatgatgaagccatcgccaagcaattacagcttgatgaagatgcggaggtattggcattttgcttagaatcattagtaacttgatattctgactagctatttagtccagccaggttttgaattgaacctcattggaagttacatgtaaaataagttaaaatctaataaatgaaaatctaaatttctatacaagataaatgatgagaccaggggagaattatttactgaaagatttatttttagagaagattgatcaagtgctgtgag

SEQ ID NO: 34708 - DNA, 1083 bp, Homo sapiens
aggtaaactaccttgttaattttttattattgatcccattttgaaatgctaataatttggatctattgggttagataaaatatacagttaaaattaatttcacttgtttctttctacttttaaaaatgtggctgtgagaaaatttgaaattttatatgtggcttgcattttacttctattgcatagtgctttataaacaatgaaaaacagatttaggaaaaatgtaggtttcaagtatttttgcttatattattatacagctagctttttagattattgttatacagatttttaggctttccgtttcactccatgagaaatatttttcatcatcactttgattagatctgtcttctactaggatttattgatttttaaaaactaatttaaccacattaatttcccaagttacaggaaaaggaaagaactgcttataaatatctttatagccaactattgactctagtaaaatgttcttcaaggttggtaaaaacccaaatacttgttgtactgggtaaatatatttacttttagctgtttaatgaagtgagagaccttgagtcttgtttggcgaagattgaccttttattacggtttcatcagggcctgttgtttgatcgaaaatggtgggggtttttcctgtcttgaattgtttgactggtaattttaattgtgcatataattctggaggcagttagtactcctgaagttaaaattatttgaggagtgtttaaatgggaaaaaaattggcgatgttgtgttctctaggtgacaggttaccatgtaataagagtgacttgtgactttggaaaatagtagcagaaaatattcttggggatgtgtgtaacattctctttgctaacttttagagacatatagtcttgtgtatcagacaaataggtatatattctgtatatgatagagagcttctcttagatgtttgcagggaaacctagagtgataaaggtagaaaatttccttcaagtgagtattgtatttttttgattatacttgttaaaaaatcaataatttgtacactaaaattctgtataaaagaaactaaatttagaatttttgaagatg

SEQ ID NO: 34709 - DNA, 1046 bp, Homo sapiens
taagctctgatcacagattttctttcacatgggactagttatttcagacaagcaatttttttctttctgtatccagtcatccattaagatgagcagtttttgaatgttgttttgtgaagagatgtccagctttttatctggactttttatgaacgttaggcagtatttgtgtcatttgctggtagcatatacatgtgaaagtaaacattgtcctcatgttttagctaaaaatcttggggtatgatgtacctgtctcagatggtgttcagtattatgcattattctatttttttcttagaattgagatgtagggaagaagcttgctttattattgcctgttttatcttttcatactttattgtttgaaatgataggtgaatgggaggaagataagccctttccttcatacaagagaatgagactattaaaaaaagcccacaataagattggcataataaaatcacaaatgtaagagtttcaaaaaagaaaagtgcagctttttcaaattaatatagtactggaaaatccttgacgttaaagtaatgctttcattactctttacgttaggctaaaaccatacttttcaatattgggtcataaatatttttgttttatattaccagtataaggttaaataaaatgtgtgtgtgtgtataatagaattgggcaatacctcattccataaaacagaataagtgttcccaatatttgtgtaatagtttaaaaattctaatctaaaactgtattgattgtctggagattggagcttcttgtgaaaaagtgtcatatgacatgattcagttttaaaaaacctgttaattccaaaagatagaattttttcttcattattgcatactttatcttttcctatcttctgtattctgactttaaaaacaacctttggttctattggcatttttcttgcggcatagcatgtatactgtttaaaagcatggccttgtttacttaactttccttgtgttttagtttacttatatgtaaaatggagacatcgctagtacctgcatcagcagcctttgtgataa

SEQ ID NO: 34710 - DNA, 1069 bp, Homo sapiens
gtccagctaattttttgtatttttcctagagatggggttttaccatattggccaagctggtctcaaactcctgacctgaagtgattggcctgtctcccacaatgctgggattacaggcgtgagccaccacacctggcctagaacttgctttttcattttctgaaatacggacaggctgagaattttacaaatcttcaagttctggtcccttttggctgaccggtttcttcattagttcatctcttccgttttgcatttgactacaagcagtcaggaggactcaggccgcatcttcaagattttgctttgaaatctcctcagctaaatatctgatttcatcattcacaggttccatctttcacaaagcactaggacacaacttggccaagttctgtgccactttataataagaattgtctttcttccaatttccaataatctctttctcatttccatgtaaaaccttaccaggttggcctttaacattcatatttataccaacattctgttcatgatgatatatgtattctctgagatgaaagaggcttcttctctagctcttctcttctcttcatcagctctcattgttattacatttaacgttcatatttctaccagcagttccttcatggcagtctaggctttttctacatgctagaaaatatctagcctctccccagttccaaagtcacttctgtattttaggttttgttttgtttttgtttgtttgtttgttttatagtagtatcccatttcttggtaccaaaatctgtattatacagtcagagttctgtagagaaacagaaccaataggatgtatgtgtgtatacatagagagatttattaccaagaattggtagagctgatgttttagttggagtccaacggcaggaagaaagtgtcccagagatatcccagctctaaggcagtcgggcaggaggaattccctctcattcagcagagggttggcctttgttctttccaggctttcagctgattagatgaggcttaatgccattagggagggcagtctgctttacttagtcaattgatttaaatattaagctca

SEQ ID NO: 34711 - DNA, 1029 bp, Homo sapiens
tctcgttacccttctccacttgtttttgtcaatagcatttgtaattttaatatttacaattggttgtgtattgatgatgtgtttttttctgctaggatgtaaccttcacaaggaggtaattttgtactctggtgtattccagctaccagaacaatggcatgtagctgtttcctggattgccaaggaactcagtaatagcagtgggactggaagagagagattttgggaaggtattgacaggatttcaaaacagtatgaggcttgtgggagaaatttccaagtggcaatattctagtggggtggagatgctcatgagaggatcagcttatggggagtagctgctgtgggagtaaatgagatttctttgagcatgaaatggactggcatgctgggtctgaccttcataaggtaacttaagagactgtagctaaacagtgattttttttttttaataacttgggtataacaaatgagcctagttctccagggaaaacttaattattgtcttctgtgtctactatggataagcacttgtgcactatttttgcaatttttagatgtaggtgtccacatatttttgagacggggtctctgtcacccaggttggagtgcagtggcgtgatcttggttcactgcaacctctgtctcccaggctcaagcagtcctcccacctcagccttctgtgtagctgggaccacaaatacgtgccaccatgcctggctagttttttgtagagagggttttgccacgttgcccaagctggtctcaaactcctggaatcaagcaatccgcccaccttggcctcccgaagtgctggggttacaggtgtgagccaccacacctgagccacattttttgagaaaatatacccagaagtaacataccaagttggtgcacaactaggcagaaagggattcaggggaggcagtcttggggcagagcccatttacaatgccaaacccattcacattcaacagttcttaaaattgaccaggttgttagttgaatacaagtggtcagcatgaacca

SEQ ID NO: 34712 - DNA, 1998 bp, Homo sapiens
cagacgttctttctttgctgcgtctactgcgaggtaaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatggtatgagacttgatgtcttttacttacatctttactgcacgttccaagcgttgtgtggcctgacgagtgtgttctctcttctagtcgacattactctgaagggacgcacagttatcgtgaagggccccagaggaaccctgcggagggacttcaatcacatcaatgtagaactcagccttcttggaaagaaaaaaaagagggtgagggtttttcttctgataattcagttgctcgttggaaggtggtttataacagcatcacatttggttgctttaacaattttcgaattaaggttcagtgcttcagctttaaatgttgctgtccagaataccagcctgttcagtgaaattgaaaaaccagattctgaacacagccaattatataaagctcaaatgtaatagtggtcatcagtgacacgtcttaatggtgttagaagtttggtttattttcctagtgattgctttgtaaaaatcacaggaaccggcagtaggtcatttaaacctgatgatttaattttccagaagggaagtttgttgcaacttctacaaagcttaactgttgggaggttttataggtggttggatttttccagttgaaaaccatgtgctttgataagggttaattctagaatcttaaagtaattcggtaagtggtctgttgtcttttaagcctgcatatttctggaaagaatacattttttgttctgttacagctccgggttgacaaatggtggggtaacagaaaggaactggctaccgttcggactatttgtagtcatgtacagaacatgatcaagggtgttacactggtaagcagatgtatcagacttccttgttttggaaagggaggtttctcaaacctgtgctttatacagcgtaagtgtctctttcagagaatgggtcatgtattttatttggtgtaatacgcaagaacttggcaaaaataggcatctgtgggtctttaagcgatagagctgagagcaaagaccagatgggtacaacatgtttgtttttttctgttgttgggttttttttttttttaatcaaggctggggtctcgctattttgtccaggctgagctcaagtgatcctcccaccttggcctcccatagtactgggattgcaggcatgagccaccatgcatggctagatgggtacaacttttaaaaagtaggctaatgatgaattttcataccttccgaattctttaagataggaaatctacagttgcagtactagttggtagtcacatctcaccatcaggaccccttgttgggatagaaaaagatgtagtttctgagttttctgtctgctgccataatgtatgtcattattctttccaacccaccgtctctcccctcaagataaaaagttcatgctgaaatggttttctttgcattataccttctagaatgcacctgataatggcaccctgtacatctattataaatctgttaagattcccccat

SEQ ID NO: 34713 - DNA, 1028 bp, Homo sapiens
attatatatatgaaactgaaacaagacgcagtaaggtaattgtaaagagacttgttatacattatgatttttattactttgtgtactgggtgtcccatcaaattccacagatataacagcttagagaagtgggagctagtgcagtgcctagcctaaagtagaaattttgtgggaacctagtccatttgggtgatatatatgccttcaagacaagaaagcaatagaaatgtgcattgttaggacaatgggtggtggttccctccctccagacttctttacttctccagtagcattcattaatctacaatgtacagctcaaatatttgcctcaacaggtaaagctaaaacctgttttcctagttgaaaataattttattgaacctccccatgggaaaacacgtgtttattacatgtgcggcttttgtgactctttaaccagccccgcctataaccaaatatagtcattcctgtgggtaaaatgtcacttcctaactctaaaaagaaaggtgaaactttgaacattcatttaggcatattggcaagtttttctttccccccagttcttttagcagttggtaaaaatcctttctgagagctaggcttttaaatggttaaacagtagtttactgtgagggatagaattatttttcttatattctaaattttctccagtgagcttatacttttttcttaaaataataaaacatattttgtagctatctttatatttagatactactattcaattggatagtattgtgctactattcaattggaaaaagttattttttaaaattaaatatatgttttaggatcgtgggaatttgaggcttcttaagaattgaaataagccttgaagaaatacgttttattctcttctgacttttttaaattggttgctttcgttcatttctgccttttatttctgtagttgtattttgtatatattccattgtcttatttttttactcttccccttttcataggtgttattccattgttttagaacagtgtttaatcattgtgat

SEQ ID NO: 34714 - DNA, 1025 bp, Homo sapiens
ctgggattataggcgtgagcccccacgcctagccttttttttaggattaaaaaattttctctccatgacacaggaggtcctgatgacatgtgccctcttgggtggaaattttagaaaacgttttcaaattatgaaacttatggttatgatattgaatacaaacaaagatgatttaattgaaaagctttcctttgtttgactctttatgatcagttttacccctggaccttgaccaggcacagagagaattcttaggattgtacaagagtaaactgcggccaggaaaggacaggacattagtaggtgagagaccaagattaagaacagaagacttctttcttttctttcccttttatgcagatgagtgataactttggccccagtggaacacacacactccagagcactatacagagaacttgggctaagggttaaagatactttggtcttcaactgaccccaagttttaaaactttttcagtttattaagtactgttacaaattctcacttgatctttgcgcaactgtttaaaatgaatagtttcaattatcactcttgttttatagataaactgaagtcacaacaaggctaagtgatttatctattaatatttctcagtactgccttaagttttttgtctaaggatgttctttctgctgtcccatgatgttttggcaagtgttgtctaaagtgatcctagaataggagtcagatagaggtaaagaaaaaagggtcgccaaggaaagagaaggtaatgtttaagacagtcctttggtctgaatgcttgtgttccccacaattcatatttgaaatcctaacccccagtgtgatagtattaggaggaggtgggcctttgggtagtgattaagtcatgagggtggagccatcatcatgaggagtagtgcccttataaaagagggctcagagagctgcttgccctcttccaccatagtaggacacagtgagaaggcaccatctaccaaccagagagtgggtcctcagcagacactgaatctaccagtgc

SEQ ID NO: 34715 - DNA, 1584 bp, Homo sapiens
tgtaatcccagcactttgggaggccgaggcaggcagaccacgaggtctagagttcaagaccatcctgaccaacatggtgaaacaccgtctctactaaaaatacaaaaaatgagctgggcatggtggcacgcacctgtagtcccagctactcaggaggctgagacaggagtatcgcttgaacccgggaggtggagcttgcagtgagcccagatcacaccactgcactccagcctggcaacagagcgagactccatctcaaataaataaataaataaataaataaataaaaatgtggaatgaattaggcaagttgggctgctaatgccttgccactgaattgaacagccacagacaaaccagaatgcacttctcagggcaaaagaacaaatattgatgaagtcaatcccaacatgctcattccttttccctaatctcatctattagatgagttcctccttctcccaaagaggagtaggtgagaggaggtgagaaagaggccatgtcccactctcctgtgcttccagggatcagaatttccctccctattagggaaatgcgtttaaaaaaaaaaaaaaaacacgccagtttggttgggatgtttttagtatgctaaaacgtttatgtttacccagctcatgagtcagaagttattttgctgcttataaattcattttgccatagtatgataaatagcttttaatgttgtaagcaaatagggcattggatagcagcactaagtcattgaaaacaaaaacttctttattggtgtttggtttttatatagtttagggaaaggctctttaaaccaagtttcaggtgaaaaaatgaaaaaactttttaaggattttagataacatgccaagcacagtgactcatgcctgtaatcccagtagtgaatctgagaagcgcaggcttcccagatcgcttgagctcaggagttgaagaccagcctgggcaacataatgagatcccgtctgtacaaataatttaaaaattagccagccatggtggtgtgcgcctatagttctagctatttgggaggctcaggctggacgctgagcctggaggaccacttgaacccaggagttggggctgagtgagccatgatcgtgccactgtacttcagcctgagtgacagagtgagatcctgatgcttaagtttaaaaaaaaaaaaaaagattttagataacaactatggaaatgaaatcattttcgtttggtttatatcttctccacatcttttctaactttgcgttctattcttaaccctaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgc

SEQ ID NO: 34716 - DNA, 1585 bp, Homo sapiens
tttagcttgattcctacctatagggtttatttactggttcaaggatactttattccaccaaaacagagagaggaagatatgcaaaattctcctggcctcagttttagctgggagctgatgctaaaggttttaacttgtaaaggtaacgttagaatttttagatcggatttttgtggtaaatgtattccctcagctatttgcatgtatgtgggtttcagtaagtattcctgtttatgttttgggctgcatttagacttgttattccttttgcaaaaattccttgagttcacccaataaaaccagtaaaaatcagccatttgcagtgtggtcaggaaacagtcaacagtattagctggacattagtgttgggtctctgagtttcggatgaaggaatgatcatttcagtagtttagttcacttgtttttcctctttgtgttaaggctatcattcagagggcaaacagttcccggtgttgtgaattgaaaatatgttctgaatagatttgctgattgttgagtatgttttgcttacacttaaggccaaattcttccttgaagatgagcttgtcaataaacatcaatggaaaaataaccccaaatttgtgacttctggggaatttgaatttaaagagaatatctgtaggataacagactgtgggtttctagtcgttggattaacatgttttgtttagcatgcttagtgtgggagtgttcaaggatcttagaatttgtttttcttaaagcaaagaattgactgagtttttgtgctcatttgtataatgagaaggtttcctcccatcatgtgggttcgtatctcaaaattaacccctaagtatatatcctcaaatgtgtatcctcatgtgttaaacagctatatattagttcaatatgaattttttttagtaacaagtgaatttttctcaaaataacatgaaatttttcagaagccaagtgcttgcagtgatggcagttcatcttggtacatagaatcaagtccaggagctcttccagtgacctgggtctttcagaagtctgtgagagcagcccaagaaatacagaggactcagggctaggaaagggaagcttcctgaaggtgtagcaggcagcttgtaaataattctttggccgggtccagtggttcatgcctgtaatctcagcactttggaggccaaagcaggctgatcactaggtcaggagttcaagaccagcctggccaacatagtgaaaccccatctctactaaaaatacaaaaattagctgcgcgtgggggcgcaacctatagtcccagctactcaagaggccgaggcaggagaatcgcttgaacctgggaggtggaggttgtggtgagccgagatcatgccaagcactccagcctgggcaacagagcaagactctgcctcaaaaaaaaaaaaattctttaatagcatattgttaaaattgcttcaaatagtataacaaattaatagtctctgtatgaattgtaataatcacttagctcttttagcattgttacctttataaaatatgtatgtagtaaaggagtttgggaatatatctttctttctcttttaggtgtaaaattgtg

SEQ ID NO: 34717 - DNA, 1618 bp, Homo sapiens
tcttttctaatagagatcattaatatttaaggaatttgtgtttatagaattgttttgtgcttttttaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaatgtacgccattcttcctcaagtgggaatttagacattttgttttattcgtagtatattcttagtgccagtcaccccaaacacctaagcatttgagagagaaacctgcatctggttttcctgggtccgtttataatagcatctgttattatctcataacttccagttttaaggcacaaatttgaagaaaaatcttttttctttgtgtaatttttatttaggatatggtattttgatatttctatttttattaacaagacaaatatttcttttgcttagtgcctttcaagtggttgcagaggtttacataaaataagggctaccttttggatacaaggtcccagaaatggagaaaacagtcacgaaatgtcaataggtaataggtcccactctttaattcttcgtgttatagttaattctaacacaggtcaacaacttacatcttccccaccctgcccagaaaaacaacttaccaaactgttcatctttgatcattcttgtgctgagatttcagacttttcctgttggaaatctagaaggtggctcctttcaccttggccttagaacttaactcatcctccttttttccttacatacctaactcatttacccctgaattagactgtaggcatttgagtttcttctagggaagagtcccagatttgatcagctcaggatacccccactatcctgcttcagtatttttataaaactcaatgtcaggccatgctcagtggctcatgcctgtaatcccaacactttgggaggcctaggtgggtggatcacctgaggtcaggagttcaagaccagcctgaccaacatggtgaaaccccatctctactaaaaaaaaaaaaaaaaaaaaaaggaaatgcaaaaagttagccaggtgtggtggtgcatgcctgtaatcccagctactcaggaggctgaggcaggagaatgacttgaacccaggaggcagaggttgcagtgagccaagattgcgacactgcactccagcctgggtgacagaaggagactgtgtctcaaaaaaaaaaaaaaaagttactgaagcatgtgtgtaaaaacatttaaaatattatcatttatgagctgggcccagtgactctcgcctgtaatcccaacactttgggaggccacggcgggtagatcacgtgaggtcaggagtttgagaccaacgtggccaacatggtga

SEQ ID NO: 34718 - DNA, 1029 bp, Homo sapiens
gtctcttaaaatatatatatatatatatatatatatataaaaataggataagtttacattgttctaacattttctaattataaaaatattccatgtttattttaacatgttaagtattcagtatattagctactgcataagaatttctacctgcaatttttttcataaacatacttattttgatatataataattgtacatatttatggggtgtttgtgatattttggtatatgcatagcatgtatagtgatcaaatcagggtaattaggatatccgtcacatcaaacctttatcatttctgaccctactcttaggaacacttaatattgtggtttttatagatattattcttacacatgaaatcttaagaataaactcaaccaatgatgttttaaaccacttttagcaaaaatgaagcccaagatatgaaatcagttaacatggtttaaagaatagtggggcctcaaatacctaccaaatagcctcttctgacagccccctttttagtagaacactatggaaatgacaactatactatggtctgtagttttatttttgttttaggattttctattcccaaaagataaagcttacagtggttgtgttattttgtctcttgacaattaacccttttgtcaagtagtcttaggcagtcatttctgtcttaatgttattaaggcaaaatggaaattgataccactttatcaaagctaaatggaaaatgatatttttaaagcaatagtctataactacagagtatccgaatcttgctattgttgcttcaattgtcaaggtttcgaaaccagcctaagcctttctttattggtacggtgagagagtgaactttctcttcatggaaatatgaagtcttggtttatttgttttaaacagggaacagagttcagaggcagcagaaactggagttagtgaaaatgaagagaaccctgtgaggattatttcagtcacacctgtaaagaatattgacccagtaaagaataaggtaaattttaaaatttaacaagtggatt

SEQ ID NO: 34719 - DNA, 1049 bp, Homo sapiens
tgtgccttgcttttgatagaaataatgagaatttgcaaaagtatgctctctaattgaatccactgatctgtataaaaaaaattttttttttttgagtctccgtcacccacgctggagtgcagtggcttgatcttggctcactgcagcctccaactccctggctcaatcagttctcctacctcagcctctcaagtagctgtgactacaggcatgtgtcaccatgcctggctaattttttaacttttttgtagacaggtggtttcatcatgttggccaggcctcaaactcctgggctcaagtgatcaacccacctccagcatcccaaagtgctgggattgcatgagccaccatgcccagcctataagatattcttaagtgagctgttgaattaaaattaatcctgttgctgacccaggaccatcatgaatagaatagtaccaaatagaatctatgtaacagtggtgataccatcatcaagaattaaattcctacttgtcactacaccttatctggactcatagataacaattttttttttcttttgttaccttcagtgttacagagttttagtcttcttaataataacaacttaggtttttctgttttcagtatgcaacgttccttatttatgtaacatgttgcttttaatgtgttataaattcataaaccctagaacactaggtttgtgaagttagtcaacctagtgaagctatactatatctttatgaatgaagtgaatgaactttggtacacaggtttcttaatgtttattttagctgcatagaagactttgtgcaaaagaaatgatacagctttgcctagcacacatgacaaaactgtgatttcctcacaggcacactttgttctttcctacttctgtgaaggtaaatttaatacaataaaaaatattttttaataggattatttaaaacttaattatatttcctgagtttagtagctagttttgcttcactgacacaacattgtggtttgtttgccattttcagatattaagcaggaaaaggcatcaagagatcaagtttgaactc

SEQ ID NO: 34720 - DNA, 1666 bp, Homo sapiens
ctcgatctcctgacctcttgatctgcccacctcggcctcccaaagtgctaggattacaggcatgagccaccgcgcccagcctcgaatttctgggttcaggcaatctacccaccttagccacccaaagtgctgaggttataggcacgagccaccatatccagctagggtgaatctttatatgccttatgaaactgtcagactttctcatattaagctatgttttcattttttatatgttattttatgctttaattttccatttgaatagaatattattaggataataacatatattagtcattaaggttgatcattttattttattttattcagacaacagaaattcccagctaacatatttattgctttaagctaaagcatctatctacgtctagtctctttaatatgtttacatttaggtgcctatggttcatgcttgaagttttaatgacaaagaatgaaaacaatagccatgcctttatgaagaagatggcagagaacatcaagttaaccagagatgcccagtctccagatgaatccaagacaaatgaagtaagatgagtgttaggccagtgggtgttaagatgtaatagaaaaatatattgtcccacttggttttttttttttttttttggccatacgtagtaatttaaattttagaatgtttacaaaagtaaatgtgtagtcagtttttattgcacttcattacaagtgaattttatttcaggaatctttagtactctgaaaagacattataaccttagagcaagaggataagaataaaatgtacaactatggtatattacgaacttacagtaagagttacagacaaatgcttattctttttgtgtgctttctttgggttggttcatttgtttgttattttccatgcatattggcatccatgttaaattcatatagagggatttttatttatcagaaggctgcataaacagtgctgaacagaaatatggaatgttcaaggaataaataacaaccacagtatccttcttttaactctaaattatacatttagtggaattggtaattatgattattttgcaatactaaaagttatatatgattcgttttcctccctagaaactgtatacagtatgtgatgtggctctctgtgttataaatagtaaaagtgctttgtgcaatgcagattcaccaaaggacccagtcctcccaatgaaattttttacacaacctgaaaaggtaattttcttcctctcatttttcctaccacactaaactgatttcaatgtcaattaccatcaaccattgtggcaaatattgaattgtcttgaccacagagtaaagaaaaaatctgggtttatcaaagagtgggaaattgtcttacacagccctgaacattattctgacttgaacagaagactacacatactgttgatcttatgtttattctaggaatttctagtattaaagttttcagatttttaaaattattttaatctcattttattgaaacatgggtagtatttttgcagataagaaaaattttaaatctttggcacagtgtaaggagggacaggttctctcctctaagcctccatttcttcatctttataatgcagatgttaataatacatatggacaattgctaatatctaggtttatatgaagagtttatcacataaaa

SEQ ID NO: 34721 - DNA, 1048 bp, Homo sapiens
cctcctcagggttaattcctaattctttcttcttccctgtgaattagtcatatttgcctgattctttatgtgatttgtagtttttcgttaggaattggacattttaagtactataatgtgataactctaaaaatctggttcttcctctctttctagattgcttttggttcttgtagggcgcagtccaccattctgacttttccaaactactttcacaaagtctgtattccttgttttgtgtagaccttgaagttatagttctgttatctttatggtcagcctgtgaccctgacatagattcccttcactgttgaggttcatcccctcttcctccatcagaccaggtgtttacccctggttgctgggtcccatgaggttccagagttctgcacaggtgattatgattgtttttttccagcttaatagttgttttgttgttgcaattgatatctgaaatttcttactctgccatttttctgacatcagtaataatgtatttgaatttgaaaaatcgtacttaaatatagcctttaatgtttaataattacctttctcctttattgatattcagtaagaaaaaattgaaaatgaattcattaagaagaaaacaattattcgtaattataccccctaaaagcccttcattgctgttaacaatttggtctgtatctttcaacactttttcttcttcatatgttcatatttccttaacaaatatttatagagtactttcaatgtgccaggtacgctaagttcttgggttgtgaggttatgtaatatgaatatcatatatattcccttaaggtttacaatctaatggaagatgaagaaagataaagaggtggttacaatatgatatgtgatatatgctctgctattgtgggagtacctagaataggcacataactcacacttgcagggagtcagaagttaaaaagaggaggaagaaaaaaataatctgtagagcagaacttctaatagtgtagacttcagacataccactactggaaagaacagagaatcagaaaacgacctggaggaagaatat

SEQ ID NO: 34722 - DNA, 1061 bp, Homo sapiens
ggtggaggttgcaatgagccgaggtcacaccattgcactccagcctgggcaataagagtgaaactgcatcttaaaaaaaagaaaattttactgcattttcttccatgacttatagtttttagctctttagttaagatctttgatccattgtaaattaattgttgcatgtggtataaggtaaacattcagattcattcttttgtttgtgaatatccagtttttccagtaccatttttgaagagactgttctttccccagagattggttttggcacccttgtcaaaaatcaactgaccatatatgcaagggcttacttctgggctctcaatcctatttaatttgtctgtatgtctggccttatgccatgtaactctgtcattactgtaactttataataagtttcagaattgagaagtctgatttctgttctttttcaagattgttttggcttttgatatttcctgtgaattttaggttgcatttatctatatttctaaaaaattccattgtacttttgataggaatgggactgaatctgtatattgccttgggtgatattgttatcttaccagtattaagtcttctaatctattagcacaggatgtctttgcatttatttagacctttaattttttattttatttatgtattcatttatttatttttccagcactgttctgtagttttctgggtataggtcttcgtcttccttggttaaatttatttctaaacattttattcttggccaggcatggtggctcacacctgtaatctcagcaactttgggaggccggggcgggagaattgcttgggcccaggaatttgagaccagcctggcagcatagtgagactctgtctctatttttaaaaattaaaaagaaaaaagaaaatgggttattggtgtctccagttcttattaaggcactcactatttctcccttcagttctgtccattttttgcttcatagattgggggactttcttgtttgttttgtatatatttattacagtcacattttcttgctggattgaccttttatcactacagtctttgtggtctc

SEQ ID NO: 34723 - DNA, 1061 bp, Homo sapiens
ttgtattttttgtagagatggggtctcactgtgttgcccaggctggtctcaaactcgtggactcaagcgaccctcctgcctcagcttcctgaagtgctaggattacaggcgtgagccactgtgcctggccttcactctttcagtgcccacatatgagtgagaccatgcgatatttgtctctgggcttggcttatttcactgagcataatgacttcaagttctgttcattttgctgaaaatgacagaatttcattcttttttatggatgagtaatttttcattgtatgtgtgtatatcctccattttcctaattaatttatctgttgagggacacttaggttgattccatatcttggctgttgtaaatagtgctacagtaaacatggaaatgcatccatctcttagatctactaatttcctttctttttttcctttttttcctttttttttttgagacaagtgtcttactctgttgccctggctggagtgcagtggaatgatctcaactcactgtaacctttgcctccccacttaaagctattctcatgcctcagcctcccaaggagttagcactacagacgtgtaccaccacaaccagctaatttttgtatttttagtagagaccagttttcaccatgttgcccaggctggtctcccaactactggcctcaagtgatccacccgcctgggccttccgaagtgctgggattgcaggcatgagccactgtgcccggccaagatgtactgaattcctttattttggatatatatccagcagtgagattgctggattatatggcagatctgtttttgtttttttgagaaacctttttttttctctctctttatagagatgcgatcttgttatgttgcccaggctagtcttgaactcctgggctcaagcaatcctcccaccttggtctcccaaatttctgggattacaggcatgagccaccacacccagcctgaggaaccatcatactgttttccatagtagcttcaacatggtgtccccactgattggagcagtgagtagtcaccagagtttaagcacagtcagt

SEQ ID NO: 34724 - DNA, 1042 bp, Homo sapiens
aatcctatggctactggtaagtaactcagagttctccgtgtgcaaatatattttgtcaatgtatccatttttaggttttttttttcttgtcatgtgtttctattatagtttataataaaactgggagttttatagaatgctgtcattgtagttatgatgtacttaaaaactgaactcctgagtcctatttatgctgcattaactctggcaaactgcatttttcctatgggatcaggagtgtagtttaatttgaacatattgctcggatgtcagactaaataattttttcctagctttgccagggacctgttgtttaatgggtttaatatctgatacctttgacttcagtatctttcaaaagtgaaatacaactgcataccaggtaccagaaaaagaaattgaaaagtgaagtgtaaagtattttagtatccaggtatcatgttgtgcctaatttagaaataactgagggaaaaaatgaaaacttaagtggttagaactcagtccactaaggcattttataaaggttgtttttaataatgtttttacttcagagaaattattatcactgttgcctgaatatgtagttccatacatgattcacctgctagcccatgatccagattttacaagatcacaagatgttgatcagcttcgtgatatcaaagagtaagtcttgttgtttttcaagaactctaaaaattatgtttagttttcaaaaaatggtaaattttttgtttattatttttatttattatttacattagaattagaatctccttatggttttattcatttattataaatttccagtttcgtctttcaaaaattttcccatctaccaggttttggttgttcattttctgtttgtttgcagctagttaagctatctaagtctttgaaataggttagtttggttatcttagttattatatttgatttttactatttatattgagagggtttgaatatgggaagagtactgaagtatgtgaaataattggagttggaactgaaaacagtggagcatattttttattctttg

SEQ ID NO: 34725 - DNA, 1056 bp, Homo sapiens
agctactggggaggctaaggcatgaaaatcacttgaacccaggaggtggaggttgcagtgtgccaagatcacgccattgtactccagctttggctagttatgtggtactgctatgctattaatttttttaaaaattattgtgattaggaatgggatctcactatgttgcccaggctagctgggctcaagcaatcctcctgcctcagcctcctgagtagtgggactataggtgtgcaccactacgctctatttttatcatagaataagccaaaggcagccttttataacactgtttagagctgagttagggataatgaaagctttaaattgggggtaattatgtacagtacatggcaaaggcataataatgagctcttacaagtcagtgatacctaggcaggacccccagtggagatgaagtttagctattatcagtttacttttaaaagtttaacatcactaaatgcagtcaatacaatttaaacttaatcaatacctcttttcattacaaatcagaaagaaaaaaaaacgttataagcaatcattcctcagtatgatcatggaaatgggttccttcattactcctatgagtataaattagcaggactctttggcattttgcatctagatcctcaaaaatgttatccttgactctttatttttacactcataattcatgagtataaaagaatcatatgaaagcttatacacaagcatgttcctccagcattattttccatcacaaaaaataggggaatggttaaccatagaatgaacacccattggacagatcctaactggatatcatataatatagtattaccttttgtaagcctcaatttcctcatcttatggagtgaaaattaattgagataaagcctataaagtgtttttcacacctgcctggcacggagtaagcactcacataatagctattaactttgattcctgaatgaatgccatagaaaccatttgaggctccctcattgttaccagtgctcattttaacaatcctgttgtccaagagtgccaggttttcttctctctatgcttagc

SEQ ID NO: 34726 - DNA, 1074 bp, Homo sapiens
atacctgtgtaacaaacctgcacattgtgcacatgtatcccataacttaaagcattaaaaaaaaaaaaagattataacggaactgaaggattcctatcacctagtgacatcttggtgatcctgacctggcgtaggcctaggctattgtatgtggttgtatcttagttttgcacaaaaaaaagttttaaaactttctttttttttttttaaacagggttttgctctgtcacccagactggagttcagtgatgttatcatggcccactgcatcctcagcctcctgggttcacgtgatcctctcccttcaatctcctgagtagctgggactataggcacatgccaccatgcccagctaattttttattttttgtagagacagggtttctccatgttgtccaagctggtctggaactcctgagctgaagaaacctacctgcctcagccccacaaaatattgggattacaggtgtgagccaccacatgcagccaaaaaaatttttaataggaagaagctagtagaataaggatataaggaaagaaaccattttgtgtacagctgtacacaaaatgtgttttaagctaagtgttactacaaaagagtcaaaaagctaaaaaaaaaaaaaaaaaagatcagtacattggctcacacctgtaatctcagcactttgggaggcctaggcaggaggatcacttgaagccaggaatttgagaccaacctgggcaatatatcaaaacccccgcctctacaaaacattaaagaaaactagctgcacatggtggcgcacacctgtagtcctgactactccagaggccaagatgggaggatcacttgagcccaggattttaagcctacagtgagctatggtcacaccactgcattccagcctgggtgacagaacaagatcctgtctccaaaaatttttttaaaagctaaaaaaaaaaaaaaccgggccaggtgtggtggctcacacctgtaatcccagcactttgggaggccgaggttggcagatcatgaggtcgggagatcgagaccatcctggctaacacggtgagaccccgtctctactaaaaata

SEQ ID NO: 34727 - DNA, 1943 bp, Homo sapiens
taaatgaatggacatgactatattccatcgaaactactaacaaaaacaggtagctcatgggggcatagttttctaacttttgaactaaattattcaaatttagtataaatgaaaactaataagtaatgttttatgggatacaggaaagggaagtacgttttagaaaggaggttttcctgaaggtatttaagtaacgggccacaaagtagctaacagaactctattgcagaaaaaaaagtttcttctctatatttttagttaattttttgtggcatgtagtttcatagtaattctgatatgataagtttatatgttgattgcttcattgatcttttttcaatcttctggcaatgtaactttcctgtgaaagttatatacttgtgggtttttaagtaccttcctcccaacatctcctttccttctatttgtcttaatagttgctactatgtaattctttgttgttagtttagcgtatatatgtggtaaaaccattttccattgagcagactgtgatgaactttattttttaacgtcatgaaaaatgtacagtaatgagtattgatttttgttagggaaatttgttaacacatatgactagttgttcttttgtttctgttttaaatttcagtcagaggctaactgttctgccatgtttggaaaactgatgaccatagcaagtgagtatgtttatttactcactaaacatgtagtaaacgtaaatgcagacaaagtatttacccagtgggactactgatttaatgttaagtaaaagaaaataatctttatcttaattttgtttctaagaaccagctaggctgattttcttttagtggctccgcaatattttgatggcacctgtttttagcttagtagaatagttttttttttttccttctctaatattgattctcttttaattttatagagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctagctttacttacagaaatatgtattttattaaagcctgttttacatacagtgatttgtgtaaatgtaacaatattgtgagctctgaattactttggagtatatctattgtcaagttaattctctatttaccattcactctcagccacattccaggaaaataactaaagaactaagccagggagattggtcttaggaattttacaagataaagtactttgaacttagtagacattcattgagtaatgataagtattttctgaatgcttgtgtacatgtgcattttcttctttcatgtattagaatggaaataatcgtcaataaattagtagtagtaacattgccatatatctggtttcatttacagataaagtaaattcctatctagacttttgtcttcattcttctcttgaactcatttaaaaccaatattcttaaagctatcaggagggaaaacttatgcattcatttattcagctttttttttttttttcctgagatagtcttgcttttgtcacccaggctggagttcagtggcacaatcatagttcactacagcgttaaagtcctgtgctcatgtgatcctataccccagccttctgaatagctagaactattggcacacgcatccacacccagctaagtttttaaattttttggaggccatgcacattggctcacacctgtaatcccagcaccttgggagtccaaggcgtgtggatcacctgaggttgggagttcgagaccagcctagccaacttggtgaaaccccatctctactaaaaatacagaaatttgccaggtgtggtggtacatgcctgtaatctgagctactcaagaggctgagac

SEQ ID NO: 34728 - DNA, 1048 bp, Homo sapiens
tttaattaaactaacttctctggcatcactggatatgtatttcatttgttaattaagagatcttgtatattcttaatccagtgatattaaataatagaagcaagaagatacaagcaataggtactagcaagaaggatattccaatattggtaaggaatttagatcatggagagaacaataatcagatgtacacaggaaaaactacattttctggaagtaatatgaaggggggtccccctgtttttaactatgtgacaacatggaaaatgggctgaactgtaatcagaggaaattaatgagtttcttgagaattagctctaccgcggatcatagctttatatgttgcgttaatgaatttgcttttgttctagactgctgaagaagaataggcggaacagcctagcaccctgtgtttaggaataacatttaaaccttctagaacaaatgtttcatactgacaaattataaagccacagacagtaaccgtgtctctaaagttaaactgtactgaaagctttccaagaaggaagtcattataaactgatatcttccattgtatgtgcacacatagctattatcttgatatggtatcctggcataagatggttaaaacttaaaatgttggctgggtgtggtgcctcatgcccgtcgtaatcccagcacttcaggacgctaaggcaggcggattgcctgagctcaggagttccagatcagccttggcaacatagggacaccttgtctctacaaaaaatataaaaattagctgggcatggtggcacgcgcctgtagtcctagctactggagaggctgaggtgggagaatcgcttgaacctgcgagacagaggttgcattgagccgagtttgcaccactgtactccagcctgggtgacagagcaagaccctgtctccaaaaaaaaaaaaaaaaattgcttcttaaaaatggaataattgtgtcacttaggttttttttgttgttgttatttcctagactgttggtagagaaaatctttgctcagtatcttgtcccccacaacctggaaacagaaga

SEQ ID NO: 34729 - DNA, 1050 bp, Homo sapiens
atgactttttattatgaagtgtaaaactcattaaagcatgaaatgaaatagcaattttaaggagcctgaagaaggctcctttaataataaaatataaaagaagcatagttaatgatgttgccaaatatcaaatgaatgttattgtccatatggggccaggaactatctgggctagatttaaaatgaataataagaggcttaagttcctcataaatgaggtactagtgcagacaatgtgcctgagaaggtgatacttgtttatgggttttttagactagccgtttcatgcttgtgatcttttctgaaattcttaaatgaagatttataaaaagttgactgtgaactgtctggtggccaccgattgctaatggagatgacttttttttttttaaatcacatcctccactgatttctaaattccaggagttaattattttgtgtttttgtacatttttacagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggtaaatacagcctttttcactttattgtatttttcattcaccactgttcagaaggtatacttttatttttatattttacctttatgaacataggtttcatattagtctcttcatcttaagaatatattgtaagttgcaaaattattcattcagttagtatttccacaaatgactgggttgcttggttgtttgatttgaagcatagaaaggtatagttcaaaactagtccctgtatgctcaaatccaattttctggctaattcatcacaaaagcccagatagctatgttccagggataaatagcagattaatgatactttttaaaataatagcataccagaatttacatattcatatgactattttcccctataagttattcagcatg

SEQ ID NO: 34730 - DNA, 1048 bp, Homo sapiens
tagttctcttccacgtagtctatgtggtatacacagcctctgttttttgaatagtctgggattcctaatagcatggtgggtacattcccataggggcattgcaatctcaacgtacaaatgcttatcaggcctgttcttgcatcaggcttgctaatgtctgtttggccaaaataagtcacatggactgggcatggaggctcatgcctgtaatcccagcatttggggaggctgaggcaggtggatcatctgaggtcaggagttgaagaccaacccagccaacgtggtgaaatcctgtctctactaaaaatacaaaacttagccagacttggtggcgagtgcctgtagttcccagctacttgggaggctgaggcagaagaatcccttgaacctgggaggcagagattgcagtgagccaagatcatgccactgcagtttagcctgggcgacagagcaagactctgtcttaaaaaaaaaaaaaaaaaagtcacctgaccaaatccagagtcattgtggaagaagactatataaggtatacatatgagaaggcattgtatcatagcctccaagatagctctgaatgatccttatttccttgtatttactcccttgtatagtcccctgcaacactgaacggggctgtcctgagtaacggaacaggctgtggtagaagtgacaatgtatgcttttcaaggttaggtcgtaaaagactgccacttcatatttgctctcttggatcttgcaccaggggaaaaccaactgccttttcacttgagctgtctagaaaggcccatgtagtgtggaactgaagcctttcaacaacagcaagtgtcaacttagaaccgtaagaatgagttaccttcaaaacacaccctccacgcccagtcaagccttcagataactgcagccttgaccaggtacagcctcttgagagattccaggcccacacgacttagctaagccactttccaattcttcaaccacatatgataaatacatgttattgttttaaggcactgagttttggggtattttgttacatagcaataat

SEQ ID NO: 34731 - DNA, 1046 bp, Homo sapiens
cagcacattaaaaatgtgcacagtaacgacatatttaaaaaagggaagaatgaatggaatttcatttctgttcctgtgtggtaaagcaaaatctagtggcttaaaatgaataattgtttctttcaattctgtgaatagactttgtggtccttcttttccatgtggtgccttctggggtcactggttttttttttaaacagtttattttaatttaataacaatctgggaagtctgcatcagcggttctagtgcaatatcaagtgcaattgggaattcagaaatttcagtggaactgttagtttagtgaatctcgtaggtaaaaatatatgcatgctttaacttttattttatttttctagaggtagcattttgttctgtcaccaggctggagtgcattggcatgatcatagctcactgcagcctagaacttctgggctcaagcagtcatcttgtctcagcctcccaagtagctgagattgtaagtgcaagccaccattcttgacaatacatacatacttttgatagcacacatgaacagacctctctaaaattgctctcaatgagttcattctcagcaaactgatctgggtcattcaacatggttttggttttggttttggttttgagacggagttttgcttttgtcacccaggctggagtgcaatggcacgatcttggcttactgcaatctctgcctcctggattcaagcgttactcctgccccatcctcccgagtagctgggactacaggcacctgccaccatgcccggctaatttttgtatttttgattgaggcagggtttcaccatgttggtcaggatggtctcgaactcctgacctcatgtgatccacgctcctcagcctcccaaagtgctgggattataagcatgagccactgtgcttggcttcagcatggccttttgattgttcctcatgttagtgcatgttctctctttttttttgaaatggagtcttgctcctgtagcccaggctggagtgcagtggcgtgatctcagctcactgcaacctccgcctcctaggttcaa

SEQ ID NO: 34732 - DNA, 1028 bp, Homo sapiens
agaatatatgacagctgaaaacacataaggaaaaaagaaaagagatttggagaggcacgtcaccaagaaaacgtagagtaggtggcaaatacgtgaaaagatgcttaattttgagttaatttgtctcaaaaaaatatttatagagtgctggaatgtggtaaatattcagtaaatgttaatcattattaatagtattggtgttagtgtttcttttttatcaatattataaaaacctagctgtgggcaaaaaaacttagtttgattttttcctgctcatttcttaaaaaaaaaaaaaaaaagaaaaaaaaagaaatactaagaccgcaatagataaatagccagagggtattaaaacacaatccacaggaaaaaattcacacagacttaccaagaaattgtttaattctcataagtgtatgataaattagatgaggtaagaagagattagtctacaaagagccaatagcatttaaaaaggcctgaatggcacaggggattctgacatgttgaaggatctgagagaaaatcagagtcatgtttcaaacaccagtcaagctttagttatgttattttaagcagacagggaacttgctatttaaaaagtgatttggaattgctggaagagcacccttaattcaggcttacaggactagactccgagaacacttcgtatagctggcccacaaggagagctgaatcctgtgctctaatcagaaaggtgggaaaatcaggaagccaccctggagctcttaagtagggacacacgtttagccgtaatccagtgattaggaagtcaccattggtataatttggtacagagcctcacacagtttaatagattagtaccagcacaaaatggatgcttcttccctctatcttcacaatactaacagccagttagtagaaagctgctgtgtatgtgcctgcccgcacacacatacacacaacagctcactccatacttgccagctgacaacagcagaaactacaccaccacctcttctgaactttcaccttccaaatcttga

SEQ ID NO: 34733 - DNA, 1030 bp, Homo sapiens
tagttttcaccttgaatgcatattaaataaataaaagggctatgttacaaataatagtacgaaataggaaaggaagctgcaaagaagcacgtattggcaaataggttgttcattctcaatcttagccagcagtccatgtatatgctcagtgagtaaactgccattttaatataaaagttagatggcctgtttaattcagaactcactttgtctttacacctgacaggttgatttttgttgctcaaagattggtatacatgtaaagttttctgggataatagtttcattaattcaagaaatactgagtacttactctgtatgaggcacattttttgtagactctaggactacacaaatttttaaatctattgccttcacagaacttaaaagtctagtgcaggaaagacagaataagcaagtaaaatgtaagaaaaattggagaaaagtaaaactacgaagagaaagtgcttttacagcatatgagttaaaatggtgtccttgcaagtattagattggcaatcctgaaacctgggttttagttttcagttctagacctaccattaactcattatgtttcttcagttaatatctctaggctgagcatagtggctcatgcctgtaattccaggactttgggaggccaagacgggtggattgcttgagcctagaagtttgagtcagcctgggcaacatgatgaaatcctgtctctgcaaaaataaaaacaaacaacaagaccccaaaatttagccaggcatagtggcacatgcctgtagactcagcttctcaggaggctgaagtgggaggatcatttgagccctggaggtggaggctgcagtgagcgcctctgcgctccagcctgggtgacaaagcaagaccctgtctccaaaaaattaaaataaaaatctgtaggtctgtttcttcctctctttctctcctgttcctcctcgtctcttctttatttttatgtgaaggaattcacatttctgaagcccctacattatctaaaaggtggttagattaactgcttta

SEQ ID NO: 34734 - DNA, 1052 bp, Homo sapiens
agccactctgcctggctaggacttttcaaactaaggagtttgtgtcttagagatggtaacataggtacagtacttagaattttggagtcaacaggtagttcagaggttatgtatttctgttctaatttttcaggtgaagaaactgaccatttgataggttgtgaacaacgctagtcacctaaagctgaaaagtgtcattaacttctgctacttagataatagaagttacaattatatattaattgacaaatattaaaaccatactaaagttagctatgtggaaggatggccaatagtttagtatcattgttacattaagaatcacaaatagctggcacggtggcttacgcctgtaatcccagcactttgggatgcctaggcgggcggatcacctgaggtcaggagttcaagaccagcctgaccaacatggagaaaccccgtttctactaaaaatataaaattagttgggtgtggtggcacatgcctgtaatcccagctactcaggaggctggggcagtagaatcccttgaacctgggaggcagaggttgcagtgagccgagatcacgccactgcactccagcctgggggacagggcaagactctgtcacgagaaaaaaaaaaagtaaaagcatacactgagcaagtgattttttaaaaaattcatattacaggccgggcacagtggctcatgcatgtaatcccagcactttggaaggccgaggtgggtgaatcacctgaggtcgggagttcgagaccagcctgaccaacgtggagaaaccctgtctctactaaaaatataaaattagccgggtgtggtggcgcatgcctgtaatctcagctactcaggaggctgaggcaggagaatcgcttgaacccaggaggcggaggttgtggtgagccgacatggtgccattgcactccagcctgggcaacaacagtgaaactctgtctcaaaaaaaaaaaaaaaattaatattataattaagtaatctaagcaccattgcactccagcctgggcaacaagagcgaaactccatctcaaaaaaaaaaaa

SEQ ID NO: 34735 - DNA, 1028 bp, Homo sapiens
gatgtgtgctctgttgaatcatagttacatgggggaagtcctcctgcctgaacttctaaatttatgggaatcacagtcaaggttgctcaatccatgtgccctctacccaaccctcaccccatttcctctaaagatcctctactgggggtaagattttacaacttccatttaaatctgtgatggggtttcaccatattgaccagtctggtctcgaactcctgacctcaagtcatcacccactttggcctcctaaagtactgggattacaggcatgagccaccacacccagcccaaatttaaaaatttttgctgatatagtaggactcactgtttcgatttctatctattttaatcagacaaagtttgatttgaatagagttgaactattttcatgtttattcatcatagaatcttgtttttctgcaaactgcctgctgatatctttgctcgtatgtattgtgttgtatttttttgttgatacggaagcactctggcatattaaggaaattggctctttaatgacacactcctaattgtagtttgtctttgattttgttttaataaatgttttaaaattccatttaatgctcagttcttggaaaaaggaagagtgattgggaccaatgtttagttcaatttgaaattcagataaataatcagtttcttccttagctactgtatttagtttctaaactcttcacactaagctcttttttttttttttttttttttttttttgaaacagggttttgctctgttgtccaagctagaatgcagtggtccaaatatggctcactacagttggagcttccgggctcaagcagttctcccacctcacacccccaagtagttgggactacaggcgcatgccaccatgcctagctaatgtttgtatttttttttttttttttacacagatggccttttgccatgttgcccaggctggtctcaaactcctggactcaagcaatccgcccacctcagcctcccaaaatgctaggattacatgagtgagccaccctacccgg

SEQ ID NO: 34736 - DNA, 1061 bp, Homo sapiens
aaaaaaaatgccgggcgtggtgactcacgtctgtaatcccagcattttgggaggctgaggaaggtggatcacgaggtcaggagatcgagaccatcctggctaacacagtgaaaccccgtctctactaaaaatacaaaaaattagccgggcatggtggctcccacttgtagtcccagctacttgagaggctgaggcaggagaatctcttgaacccaggaggtagaggttgcagtgaactgagactgcgccactgcactccagcctgggtgacagagcaagactccatctcaaaaaaaaaaaaaaagataaaaaaaaaagagagagattgatgtatggcaaaaccaaggctgggagttcaggccccacagaatacccaggtctagaactcctgtctttggaagctaattctcttttgtcctcacccccctgcctcacttaacgatatctttcacggcctttcctcttcattcgcactaccatcttcctagttcaagtcataatgttaattcctaaattactgcactagccagagaaggaggaaaaaaactgtaagaaaccacatcaaaatgtcatctgtggttggtagacatctgattttaatttttttatatctgcttttctgacatttatacattttacataataaacaagttttattttcctaaaggaaaaacacacatcattactggcatagccttcaccctggtatctgagcgcatgtccattgtacaacctatctgtgcctagctatcagagttgcctttctaaaatgtgttctccaggctcctctgaaaccctcagggtgtcctggaatttcaaagtcataacccagacccacccttccgcctatccccttatctccaaccacacccaacccaaccctctctgcttggcaggccagcatcctccttgtcctaggaccaggggagctccattcagctccttcgcagctactctcctctatacagagaaccccatactctttgtcctttcctctttatctctccagatgttatcctttgaagctcagctagtctgtggccagaccaccctgatcactc

SEQ ID NO: 34737 - DNA, 1027 bp, Homo sapiens
aggctggagtgcagtgtcacgatctcggccccctgcagccttcgcctcccgggttcaagcgattctcctgcctcagcctcccaaatagatgggattacaggcatgcaccaccatgccccactaattttttgtatttttagtagagacggggtttcactatgttcgccaggctggttttgagctcccgacctcaagtgatccaccggccttagtgctgggattacaggcatgagccactgcgcccggccccgtaattacatttgaagttacttcacatgcagcatcctctgtagttccaacaattgatactctctcataaatataaaatttgttccatatgtatttcaattcaaagagggtaactttcttagtaactttgcaggaaattcactgagcattttgagagctagagaagccatttccttatagctgtaaagtagaactaaatactgagtttctgataggattctctgcccccttcttccagctgcagaattgtgaacttgaaagcttaacaacatgtttgtcagagaacttgagttttgagataactttggtttggttttgaaaaaaaaaaaaaaaaaaaatatatatatatatatatatatgcatagaaaatattccttctgcagtcagtattttcagcagatgggaaagggcaggagtgacttgagcttccagccatttcaatctgggtaccttataacatggaagcttgtctggggatgaataaattatagcagttggaataattatgatagaggacaagcagcagccgagagtacaattgacaatggggccaagttggcctgattctgtcgtatcagagcatgcatctgtttgccaggttacctgaaaatgctgttttcgaggattctggtgtgttttgtttttcatcgccctcccttttaaaacactgtaagagccatcatctgctagtgaccttttagaaataaaatggctggggcagacgtccacatggctgccgcttcacatgttgggcatccgtgtaagatttaaattgagc

SEQ ID NO: 34738 - DNA, 1030 bp, Homo sapiens
agcagctggagcatctggcgggagcacctagcgggagcacttcacgggagtgcggccgggtggggcggggccacgcgcctccccagcagccaatgggcggccgcggcgggcggggcagggagggcgcagggaggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcaggtgcgttcagggggaacgggggtcgagcccaagctcgctcgcggggacagcgaggcgggcgcgggagacctgcgggacaaaggctgcgccctcccttccccgagtcagcgcttagcgagttgcctggtcctggacggctggaagggctgaagagggggctttctgccccgccggtgggaagaaggagtgaggcttgtatgaaatgggggggaggcgtccttggacccccaattcgccagtgcagcaggactgttcggggtgggctattcattgatggggtctgcacggggcatttctgccgtggacagcgttctatgattgaggcagtgactgccttcgcctcacgtgccccctggtgaggccacatttctgtcttcctgtctacattaggactgaaagatatttcagggttttggtaatccagtatttggattaaaagcaatatcctttcgtgtagaaaaactgtgcatttccaaatgattttagttacacgatttaggatattggtgtgacttccatgcgagaaaatatctcaaattccccaaatgtagaaacgcagccagctcttggcattgagaaagaagtagtgtttttgaaaagaaaggcgtgaagatttaaatattgcttacaacactctattagcttgtgggggaatctgtgccttttctattatctgtttccctataccaatattgtaaccaggcac

SEQ ID NO: 34739 - DNA, 1007 bp, Homo sapiens
gataatttcagaaaggaaaaaataagtacagataccaaatgtgtatgaaactcacatcaaaccggaaaagctgtattcctggtgtgctctgagacctgtggaaaaagcattttgggagcatcttggaatagtgtttgctacatgaatagatagatgttgttctctctgcttctagtgaacagagcagtggtagaaaagtttgctttttggttgggctgattgggactccactcacattttctcctagcagcacatcccaatgggaagtaggtttccaagcctttccatggtggagtttgtctccttaaagtggagctgaatcactgcattgccaagctgacttttagattctaggcataagggagagctggaagaattttcttccatccaagaaaagccatttaccctcttctgttgtttgactttaccgtcctctctcaccgcattatctcccatccaaatacccaagcctggctgagcatagtggcttatgcctgtaatcccagcactttgggaggccgaggcaggtggatcacctgagctcaggagtttgagaccagcctggccaacatggtgaaaccctgtctctactaaaaatacaaaaattagctgggtatgatggcacgcacctgtagtcccagctactcgagaggctgaggtaggagaatcacttgaacctgggaggcggagaggttgcagtgagctatcgtgccattgcactccagcctgggtgacaaagtgagactctatctcaaaaaaaaaaaaaaaaaagaacaaaacccaggcctatgtttcccaccaaattctccacctgtcttctctctccttcagtcaaaactgctgttctttcttggctaggatttagaaggtaggtggttgtgacttacactaatatgtgaatgactgacctttggaggagccataggtctaaggcagcatgctcagccttctgagtagctggtgaatctgtttcaccacaacagtgcacaagttctgttttctgccag

SEQ ID NO: 34740 - DNA, 1035 bp, Homo sapiens
cctcagaccactgaccttcatcaaactcattctcgcttccccactcgagccacacaaggggtcaggaaggtgtctaggctgctgttctggaccatcgtacccttaccaaagagatctctcagtgcggaggagtgaggagctttggcctcccctgaataagcgtgaggaagcaaagattccccagcaataaagtagatgctgaatccccagcaataaagtagatgccgaatgtcatctcagcccccactggagtgagactgcctttgtgcattctctccagcacatcagtggttcctataaatctcacaatgattgcttttctcaaggttgcttcgtggcaagtctgcaagtgcgctttctccaacagagggaggaggttaggaatagacttcgcaggcaggagctgacttgggaatggcccaggggagaacaagtaaagatgcatctgctttgaaagaatcctttcgttttcatttaaggacttgacatcagggaagttttatatcctgggaactcgcctggctccgtgttgtgtgtgaagaaggattgtgaggccgctgctcaactgcgttgcctctttctccttccttgtgtcaaataatgtagcttttattttgtatgattgcgtgtgcgctgggtgtttcccaactgcaggggatggggttagtattcctggccctgtgagcagagacagaggtgacccaggctgggaactgcccttcatgaagggaccagccattagtgggtggcgggcaggcaaggagatggatatcgtgggcgatatttcaattatggatcaacccttagtgcctggcacatggtaagcgctacatgggggttagccatgatcatgaccgtcctctttgtagaagggcctgtcagaggttaacatcaggggagcttttccagttatgtgtcttgctctgaaaaataggaagggggaaagttaagttaatggcagtagtgggcccagggcttcaaagggccatgcatcgtgttttctacctgagtgctcagtgtattgtagacagtctg

SEQ ID NO: 34741 - DNA, 1075 bp, Homo sapiens
tgtgccactgcaatccggcctgggctaaagagcgggactccgtctcaaaaaaaaaaaaagaaaaaaattgatggagaactgatggtttttcctacagaacaattagattaattcagatgctggctgggtgcagtggctcatgcctgtaatcccagcactttgggaggccgagcggggtggatcctttgagctcaggagttcaagaccagcctggccaacatagtgagcccccttctataaaaaaaaaaaaaaatacaaaatttagctggatgtggtagaatacacctggagtcccagctactcaggaggctgacgtgggaagacgacttgagcctgggaggcagaggttgcacagagccgagattgcgccactgcactccagcctggccaacagaaccagatcctatctcaaaaaataagtaaataaataattcagatgccaagccatttctagctaagccacaatactttgtcacttataggattcctatttaaaatctcatccaattgtgaggccctatagctaagtcacaaagatcaaggtctgagttctccctctgcttctgactcgtgcttataagaaaatcatttcagtagtcagccttccacattttcagactctaaactgacaccaagagtggcagctctcaacagcagtctgcagtagattcatctgttcactcggcatgtatgtattcaatagctagtacatacatagcagggtagtagatcagtcagactggggaaggaaacaaaataatgcagcagagacaatgctaatatcatttaagaatgacaattacagtgctgctggaattgaagaagtagcttgcaactgcactgcaagttggatttctgttgcttcatgttgaagcagttcggttagatgagttcactaagccctaacacataaataatttcacttagctttaggagaccctcagactaatgatcgcttcatgaaaggtgtatttagttgttgaatccacacattcctaccccagatctctagccagacatgcttagttccccctctgttgttggcaccaataggatatgtgtccctttcgatcca

SEQ ID NO: 34742 - DNA, 1024 bp, Homo sapiens
ggagaatcacttgaacccaggaggcagaggttgcagtgagctgagatcgcgccactgcactccagcctgggtgacagagcgagactccatctcgaaacaaaacaaaacaaaacatcttaacaagccaagagaaagcatacggaagaaaggaaaaacttttatgttttattattgtttgtagcgtcttccccctgctttttgaacggggcgggggcttgcattttcgttttgcatttttcatttacaagttatgcatctgatcttcggtgctaacaaccatggaattccaccttgtctacttcagcaccttcccctcccctccccttcaccctcctgtgccatggagagagaaagaatcttcccagattcttttttatttgttctgaatcccaaagcagatctgtgtctacaagtaacatcgcaaataggttttcttagtagcacttaagaggggaacaccatacaggttcaaaaccttgactcctttgccagaaactgccatattgccagttggttctgtaagtatcttagggcttgcagtgaaatctgtgctgcttctggtcaagtcagctttgttctgagcacagccagtaatatcatggccactctagagccagtggcattctgaacaagtccttgggctgcttctaacattgctggtctttaaagataaattttatggtaaggaacgcaggttgtgaacaatttgctttgctacttgatgttttacaaattctatcagcaaaggctggaagaggagcagtgaatatctctgtccaccactaagggctggggcagtgatgtatgtggagccagggtgtgaaattgacaagagggaaagcatggaatggagatggaattgtaataggaataggaggactggttccattaaatccaagtcagtgggttgggctttctctttttcccttccggctgtgttgcttactgaattctttatctgccacctttttattgccagcatgtctatttcaatgcctgttatgagtctgttcacgttagtaag

SEQ ID NO: 34743 - DNA, 1032 bp, Homo sapiens
ggggacagggggaaattcccagcataatttgagactagtggcacttttgcttctggcagatttaaatgaggaaagtgactgcatgcatgcacatccgtggccacagtcttcatcagcccctttgtttgatttctctatttctcacggtggctctgctcccgtgatgcctgcgcacgtgatgcagcgacacttgcacagagccaggcccactcgtgttctcctttgaattgccggaaagcactccggttgcttttgtatggccacataggaaacagcctaatccttagaataaaattgatccctgggtttagagctcaagtttttaaagtttttcttcctacatacattgattcagctgcctgtgattcccttattacccctccatctcggtggatgtctcattctacttcctctcccctctgttctctcttctctagcactgttacccatttcctagtcaactcaaggccaaaaatgagatttttaaaagccagcagatattcagtaaactgataagatatgtagaaaggccagatatgatgggaattgtctagtagacgtattttatttggccatcgcagtgtttaaaggattattttctggaattgggatgactggactttgcaggtgcttgcccattttccagtcacccacctttgttgtctctcacactctgcttcacatgtttacatcactggcctgtctgtagagtcagtctggtccattgttgacttccgaggcttttccaatctgctttccttgggaatgttttttttttttttttttttttggagatagagtctcactctgtcgcccaggctggagcgcaacggtgtgatctcagctcactgcaacctccgcctcctgggttgaagcgtttctcctgcctccacctcccgagtaactgggactgcaggtgtgcgccaccatgcccagctaattttgcatttttagtagagacaggctttcaccacattggtcaggctggtctcaaactcctgacctcaggtgatccacccacctcggcctccc

SEQ ID NO: 34744 - DNA, 1073 bp, Homo sapiens
ctcggcatacttcctgcctttccttgtggaacttctcagtatgaaaaataaacaaaatctcactcaagatttcttggtctccagcccagtactcttcctaatttattgtattatatttttttttatccatgaggacgttcacatatgccatcaagggatagataaatgttagtaagtcttgggagtcatgaagttgctctgttctgtgaaatcgcatagaactgatttctttagaatttctcttttgctaagtgccaagttccagttcccatcattgaaagacctaattgatttgctcatttcttccttctttatttattctttctttccctccctctctccctccctcccatctctccatccatccaattttgattgaatacctgccatgctggatgtcgaatatgatggtgaataagacagttatggtatctgcctaccctcacaaggcttaaatcccttaaaccaatgtgagataatatgaagggattctataaatgattgtagacctattaataataccgtaggtgtgcccactttgcatctgtcaccagcaccattgttaccacctatttctagcaacagaataaacctcctctttttatttcaacaaaatctcagcgtaagcttagtaaaactagggtgggtttaattgaagataaacagtctgattcgtgccattcagcataaagttcctctcatgatacctctaggtacctccttatcagcccaacttgaaagccaccaaccttggcctctgccgttggtctgacatggtgtcatattttgataatgtatgtagctattcttcatacacgctaatgtctcagtggtaaagacaactaggctaaatgtgtaaattcaggcctccagtcctcataaaccacagaaatggtaactggcagcttctttgtatcttttcagtgtctagttccagagctcgctgtctgtgagccactagaatgggacgagggaacccacttgctagggttttctccaactttatcccaaaacctatgtatctaaccttatgtgtcccagttgagatgccgaaaacaaaataatagcagaag

SEQ ID NO: 34745 - DNA, 1064 bp, Homo sapiens
taaaaaaatactattttaatttcagtgtttctggtaagaaatctgcctttactaatgactgaaatggacctggtttttgttttcccctttattacagtttgtggattagtcggtgtattgaacatgaaattcaatataactaaagtgggttttaaaagataatgaaatcaatactaacgtgaaaagacttgtcttcatcagagccaccccacaattggccctgtgctctctgttgctgcatacttaggtcctacagttcttcatgtaaccgcctgaaaagctctacttttctactaagaataaataatcctgctgaaatggaccataggtaactcaattaaacatagcttcctaccactgggttgtttaattatttttcaataattaaatagatagattgaaattttattaatttattaactgcatttttttttaagaaaagacatactcattgaagacaaagttaggaaacatagataaacgtaaaatttaaagtcatctggggctggacacagtggctcacgcctgtaatcccaacacgttggaggctgaggcaagaggatcatgtgaacccagaagtctgagaccagcctgggcaatatggtgaaaccccatctctacaaaaaaaaaaattagctgggtgtggtggtgccttgtagttctaactacttgagaggttgagatgagagaatcacttgagccacgaggttgaggctgcagtgagccatgatcacaccactgcactacagcctgggcaagagagtgagaccctgtctcaaaaaaaaaatcatctgtaactacaacagagatcaaaactgttatgtaaatgctaaatacggtgttcaccaagagggtgtgatttaaaaaaatatctagtaccacgtatttttaaaattaatttcatgtactccccacaacatgagaactggggtatgtcagcctctttatgcaaactattctttaccaaaaaataaataaataaataagaataagcaatgcactgaattcccagctttgtctgggcagtttttctttgcccctttgctacttgttagctgttactc

SEQ ID NO: 34746 - DNA, 1050 bp, Homo sapiens
aggttgattccatgtctttgctgttgtgaatagcgctgcagtgaacattcatgtccatgtgtgtttatgatttatattcctctgagtatatacccagtaacaggattactgggtcgaatggtagttctgcttttaactttttgagaaatcgccacactgctttccacaacagttgaactaattcacactcccaccgacagcatataagtgttcccttttctccgcaatctcaccagcatctattattttttgactttttagtaatagccattctgatttgatttgcatattctttaatgatcagcggtattgagctttttttcatatgcttcttggccaaatgtatgtcttcttttcagaagtgtctgttcatgtcctttgctcactttttaatgggtttgtttttctcctgtaaatttgtttaattaagttccttatagggttgtgggagtgaaggaggaccggagagatcatggtgaaactggaggatttttattgagtgcactcagacccagcggattaacatccaaaaactgggcctggaacaaagacagcacttgaattttagacacatttctaaaagggggtgggctagcctgaaacaagtttacagtggcgcgaatcgtagtggcgtgaaagcaaggatacagaggcagaacaaagggagttaattaaattgtgacaggttcataactcaggattacaggtgactcttcctgtgcagtccagatggctgttatggaggcttgctctagtgccttgcacaggcttatctcttaaccttcactatggcgcccagatggctgcagcccaggcctgctcaggcatgtcttataatcttcactgtgctgcttagataaaaacagaatactcaagttaccggaaaacaggaatctgtaaactcataagttttactcataggggaaaggaaaatttgttttcttctccctatgttgaaggagggctgggagagtctccagggcacattcctttgagctctggcttcttagataatattattgagacttcacctgggtccaggctttgcct

SEQ ID NO: 34747 - DNA, 1044 bp, Homo sapiens
atgtcaatgggctcgttccctgtcctctgaaagcctatttcctcatctttaaaggagagttaataataggttctgacagggccctggacagaccagttaagagaaggggtgaaatatgagagatggagaaatgatagatctgggactgcaggctgctgctagctgttgtttagccctgagagtgtgctgggaactgtactaagaactttgcctgttttattttatttaatcttatatctgctttcagcagtggatgttattaccccattttcaagattttgaaactgagcccctggcaggtaaaataacttgtccaatgtcacacagccaaggagtggcattgtcactacttgaacccaccactgtaactgtcatgtttatgctcttaaccattttgccacatttataagtgatcttttctgtttcactcctttaatatcctccttgcatcctgtgttgtttttaacttgaattgatcatatttatgtaacattttatttaatttgctatactataagatcccgagggctggggtcaggtctcatgaatttttttgtctttcgtagcaccttgcttaataaaatatggcagataacactcaataaaatgtggttgacagaggctgggtgcggtggctcatccctataatcccagcactttgggaggccaaagcaggcaggtcacttgaggttaggagttcgagtccagcctagccaacatagcgaaaccccgtctctactaaaaatacaaaaattagctgggcgaggtggcatgtgcctgtaatcccagctactcgggatgctgaggcaggagaatcgcttgaacccgggagacagaggttgtggtgagccaagatcgcaccactgctctccagcctgggtgacaaagggagactccctcttaaaaaaagtggctgatagaattaataatctctaagattccttctgtcttctaaagttaaataatttttcattctataggtaaagcttcagttgcagttatacagttaaagtccagtagaacttaaaaagggcttcttggatg

SEQ ID NO: 34748 - DNA, 1234 bp, Homo sapiens
actgagaaccattaattgcttcagaaaagaaatagaattggatttcttttttttttaagaaatggactaaatgctctaacactgaagaactatattcctatgtgcgtcagtttcttttcaaccattagctcctttatgatctctttatacagggtgggtatagcccacaagtaactatggttactagtttttataggttgtgaccagtctgctgtataaggtgttaacattttgcccaatctgccttatctccatctcttctgtttttttgtgtctgtgtctctttacacgcacacacttaaaacatgtttgctgaaccatctgagttagttgtagagattatgaccttttcaacatgtatttctcaagcacaaggatattttcccacatagcctataataagatgatcaccaataaatattatctgatatataaataatacttgaatacatgttcagatttcacctgttaccctaatactgtcttttatacccgcctcccaatccaggatgagtcaacagtcattcattgaattttgtctttttagtttcctttaatctaaaacagtcaccctgtttttgttttgtttttgtggttcatggcattggtgtcttgaaagatacctttgttttgtagaatgtatcacaatctggttttgtgtgattgttaccttatgattagatacagattaagcatgtttggcaaaaatgctacatagtgactgtggcgatacctactgttccattgtcctggaattgattatgccgagcaccacttggttgagctggtctgccagaactctccgtttgtaaagatgccttttctcttaggtaatctgtggggtgatattctgagactgtgtgtgagtgttctgtcctacaacaaccctttctagaatggttttagcatgtattaatgattgttgactgaatcagtgattgcattggtagttgcaaagtgggattttcttctgctctccctttgatatttattagctggcatcctttataaagaagagtttcccccattattttttcaatgaatatttgtgggtttatggtttcttttttaatccaatgtattatagttcatcaacatcattcttttttttgagaaagggtctcactgtgttgcccagactggagtgcagcggtgtgatctcagctcactgtaacctccgtctcccaggttcaagagattctcccacctcagtctctcaagtagctgggactac

SEQ ID NO: 34749 - DNA, 1015 bp, Homo sapiens
cccaaagtactgggattacaggcgtgagctaccgcacctggcctgtcatgacattttaaccctcaatactttagcatccatctccaaaaaaataaggaagcttcataataaaagtacaccaccattatcataccaaacaaaattaacagtagtccccaaatattacttaatattagtccataatcaaactttctaaattcatttcccagacctttagtgttttaacaaaattttaaaccagaatccaggcaaaaggctgtgtattgtattaaatacacaatcatgtcatctgcaaacagagacaatttgacttcctctctttttatttgaatactctttatttctttctcttgcctgattgccctggccagaactttcaatactatgttgactagatgagtgacaatttagtcaaattgtccctgtttgcagatgacgtgattttgtattgcattgttatgcctcttacctctctttaaatctaaaattccagctatgatattgagatttttaggatttggaacattgaaaagattatggagctttcccccaactcagatatccctatctaacaccaaaataattcaaaaaagaaacaatactgaatttcaaagtaaatgtaaggaagtccatataaattcagatattttttctctcatcaggttggtgcctttgatactagttttgcaatttcaggtaatcacatttttaaactcagcatatgcttgctttccttcagttaaataacccagccctggactcacagaattcaatagacatacagtggctcgttgttttctgttgagctgaatatctggtatgtctaaccttcacagatatgaaaccacattgtttttttttttgagacagagtctcgctctgtcgcccaggttggagtgccattgtgcaatctcggctcactgcaacctccgcctcctggattcaagcagttcttctgcctcagcctcctgagtagctgggattacaggtgcatgccaccacacccggctaattt

SEQ ID NO: 34750 - DNA, 1028 bp, Homo sapiens
tatttcctaaatgtaatttgaaggacaatgaattcaatcttgctgaagtgtgtttgaaggtgtacctttatgcttagtttgtttgctttcaaaggagctttggactgaattgtatttgcttttcagactgcagggctggaggtggccatggaagcctccagaatctgattgctaatcaggaaagctgtttgctaagaaaggcctgcctgtttggacttgaagtaatgactgatgcacagataaagccagggtgactttttaaatatcttttgacttctgtgtccagattttgcttttctcttaattaaaacccttagacaaaggtcacaggtcaaaggagatgattcctctaaactcttctggtagcaatagctgcttaactcttcaactcttgataggcttgtctggaaactgttgtgttcatttttctatgacgtgatttacctcctttggcttagtttgagtgctgaaatgtagtaatagatacgaagatggaaatttttttttacaatgtagataatggtagtctggagaagaaaggcattgtgctaacctttatccatatttcatatggaatacttgaagttttatttttactttttatttatttatttatttatttatttttgagacagagtcttgctctgtcgcccaagctggagtgcagtggtgcagtcttgactcactgcaacctccgcctcctgggttcaagtgattctcctgcctcagcctcctgagtagctgggactacaggtgtgtgccaccatgcctggctaatttttgtatttttagtagagacagggttttgccatgttgcccaggctggtcttgaactcctggcctcaggtgatccacccgccttggcctcccaaagtgctgggattacagacgtgatccactgtgcccggccgaagttttatttttaaaaatcagtaaacagtgttatttttctaatttcataagaattttagaaacgtattttcctaaaatggtttgttaaatacctcatccgactcagtaatgtttat

SEQ ID NO: 34751 - DNA, 1028 bp, Homo sapiens
ttccataggattgtatagactctgcatttttttgagtgaaacagttgttgacatagtgtaagggttgacacattgtatttttgaacttcttggaatctgcttaatggcaaacaggttgctgagaaccgaaggtcttagctgcaaagtgagcatacatacacagccctgcaaagctaggtgcataccagacaagtgaataacatactaattattatcctaccttggtagtaatagaattgtagcttcaggcactatgtaagacctagctttttgagctggcaaaatagtgattactatttttagttcaatttctgctctttaaaaaaacatagtatactacttgctactcctggatggttttatgtattttaattaatgttatcttattgcatttgtaccctgaggctgctttagtgaaagatataatttcagaaggctgatgaaattagataggtctgactaggaagactctgttattcatatttatggttataaaatatttcgggtacatctgtgtaagacattcttgtgctataaacatacagacactgttgtgaatcaatttgccttagagtgtggtagagtagttacagaccagtatagtagctctagtgtgggggtgatttgttgtttttgttgggggtgtttttggtattaaacatgactttacatttttcacttgaaatctcatcgtgcagtgctgtgtaaagaaatgaaagtgattctaaaccaaacacacacaacactcctcagctctattactttatagtcaggcttaacacattctgatggaattggcatgaagtacgtgaccaggtagaaatcagctttatttggtctaaatgactagccggttatagggcatggaaaatctattttaaatcactttccagagccaaatgcaattaagatgttgcaataaagtgaaggccaattctctgagaaagaaagaaatactattttgaatgaaaaaaatactattttatttgacatagtcaataaagaagaaaagctataataaactattt

SEQ ID NO: 34752 - DNA, 1044 bp, Homo sapiens
gtcaccaaggctagagtgcggtgacatgatcttacctcactgtggccatccatcctcagacgattctcccacgtagcggggactacaggcgcctgccaccatgcccggctaatttttgtatttttggtagagacagggttttgccatcttgcccaagctggtctcaaactcctgggctcaagcagtccacctgccgtggcctcccaaagtgctgggattacaggcatgagccactgtgaccggccccagatgtgtatatttattttatctatactgatatctgtatatctgtatctataaatgatctctcttcttttcttttttgagagagagtttcgctctgttgcccaggctggagtgcagtggcacaatcatggctcattgcagccttgaactcctgggttcaagcagtcttcctgcctcagcccccggagtaactgggaagacaggcacacaccatcacatccagctaattaaaacaattttttttttttttgtagagatgcagtctcactgtgttgcccagaatggtttcaaactcctcaaagattgggctcaaagttcgggctcaagtgatcctcccgccttggcctcccgaagttcttggattacaagcttgagccactgcctggcctcaatttcactcttaacaaaatatttcaaatatacaaataatctaaaaagtggggactaatgttctagatactgatattcctaccacacccatcagaaaagaaatgcgaacactgttctagatgttttcagatttatctttacttctccattattgcagttatttttactatttttacttgtgccattcaacatacaccctcttacaactacttgctagtgtgagtgcatgggtgtgttttctctctctctctccctctctctctctacccagactcttctaccctgcctagggctatcctgtgtttttcagacagttgctgtaacagcagcagtggtggttctgtatccaactgggtcctgggagacctgcagaagtaataatgcagaaaacagcagcctccgcaagga

SEQ ID NO: 34753 - DNA, 1031 bp, Homo sapiens
tatgattttccttagctctgtctattttgggaatggtgagaaaatgggaagcgggtcaggggagatgttgcattacttcctgattgccatagctcccttctctgtaaaatcccgtgaaggattgagaggcaggtggtagtgcttgcttagtaactcttccctttacacccaccagctccactcccaagttgggtgcctactacttccaaaataccccgtaattgggtcacaacattatctgcctgcttggaatcatatttaaaaatcaaagcaaagatgcagactatgtcagcaggatttgaaatgtttccatcctctgctttgaggctttgcagaattattctgaaaacaaaagaaggtaaacttgttatcccaatgaggtggcagtttctatgtggcctagaattatgcctaatttttgcttgtaaaagggctcaaaccatgatcctttctgactttccacagggatgtgagcttttgtggacatcactcaacagatcagatttactgttgaattttcataacataattgacttggaaagcatttcattcagtgttttgaatggtgactagagagaaattaagaagctcagttgttatatctttcgaattcctttcccatgacacagtcatctctcccctgaatgagagcagtggcctcctggcttatccagctctgttcactcagtttggcttcccaagtgctgggcactgttccagatgccacacgtggacactgaccaggatggccactgcctctacctgctcggagctctgggtctatagagaaaggctgacagctaaggaatgaatgacggtactatgtgatacgtattactgggagaaatactcagtgcttcccagacgagcacttatcctgcttgggtgtggggagtgtgtggggcaaagcttccaggagaagggatgctaagtctattccacagtgcacctggacctctatcttatggttccttaaggcaccctgactctagctcccgcatggagcctgctgtttctgaatgcgtgcctcc

SEQ ID NO: 34754 - DNA, 1025 bp, Homo sapiens
cgcattttgtgtgtgggggcgtggttgtgatgttttagtctgtttttctaagatgggagaaataacagcatgtttacaaaaatttaggaattctgtaaatatcttatacattatgaaacttaggaagcttaaggaaacctggaaaagcaaacacaaattaattatgggcatttcccaggatacctcccattaagtggactcaaattagggtcccagcatcttctatacttgaaatcactggcccatgatggataaacaattgcttggttctgatcaaggcaggccttattgacctcaggaaggacaagataccacagccatgagtaattctgtcctggttattggatgaggggattatcaggacgggacatcccccaccttgaccatcaggaatgattatctggttgacaacactgccatcatcttccttcttctaagaagggcctcacgggcatctagtatatcatagcttgtatatagtaaatattcaataattgacatgggctgtcaatccatatagaaaatgtcataaggaaattggatcagtttgagtaattccttggaacttcaagcagtgatgatattagaccatctatcatccaatcccttaatgctcttttaacctcaacatgatctgccatagttccaggagtaatctagaagtcatcttataaaatctcttttaaataggatttaacaaaatataaataatcatacattacaggaggatttctttaaattgtgaactcttctagtgcatctaaaaatagatttagaaatatttaatttatagatttagaaatatttaatttacacaatgtccaggaacttatttttctttcttttttttttttttttgagacggagcctcgctctgtcacccaggctggagtgcagtggcgcaatctcggctcactgcaacctccgcctgctgggttcaagcgattctcctgcctcagcctcctgagtagctgggactgcaggcacgtgccaccacgcccggctaattttttgtgtttttacca

SEQ ID NO: 34755 - DNA, 1057 bp, Homo sapiens
ctaaatgacctcagaccatggcagataggttttaaaaagagaaatgtgagaggtgtatatgtttcgggggatcatggtacaaatcatctctgaagagttatgctaccaggatgtttcagaggggtcagagccagaaagaaccattgacttcttggatttggcaaaatcctaggaaatacataatggatttgccacttttggagttttctctaacttgttaactcccttggaaagggcctaaatctttaaagataaaatagcctttttacacaaagaaaaatgaaagattccattcacagcaacaagaagaaaccttaccagttatgtgaatggttagtaggagaaaaactagaaaatttgacaaaaatgagagaaatattttaaaagttgaataaataaacataccattctctgaatagaaggatcattaaattgtaagttcttcccaatttgtgagccatttgggggaacaaaaaaaaatacaccttctcctcttgattgtaatctagtctaggaaaataattataaatgcagagaaagagattagagtctgactgaaaatagaggcattattatactattttgagtgcttctcatatcagtaaaaattaaagttttttcctctttaaattttataataaaaatttttcaataacttagtaacttagtcgttaaatcaataatatatttcaacaaatatatgtcaaagcgctattctagtttctgggaatacaaccatgaaagaaaatctctgcctttgggaggttataatctagagaagaaaaacatacaaacataagtctattatacagcaggctggactgtgttaaatgctctggaggacttgagtgcaggggagaggatggggtggggtggggtgctgttttcaatggggtggtcacacaaggcctcactgtacctgaagtgttgtgaccaggacctgtggctatctggaagaaaattccagatggaaatagacaaatgctgagagcctgaagactgcagggtggtggaagctgaatgagggagggggtgactagtaaaagcactattattc

SEQ ID NO: 34756 - DNA, 1025 bp, Homo sapiens
ttcacagggcagtgagagttactgcatagaaaataagaaaaataatgaataacatgtgcagaaactacagccaaaataatatctgaaaagcatattgcactcagtgcacgtctaggttgtatcagaaaggaccaccctctgtttgtggagccacagggaagagaaagggacgtttacagtacacattggatacgtagtctttttccatggagtctcttctaccaaagaagaaaaagcaacggtggaacagaagataactgtgaataatttaaatcctggatgcagacccacaaatggttaaaataaaacaatctcagggaagaaaacagtgcctttatgatgtttcagaattatacgttgagtcactattggcatttgtttaggttttagatattctcagccatggatatgtgattttttttatagacataggaagaattaagttgttgtgtggtaaggtagttctagactcatggaaattgtatgaatctagaagcaagtgtactgacaatcaagaaagtaaataaactctgagtagagtaatcttttaacaggtggagacacagcagtagaaaataatatattctggagaattttgagtgtgaagttaaaatttattatgtgctatttctgttacctgaagtgaactctcctctcctttcaaaggccaagtcaaattctaacttatcaagggaggcctcttaaagcccatgttgatttctgaaattatcaaagaggggcaatcatatcaaagctttatgctacattcatttttaatgtcttataattttgttttgctatattgtaacccccttgtagcaaggaaccattttttaaatggatgctataaaaatagtggatcttttttactgacttcagcttgacaaacctgaatccctttcagccacattccttccctacagccttctgccaggtactcacagcacactatgctcacacccagaggctcttgggtgtgtacatgctcttcggcttccatgaattgacttggtgcattgtaagtg

SEQ ID NO: 34757 - DNA, 1031 bp, Homo sapiens
aggtaaacttacacctgagccagcaattgtgctcatagttatatagcagaaatggaagtttctgtttctaaaaagacttggaacaaaatgctcctatcagctttattcagagtagccaaaaactagaaaccaaaccaaatgcccatcaatagaagaatggataaacaaattgtgatacagtctcacaatggaacatctaaacaataaaaaagaatgagttattgattcatcaacagcatggatgaaaaatgaatcaaaacatgaatcaaaaacattatgccgagcaaaaaaaaaaaaaaaagccagacacaaaggagtgcatcctttttaatttcatttttatgcagctcaagatcaggaaaaagtgatttatggtgatagaattcagaacagtggttgcctcagggcagggaagaggttgattggaaaagggcacaaggggatttataggatgggaatattttatatcttgattggggtgctaattaccacactgcacaattttcatttgactctgtgttaaaggtctgtgcattttattatatataaattgtctcatttaaaaattattatttagtttctgtgtagtattgccttctattttacctgtacagtattcatagctgaacatcgttgtatttggtaattatttttttgttttttaaattttgtgtttcccaacaccaattattttttttagagatggggtcttgctctgtcacccaggctggagtgcagtggtgcagtcatagctaaccatagccttgaacccctgggctcaagtgaccctcctgcctcagcctctaaaatagttgggattatagataggcatgtgccaccgcacctgatattttttttaatttatttttttaatagagatggggtcttgctatattgccaaggctggtcttgaactcctgagctcctttgattctcccacctcagcctcccaaagcactgggattacaggcatggccaccagacctggccactttttccatcattttctaaagataaatctcttacctgtt

SEQ ID NO: 34758 - DNA, 1025 bp, Homo sapiens
ttaagaagtgcaccatagcgggagttgcttatgggtgagttttttcctttaattaggatatgaaatacatgcttaattagtgctaacagtttggtacatttgggagttcttattaggggagggtatggggttgtttggttttttttagtctgaaaagcagctgttataattttaggacacatgtatatttcgcgtttctagtttagcattgttttcatttgggatgacatgaggtgggtgctctgcccaatggtattttcagtgtttagtgttgctgaaagtctctctcttgccctggtaataaggaacaaatatatttccttttacactactataaactggagtatagcttggatctggtaaggacagataatcaggccttgagcagttttcaagttaaaatagtgacagttaccccttttgatactttttttttcttctatcatctctcctttttgcagtcatagagcaatctaaaattctgatgatggaaaggaggtagagacatgaaactcttgaatctggaggataattaatatcatcagaaacttttatcaggctgttaatttctttagaattgcttgttgagcacccatttaatttatttcttacttccaggtatgcttacaagctgttccatagccttctctttaaaatattttatagggtaatgtgagaaaattaatttctacatttcctagaaaagacatcaaaaggtgaaacactctcctggctggttgacattggcctattgtcaaacttgccaattatccttatctacctagaagtgagactagtaaatatcagcctcctactcatacaagcatggacacttgcttctaggttttctggcttgcacccactcttccccactcactctgagcagtaagccagtgacaaagagtgttacattttgaaatgccttagttaaaattataaataagtaaacatttcatgaaaaatcccaaaagtatatggttattcctagatatccttgttctttgcgttacgagagcatgactaaa

SEQ ID NO: 34759 - DNA, 2003 bp, Homo sapiens
ggcagggactagtatactttttttttcaagaccctatcacaaccctaaaaaataattttcattattattttcttccttttttggtacaagtggacatacagtagatggcatgaggttgagaaatttgagaaagaaaaatctagactataatgtagttctctataaaatatgctttaatttgataagcttatgagtaaacttttaaaaattaagttttcacactaaaactttaaattgggctaaaaagcaaataaataaccctcaaatattaaatgttttcttatgccttcagacctgatcaaaataagttttgaaaaaaattggcattagatgtttttattaacatgtattattttctataataatttcgaactttctgtctcttttgtccatttgtttgttttttttcctctgttcatttttttttttggccattttaattattttatactgggacgtgtaggtggcagtaggggagatagtgaaagtgaccaatggggaacatctcccagcagatctcatcagtctgtcctcaaggttagaaccactgagtcgtataggatgcgtgtatgtgggtcctcaccgtaaaccggagaacagttgcacccaaatatggttgagttctgtgtctcttcctttaaaacacaaactttttatactgcttggtgatggacatttcacagatgttttaaagggatttttgaatactatgttgactgatgcttgtccttcagctgggcaaattgaactcctgttgttatcaataggagtctaagaggcatgacagtaaaggtagattttaatttcctgtgcaccattaatatatattcgtatttaataacatgcctaagtactaaggcttaatttattatctctccgggatattattttgaataatgttaagcttttcatgaaacagtcattgaaaattgattagattataaacatgtcttattcttgtattttaaatttttctgtaagttctgtaaaatccttccagcgattgtgactataatttgggctcatagggtttatagaggaccccctgcacaaagctggatgttgcacattttgtaccgcatgctttgggatcgacttttatcccacttgtatctagtgacaaagtgcacgttactgtgatcaatttcagctgtctactagtgactgtattgtgatatgcatcttgtttcatttttcacttactaatcaaaaagcctgctttgcctctcttgactagtttgtgttttagatgtcatcataatttgctgaaatatttatgatctagcatgattccttatctgagacttcttgctgccttttcacagcactattaagaattgcttcagtaactgctgtcctaagtgattgttgagaatgttctgaatttcgatgcttattttattaccccaacttcaaatagaacttagccatttgaacttcctaacttcctagccatttaaagacctagataagttactttatgcaaaaaaaaaaagtagaattagaatattattctaattgtcagaatatggaatcaacattgtcatttagtattttctttgtcatcgtgcttctatattatcaggtgtgttttataaattcataaactatgtttcaaatgtatacataagtaaattacaaatttcgagcaatttccagagccaaattgctattgtgacagtgattttaaaaataaaattttgaataagttatagagtgaaaatataaatattgaaggacttaattttggggaaaagtagcagcttttacgaaagaaagctcatagggtaaattgaagaacctgcagagctactttaaaatgaatcagtaaaatatttttgattaatgtctatgtgtttaagcaattttcacaaatcttcgggccacaaaattaagctacatgcccatttctgaaactaggaatagtctgttttgcacatgtacaagttggaagttgattagaaaattccaggtgtttgtaatttgtaaatttttttctttct

SEQ ID NO: 34760 - DNA, 1051 bp, Homo sapiens
aaagtattgttttcccaattaaactcttagagacataattatagaatgaatcatataggctgaaccgttaaatacaatttttatttttgatgctcaaaaatgtgaagataatcgactatactgccctgaatttgtatttaattttaagttggaaattttcaaaatctttgccgtctgactctatccaacttcagaaactccccagcaagctacttgtatttcttaaactttagaccacttttacagaatttgttttataagcattaaaaacacttactggtggctatgaatttcaatttatcgaaatagtttctgtgtcttaatatggtctccacagcgattaacttcctccaagattatatttttaaaagattatctgattcattgctttttgttattgagtagaattcaaaataaaagctgtgctgctagacatttcaatccaagtagcagagtaccacctttcagtattttttttcctcaaagggttttagcattacttagctcctttgaatctacattaacctcatgaaataggtagtagttgtttaatcatttaactgaaagagaaattttgactttaggtaatgactaagtcagggttggaatactcctaatttactatcttcacactgtccactatcaaaagaagtacatgatgatttttacccgcaagtgagcaaccacttagcagtaagagtaaacaactgtttataatattttaattttcaatttttttaatttttaattactaagagtacatcttctgtgaggtagtttgaaattaaagcatgaacatggttgaaagttactgtgtttcgtaggctttcattttgaaatgaaacagattttagcatttaataaataatgaatacatttatgtgttaagaaagtataaagtagggtaaaataactcaagctgttaattcaagtccatattctccgcatgtctatttcataccctctctgaaaaaatttctctggattcaaaggcttacccttccaaaacaatgcattctctagacttcattaattgctaagtaactcaaaa

SEQ ID NO: 34761 - DNA, 1021 bp, Homo sapiens
cagaaggctgtaggtagtggactgaaagccctaaacatttccttaactttggcattttggggactaaaattgctttatcatgacattcctccaattagaatatgtatgattaaagcatttttgtcatcttgactttttcttctcttggttcctcttatgcacacactaggctggaaggggaatgccgtattaggagctcagaatccaaaaggaaagacaggtgtttggatgtcttttgagaaattgatcttaaacatagacattctaaggagttaagttccctactttccttacagtaaagaactttagcagtcattgatttagcatgctttagtaagaacttcagcatttagtaagcccctggttttcccaggccactggggtaccatataaattgttactattttattgagtttaggaaccacaagcccttcttttgtcttacaatgagtaaagatgttggaaagcagcacaatcaattagggatttgtttaagtctgactgttagactctaacacgatagtgtagaggacgtgattctgattttgtgaagcacacagttgaatttaagaggaaacattaacatacaggagttgattaaagaaaattaaatggtaacctggatgcattctaagtgccatgatttcagagaatttacattttattatctttctcagtgagtgtaatcacagtaccatcacagcacattattttaaggaccagtttacatttatacttgcagtttttaatttttcctctttgcccttttttgaggtagggggtgtttgattccaagatccctggtaatttgccagtttcagctagtccaactttcagatttcagctgaattattttttgaatcaagggacccagaacttaagcatacgtgtcataaataaaaagacaatacccctgccccaaccttttctaacctcttcttttggtaaataatagactgcagtgggctgcctctgcagtaatttcttattatgattcccacaaaagacactattctgttct

SEQ ID NO: 34762 - DNA, 1050 bp, Homo sapiens
tcaattttattaattttatgacagcttagcatttttatgttagtacagaataacttactaaagaaccctgtgggtggacatttaggtcatttcagttttttaaactcttgaataagcatctttgtatctttttgtacacctttctgatggttttgttcaaagtccctagaaatgggatttctgggtcaaaagtatatatctttttatgacttttgatacatatttgaaaattgctagaaagattatactggtttacactcccactgaaagtgaatgagagtgcctgtttatcccttttgcagcactgtatagcatttttcttcctccttatggatatagaatgtaaaaagtaagtctttaagtttacattgctttattaggtttaacatattttggtaaatgtagtgattatttttttctgaattgtttatcaagttttgtattgaagtttaagaacttatatgttaacgataataccttttttccttattcatagtttatcttaactttgtagtgctttaacatgtatgtaaattaatttttatgaagtataatctttcctttttttaaatttctgctttaatgtcatatttttcaagataatttttcaattatatttttcttttagtacttttgggtttcattttaaacagttatattagtaattcctgtgtgatttactttgtggtgaaatgtgaggcctggatctaagtttttcctcaaattatttacctgacataataaccatatatttaataatcctttcttcccacactgatttgaggtgcttccgtatgtatatatttgagtttttttctggagtcagtctctctttcccttccccccaccccacccgccgccacctctctttattttggtcccttttagcccctggtatcaaattcctttattgcaacataacaaaaaatattctcttagctgtcccatttgctttgctcttttctctaggtttttctgggttttctttcccccacagttgtatttttctactagaatttatgagtacatcattgaatcaagttaaaaaac

SEQ ID NO: 34763 - DNA, 1050 bp, Homo sapiens
aaagttgattatttttctcccgagttactacttatttttacaattacaatgtgaaaattttctctgcagccacatggctgaatgacttttgaattagtgaggaataagcaaaagcagaggataactttttaaaacatcaagattctgatttaatgtagctagttccagtaataaagcagacaaaatgacaaaaatcttggagtgcaaaaagtttagaggctgtgctatgacaccgattgttgtttaatggcattgaacttttatatctggcataattctgtctttgaacttatatttttttgtattgctatggctttggctttccctgccacctttttcagctttgtgtgggtcaatctttatgcaggtaatgaagctgaaaaactgagtggctacaagctttatttgacaaggttctttctcttgtagcttaggatgctaggacttgcaatttgtgtgtgtgtgtgtgtgtgtgtgtataccttagttaagaaaaagcctctttggaaaaaagaaatatgtataaaaccagtatttaattattatctatttgactgtcataaattattagctggaatttgtttaaaaatgtgaaaatgattgtctgcttgtcatttaaaagtcaccctttttatagttaataagtttttaaattttttatttttttgagacagagttttgctctgtcacccaggctggagtgcagtggtgtgactcggctcactgcaacctccgcctcccaggttcaagtcattctcctgcctcggcctcccgagtagctgggattacaggcacctgccaccacgcccagctaatttttgtatttttagtagagatggggtttcaccgtgttggacaggctggtcttgaactcctgacctcaggtgatccacctgcctaggactcccaaagtgctgggattacaggcgtgagctgccatacctgtccataattttatatatagttaattgataatctatatctttaaatgttctcattacaaaaaataagattaaataactctttaaaatcataaaagtagtacattta

SEQ ID NO: 34764 - DNA, 1032 bp, Homo sapiens
aaaaccacagtgtgatatccacagcctaaaattcacagcctaaaaacattctcagcaatagatttttatatagaaacactgatgcaatggaaagaaaaaaagattttaagctagttttgctatatttaaagctacataacatacttaagcaataaaacaatgccagaaactatttataacccaaaacttcttatttccccagtcaaaaacaatcaaacatatgtaataataaaatttgaaatacatctttttaatataaatatttgtctttaatagatagtaagcaattaatttgtcagttttgttaattgctgtgatttatcactgtttttcgttccacaatatgtatatgtatgtgtgtgtatacacacacacaaataaaacaagctcatgtaagtcataaagatcattacatcatttgatacattttacatcatttgataaatatatttaaaatagtcctgaaaatcaattctgccacatgaatttgagagtatatgtcttattagtcccatttttgaatgtctgctgtgaacataatactgtatatttcatttatcatttaatcaatttattagttaatcagaatagaaataaatttatatgtatatcttatttttaataaaatgctaatagtaaatgactatgaaaagagaatctattgataggggttttcctatgttatatgatattttcaagtatattacgctgataaaatattaagaaagcctcttacacagagatttcattctaaatagatacacattaattttgacaaggtaaaaaaagtgaggttaaaaaaagttgtcttgtttgagtattcattaattcaacaaacctttattgaacatttattgcatctcaggaactgtgctaggtgctatgaagaatgtaagaatgcagttaaatgctcaagtgaatcaccagaatagaatataagccttctatataattatagtagatggtaagtgatggcaacaatgagatatctaaaagaaagattttcaacttaaagcagtgattgcctatgat

SEQ ID NO: 34765 - DNA, 1056 bp, Homo sapiens
catgtgtatatgtatgtatatttcttttgaaaggaattggtccagatggtcatatcgctttcaatgagcctggatccagtttagtgtcaaggacaagattaaagactctagcaatggataccatcttggcaaatgccaaatattttgatggagatttatcaaaagtgccaactatggctctaactgttggtgtggggacagtgatggatgctagagaagtaagcattaaatattctttgctgtctttcttttcatgttaatatattaatattttggaggagttatgatgctgaataagtgatattttgattgcattctatttgcagtataaattgttttctagttttcagtaaccaacttttgtcagtctcattgacatgtttagggatcaattaagtcttttggagctgtaaactaagaattaagcaccaccacttttgaggtactatttcacttgcctattcctgctccagtttgaggtcctaaaatcttactgatcacatcgtttgttttttattgaaagtgtctcatgacaggactgttgggacaatgatgcaatgctagttacactacatcttttttggagctcacaggatgatttaaatgctttttgactgtatgttatgtaggatgatagagccctgttggtttccagcagaaaaggaactcagctagggctgcaactgttctacatttggcatatttaagcatggaagagctctgaacagaagaccctgtgtaatttttaagtttttttaaattgggctgtcattttcttccttgagaatacagaacacattgtagtcagttcgtggttatatgtagttaaattatatggaaacccagaactctgttcctttctggtagccagattggacaggttcagaggaaaaaactatagacaaggtatgatgaaaaagtaacttatcttgatataattatatttaaacttgaacatactaatagaactgtcaatcaaaatatatgagaaacctagaaatcataggtatatgaataaaagacctttcaaggactgaaacttcatagtcaataagt

SEQ ID NO: 34766 - DNA, 1098 bp, Homo sapiens
gaatgattggataaagaaaatgtggtatatatatacaccgcgaaattcagccattgaaaatgaaatcatgtcctttgcagtaactggaggccatcatcttaagtgaaacaactcccaaatagaaagaaaaataccacatgttctcacttacaagtgggagttaaataatgtgtacacgtggtgatggaaagtagactgatattagaggcttagaagggttggggagtaggagtgggtagatgatgagaaattgctaggatcattgtacattattcaggtgatagatacaccaaaaccccagacctagtcactaaataatatatccatgtaacaaaattgcatttgtaccccttaaatttataccatttttttaaaaaaaaggaaaacaatatgtcttacagataacagaagctgtgagttactgtaagaatgctgatttccacatctttcatggtataagtcaacctacattgtgtaaaatggaattatgtagcttttaagtgactccgatctcttaatatacgtataataatttttcttaattttagaataatttttgaggaactaaaattgctttttgtcaagaaatttctcctccagagatgagcagtttatttagttcactttgttttctttttcttctgttgaattctcttattaaaaataacatgtctagtgtgatcctattgttataatttgaattctgaccttgttgcttactacctgtgtgaccttagtcaaattatgtgagtccatttcctcatctataactgggcattttatttacttcacaagatggttgtaaggattaaaatatgtacacttgtccctagtatctgttggggattgattctaggatcccccttcagataccaaaatccacagatgcttaagtccctcatattgtatgacatagtacttgcatatcacctgcacccatactcccatatactttatctctagattacttataatacctaatacaatgtaaatactgtgtaaatagttgttatactgtattgtttagggaataatgacaaaaaaaagtctgtacctgtttaatacagatgcaaacatctttttcccctaaatattttc

SEQ ID NO: 34767 - DNA, 1034 bp, Homo sapiens
tgaggataggcttagagtgttttctgagtgtgatctaaacagtgctactcaaaatgtgtctgcagagaagtgcttgtctgtgaactgtttgttacaggtcagtgattcaataaggagcttgggccagaaagtgtatcagtatactgctgtcttcatcgagaaattttggttttaaaaaaattatcagctgaaggaaatagtgtgcttagtgtggtagttaatttatcttcttgtgcaagttatttgttatgatgggccagtgatggtttgtagaacagcacttcgagtagcactcattgtgaagtctcttctaaatttcagctttccatgcagtatctcctttacaagaaaaacgtcttgctatagttagtctctctctcaccacttggtaacactccattagcacattcagcagctttatcgaaattgaatcagtatactaaatactgtgcatactaaagtgtgcaatgtgatattttgacatatacatatttacatccatgaaagcatcaccacaaattaggataatgaacatttgatcactcctgaagctttcctcttggtcctctatagtccctgtcccttccatttcccacaagtaaccactgatctgcttcctgtcactatagatggttgcatttttggaagtttagtataaaggaatcatatagtgtgtaatttttttttaatctggcttctttcagcattattttgcgtttcatccatgttgcatgtatccgtagttcatttctttttattgttcagaagtattatgttgtagagttctgccacaatttattcacctattgatggatattttggttggttcaagttttaggcattagaatacacagaatgctgcgaactttcttgcatacatctttgaacgaacatatgcttttttttgagcaagtactttagaatgaaatggctggatgatatggtaggtttattttttcaagatactaccgaaattaaaaaaaaattttatttgaataatttttgagggtacaggtggtttttggttgcacgga

SEQ ID NO: 34768 - DNA, 1030 bp, Homo sapiens
tctcacctggcttcaccttggcctgcttccttcctctcacagtctgaagttctttgcacttcagatgtgccagctctccttgctgctgctttgaggcttgacagccaaatggcaagtaattccctttaaactgaagattttcagctgctatacttggctttcttttcttggtagcctaatttagctctttttttttctttggcgatggagttttgctcttgtcacccaggctggagtgcaatggccgatctcagctcactgcagcctccagctcccaggttcaagcgattcttatgcctcagcctcctgagtagctggggttacaggtgcctgccatcacacctagctaatttttgtattttttgtagaaatggggttttgccatgctggccaggctggccttgaactcctgacctcaggtgagtcgcctgcctcagcctcccaaagtgctgttattacaggtgtgaaccaccgcacctggccataatttaatggtttttactaaaatagtcatatgatcagagtctgtttccatgtgtttctccaatggtactttttttttttttcttttttttgagatggagtctagccctgtagcccaggctggagtgcagtggcatgatcttggctcactgcaacctccacctctagggtttaagtgattctcctgcctcagcctcctgagtagctgggactataggtgcacgccaccacatccggttaattcgtactttagaactgatactaaactcatgtggcattcatgtagcctgaaattgtcctccttctttttgcttctacccagacacagggctgtctttgccattactcctgactccttctttttagcacttgcttgatgtaacaatcaccacgtatgtacatgtccttcaccccaggagactctttcaaacaacaggttgggttttttcttgttctgtttttggtttctgccatacccgggttgacaggagggaagacatcaaaagagacattatttttcacaatatactcataacaaaaagaagaa

SEQ ID NO: 34769 - DNA, 1062 bp, Homo sapiens
ctctgcctccctggttcacgccattctcctgccttagcctcccgagtagctgggactacaggcacccgccaccatgcccggctaattttttgtatttttagtatagatggggtttcaccatgttagccaggatggtcttgatttcctcaccttgtgacccgcctgcctcagcctcccaaagtgctgggattacaggcgtgagccaccgtgcccggcctaatcagacattttaatatttagtatcatagtcagccctacagtttgaaatattctcttctgttatctcccagtctcctttctgcttacctaaaccctgaatttgttgaatacaatcagtagtggagagtagtgttttaaaaaatcaaatcaatatattgactatatatcattactattaaaacattacccaaattgatttttatgtaaatggaaactttcaaatcaatgtatgcattgaatttaattaaaatgatgctgtttttatttaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatag

SEQ ID NO: 34770 - DNA, 1023 bp, Homo sapiens
aggatctctgcatcctaagggggctttacagtgagatgactacttaaaccaccatctcgctcttttaagtttttagattcccgagagagaaaacctaatagactcaccatggatccaagggctccttttggcacaggcagccacagtcagggaactagaacaggtagcatagccatggctgtggctactgggggaattatggtgaaccaggcagccatcccaatgtatgtcttctacaaattttaccagtatgtggcagggtcaaatgaagggtttagagaaaaaaagatacatttattgaaggcagaagacctagccagagaaaagacagactttgaagtcgtcaatgaaattgtgaagatgagtatgaggtcttttaggaggcagaaagatataacatcaagaccagtgatttttaacttttcatcaacccccagcgcaacagaatactgattaaagtgaaaggcgacactatagccatgatcctatgtattttcaaaaggtcttcctttattgaatctgataagcttccctattcactttctcctatagaatcattgatttaaatgatagatatcagagactgagaaggattgggggaaggggatgaagtgatgttgattaaggtatatttccaaatagctggaagagaggacttgaaatgtttgcaaaacatagaagtgatcaatactcaagatgataaataccctcaaataccctgacttgatcgttacacattctatgtatgtaagaaaattacatgtgccctataaatacatacaaatattatgtatcaataaatatataataaatttgaagtggaagggttagttactttttaagagaaaatgactaatgtaattaccttagagattaattaaggaaagaggatatagagacgtattttgagagtaagaataagtggtgagctaatgccaaatgtttatgaagtctggctaaaggcactggcaggaatgaaggtaagaatgaaattaagcaatacaaaggcttgaaacaaccact

SEQ ID NO: 34771 - DNA, 1086 bp, Homo sapiens
tggtgagaacacttaaaatctctcttggcaatttttaagaatacaatgtatgttattaactatagtcatcattttgtacaatagatcttttgagtttattcctcatatctaactgaaattttgtatactttgactaacatccccccaatccccttctgtccttcagtcactggcaactaccattctgctctttcacttctacgagttcagtttttttatatttcacgtatgagtgagatcatgtggtatttctactttttttgtttgtttgtttttttttttttttttttttttttttttgagatggagtctcactctgttgcctgggttggagtacggtggcgcaatcttggctcactacaacctccacctcccaggttcaagcgattctcctgcctcagctgcctgagtagctgagattacaggcgcccgccactacgcccagcaaattttttgtatttttagtagaaacggggtttcaccatgttggctaggctggtcttgaacccctgaactcgtggtttgcccacattggcctcccaaagtgctgggattacaggcgtgagacattgcacctggccggtatttctgctttttaaaattatttatgaatttggttgtctcattcccatgcaagcttttctactttttacttgggaaaattatttaacttctgtgtaactgaacttattcatatataaaatggggcactaataatacccacttcagagtgctgagtattatatgaggtaataacatgtaacggacttagttaatggtaagcgctatatatgtggtagctatggtgattatgattatctacaaataatattgttctacaagtgtttcttagttcttttgaaagagggcttttcctattattggaattaaagtggaacgttttgatgcagacagtgttgtttgtaggtaaaccatttggtatgacttactgaagtgctagcagaatgatgttgagggctgagtagagtagaaaaaacctgtcccactttgattgggaagggtaacacatctcatctctaagtgaatattttagaaagacctctgttttttgctatgaaatctgta

SEQ ID NO: 34772 - DNA, 1047 bp, Homo sapiens
tctctgtctcccagactggatgcagtggcgcactcacggctcactgcagccttgacctcccaggctcaggtgatcttcccacctcagctttcctagtagctgggactacaggtgcacaccatcgcaccaggctaattttggtgtttttttgtagagacggggttttgccatgttgccaaggctggtctcgaactcctgggctctggcagttcaccttcctcggcctccggcagttcaccttcctcggcctccgaaagtgctgggattagaggcatgagccactgcacccagcctggtgtacttgttaaaatccattccctttagttagtgctgtggtctaccagggtattttcagtattttcatatttagggggacctttttctgttgtgattttagctcagcctcctcttctgtttttcatttagtttttttcagaactccactagctctatgaaaatacttgcattgggagcttgaaaaatagctctctcaggagttgtttttttttttttcctagttataggtaatttgaagtttgtagaaatttgtgtcttctagttgtgctgtggtcgtgggattcagtgattttgttattaatgagctatatgttttttgagggggacatgtggatatatttggattaaggtggcttccattacctcagcactacagattttttttcttaaatacatattaaagtatatgttttaatatagaattctatcgcttcagttctaataatttcgtttgctttcaattcagtgaattatttaagtcatcttttccttttagtcctgtgtggaaaaaaacacaaactgtttttcctctgctcttaaaacacaacaatcaacacaaaagacttttgtgaccaaatgtgtgggagtttctttcaaccaagaagaaaacaatcacttctgtagcaggcaccagctgggtgtcctctaattcatttctgagactacctggagaaagtgtcagatcctgtaggttgagggcttagtcccacaagactgccttcccttcagacactggtctgaagttcaggc

SEQ ID NO: 34773 - DNA, 1049 bp, Homo sapiens
tcattgctactatataggaaatcagttgacctttgtatattaacttcgtgtcctgtaactttactataattgcttattccatatgtatttatttttttaatgctagtagagttagcatctttaggtattatttttgaataatttgtaatgttttcattttattttattttttccttgtagggaatgtcttgggaaacatgaggtaagttacaggcacaatttttaagtaaagcttataatctatactgttacatactagtataactttactagagttgttagaaataacaaagtcaaagtattgttattttactgttataaagagtacaagagtttatctactaatttaaaaaatatgtagtgcctttatttgagaattagcctgtggatatgcattcactacagaatcatattgaattttccttttaggaggagaacattttgcttcttggcattcattactttgaaatattttgacaggttactttgattttgatattattattattcgtgcaaacttatacctttctgaaacttgttctcaaatgatagcagagtaattttggaaacatataatatgtccagaaacgtttgagtaatgtgtgctgtgctgatttcctttattttttaaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggtaatgttcttagattgaatgtatatctgcccatagtattcttgaaacgttttttcaacagttataccataaatatttttctgttttgctttagcttcctgtctctttttttgccctcatcccttctccttcttttcctttcctaagacagctggccttagacagcttggtgtgtatagttctgtgtctttattccagctcataataatgtgccttttaatgtggaaccctttacatactgtacctgtgttaatacataggatatggttttatgat

SEQ ID NO: 34774 - DNA, 1050 bp, Homo sapiens
atttgaattataattcttaatttgtgtttgttttagggaactattttgaacttctagaggcacttaagccaggatattgtccatctttaatcttttttttatcaggttaactcccggtccatgttttgcttggtcctgacacctaggcaacagtctctttaagatattcatttcttcattgaaaactcttcttcctttattatttcatttctgatagagttccttactgggaaaactagagtggaagaaagcccttaagatgatgacagaacctcttggagcgaactttatagcctgctttaaagatttctttgattttgtttttttatatttttgccaacccataacaaaagagcgtaaaaagctgaaaccaaaataacatttttttttatgtttagaagagaaatatttgggattatatcctaaaatggtggcttagtacttagtctttcacaaagcacaattaatggaaaattgactgtgcttgctactaaccaatatcaggtcatgagaaagaagttattgggaattcatctaaaaattgtgtacttggatagatgtatgaaagtaggccaacgatattattgttaatgttaaattttccaaagacttaaatccatttttgcttgttttagttttgaatgagtaatgtgttaaatttgttatttagaacagaagttttagcacattttagagaaatgtctaaaactttatgaggtaccagtgtacagagaaaaaagtgttataaatcagaggctgggtgcagtggctcacgcctgtacacccagcatttgggaagctgaggtgggaagattgcttgagtccaggagtttgagaccagcctggatgacatagtgagacccctccatctctataaataatcaaaaattagctgggcatggtggtgtgtgtctgtagtcccagctacttggaaggctgacgtgggaggattgcttgagcccagaaagttgaggctgcactgagctgtgatcatgcaacagcactcagcttgagcaacaggttgagaccctgttacaaaaaaaaaaagag

SEQ ID NO: 34775 - DNA, 1050 bp, Homo sapiens
atttatgtggcatttatttggaaacagaacatgttctcgtgacaatgaaaatattttgtatatgatacaaaagaaatttaaatgttaatatgaaacttgttctagcataatatactaactatactcatttgggagttaaggttagagcatcttttgagaatgaactgatctatgatgatctacaagtatatttttgatagagctgaaggttaacacttctactgccaacacttatgtattttaatgatggaagtttaaagtctttcatggtatttgaacttttctttgacttaggcacattcgaattatatctttttttgggctgggcacagtggctcacgcctgtaatcccagcactttgggaggccaaggctggtgaatcacttgaggtcaggagttaagaccagcctggccaacatggcaaaaccccggatctactaaaaatacaaaaaattagctggacgtggtggcgtgcacctgtattcgcagctacttgggacactgaggcacgagaatttcttgtacctaggaggcagaggttgcagtgagccgagattgcgccactatactccagcctgggtgacagagtgagactttttctcaaaaaagaaaaaaaaaagaattatatgtctttttgtgctagatgttgagaattatgaaattctttattttcaagtttattcccccttaattctaaattgtagtcatgtttcttgcggtattgcatgtctataccctgacttctctcttctgtttgttgttgctaatatattttgtttatttgtaaaccacaaaacaaaacttaaaaagttgagctttgtgaaaagcagagtgaattcctcaataaagttcaggtggttagtagaaaactaatgttactttctttttgtagctgtattctagatatgtgctgtttaattcatggtaactagccacatgtagctgtttcagtatttagaaattataagaaatttgattccttcctcagttgtaagcactagccacgtttcaagtgctcacagtatgtggctaattgctactgtattggac

SEQ ID NO: 34776 - DNA, 1033 bp, Homo sapiens
caggagtttgagaccagcctggccaacatggtgaaaccccgtctctactaaaaatacaaaaaaattagctgggcatggtggcacacacctgtaatcccagctactcaggaggctgaggcaggagaattgcttgaacttgggaggtgaaggttgccgtgagctgagattgcgccactgcactccagcctgggagacagagcaagactccgtctcaattaaaaaaaaaaaaagaaagaaagaaatatttttgcatgtaatgtcaacatttattaatatatttgtagatatgtcatattgtttatataccttttattagtaatatatatttatgcccttgcttggttctttttcttactttagtatactgttaaaaccaggaaaaaccttacaaatattttgggaaacaattctacagaggagaggtgactttcctagagttagacaattagtaattggcagagctgggtttaaacctagttgacttagctttagagccattactgggctgatttcattttctctgtaaaagcaggaaaattctgaggagactagacggttacttttgtacctgtttatggggaaaaagcagcattgtacagcagttaagaacattgacacttgaatcagattgctacggtttgattcttggctttgttacttggctgtaggatgtttgacatattgcttagcatcttaggggcttagtttcttttgtaaaatgggtataatgatactaaatactgtagagttgttaggatgaaatgaatcagtatgtgtaagtactgtagtgcttacagtagtgcctgttgtgtagtctgtgctgtatatctgtttgctggaatgtttaatgtattttgtggcttgattattagagattttctatcgtaactgctgctttcttttaaaaaatttgtttcttttttttttttttttttgcgacggagtctcactctgtcgcccaggctggagtgcagtggcgcaatctcagctcactgcaagctccaccacccgggttcatgccaatctcctgcct

SEQ ID NO: 34777 - DNA, 1033 bp, Homo sapiens
tcaccagtattttgatagttttattgtattttcatattttttttcttgatttgttaatcaccgttatcataaaaatttgctgcattttagcaggatacttagaaaagtgaaagtttttgttgtggtattctctttagttgtgtgtcaaggaatttgaaaatacttttctcgtggattacaggaaggtagaatgctccaaaggtgactttcaaatgtgtgttgtaaaatgatatattagcacattatgcttttctttttgagagattgttttgcagaaatgaaacttttttcttttaaacagagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacaggtactgatcttttaaattttgacttttgacgtcaatgaaactgtattcctgacatttttttggtaatgcctttgttctatatggaatagattttatatcttaagatgagcactgtatgttatagagttgaatttttgtacactttggtatttgagttatatattgtgtaacactaatttttctataaagcaaatagaatggcagtggctcttttatagccttaggaggcctttgtgtgtatttaattggcatttcagtagaatgcttggatggggctgctaaagctcctgagcggtggactggggcaagttttttctggttgtgatgatttgattgaactagagtactttgtgtactcctttcaatctattcattttttttcatcatgttaaatgcgtcttgaagtctttttaattctttatttccttattttatatcttatttacaacatctgattttcatgtatttatttttagagttggggtcttgttctgttgcccaggctggagcgcagtggtacgtagtggtgcgtagttcactgcagtcttcaactcctgggct

SEQ ID NO: 34778 - DNA, 1049 bp, Homo sapiens
agccacggcacctgacccattctggagtttttttgggggggcaggacagaacagtttcatcttgataaattaaaggatttaataattttgattacaataatcacagtgttagtattttgaataattttagcagttagtgggaaacatgatttagataattttaaagaaattgcaatattttgaatcagagcaaaatttccttaacaatattactgttaatttttttatgtcttatgattctaatgtttctcctttttttcttttaacagaagaaatacagaaaggggtttattgatgtttcaaaaatcaagtgtgtggaaatagtgaagaatgatgatggtgtcattccctgtcaaaataagtatccatttcaggtgagctggtgtatttttgtggcagtgcagtgctgggcttagtcatgtttgctctttgacattacagtttcctgtccttgctttgctggctgatttgtaggttcatttgccactttaatagttgtgacttttcttcatgaactgtttaagtctttgtggaaacattttctgattcttaaggagttggggctaagactgaaaagtgaggttgaagtgttccctatgaatctgagaaactgagaagtgaaaggctcaagtggaaatgagattaaaaggctgcttgtgatgaaaaaaataatattagacatatattaattaaactatgcttcttcggggtaatcatgttattttttttcccgacaatggttctgttgcataagggaggtaaatatctcattattctcatttatgtctgaggaaatcagtgctcacctgttaaatagcttctccaaggtcaccttgtaaatgaaaagtctgccaagcacacacacgcgcatctcctctccagaagaggagggtccggcgtcctgagctactccgcattcctgccagtatcttggttcccacctgccttgagaactcaggaatgtggagttggatcctgataatctggagctctcagcccctccccagcacctcaccacttccttccctgctcaaggatgtttttatgct

SEQ ID NO: 34779 - DNA, 1035 bp, Homo sapiens
atattttgaaatgaaggcactttggcttccttattagcaagccatctttaaaatgctcatactcatatggctaaggtttagatcattcaattcaacaaatatttattgtgctttcggtagatgccaggcattcagctaggtgccagaaagaagaataggacatggatggccctgttttcagagaacgttctcttgctgtctattaagacagagaaggcttttaaaaaaatttcatttcaggccgggcactgtggcttacgcctgtaatcccagcactttgggaggccgaggtgggcagatcatgaggtcaggagatcgagaccatctggccaacatggtgaaactccgtctctactaaaaatacaaaaattagctgggtgtggtggtgcacacgtgtagtcccagctactcggaaggctgaggcaggagaatcacttgaacccgggaggcggaggttgcagtgagctgagatgtcaccattgcactctagcctggcaacagtgcgagactctgtcccaaagaaaaaaaaaagagcgagagagagattgagaccatcctggcgaacatggtgaaaccccgtctctactaaaaatacaaaaattagctgggcctggtggcatgcacctgtagtcccatctactcgggaggctgaggcaggagaatcacctgaatgtgggaggcggaggttacagggagccgagatcgcgccactgcagtccaacctggcaacagagtgagactccatctcaaaaataaaaaattaaaaaaaaaaaaaaaagaaattacatttcagtgtggaaaattcaataataggttcaaggctttatgaaaactgagaggaaagtgatcagctgtgcactgggagtgatggtaagaaaggacaggtttcatggtaactgggacattccaggcagagggacacaatgtagaaagggatggcagtgtgaaatagcatgatgtgtctagctaaaagcaggaaattgagtatttccagagagtaaaatgggaggagggagaggaagagcaataggagca

SEQ ID NO: 34780 - DNA, 1034 bp, Homo sapiens
tgcccttcccaccagctggaggctgctggtcaccactggtggattacgtgcctgaaacgtcatcacctggattacctcttcacaggtggactacagcgtcattccttttacatatgcaccaagttgctgctgaacactgtcggctttctttgtgctatctgacaacacagaatgaaagcaatcttctttatggagatactgcaacacagatcaatgtgtttagattctaagaaatctaaaaaactcagaattctaactttataaaattaatattattaaatctaattctgctgctgcttttctgggtgtctggcatagttacttgacctttctgggacccagttactacatctgaaaaatatgactttcctatggtaggcactattattttgcatcgagttaaattgaattctacttagcaaaatcacaatagagcaattactgcattctttcaaaatgtattaatgcaccaaacatgtattgaacacctactgtggcaagcagtgtgctaagtctcaaggttgaaagatgaagaaaatgtggctcctgagttcaaggaacccttagcccttatgttctgttccatctctttaacttaatggttaacgttttcttcagctgtatttgtttttcctcctttttccttgataagttgtatttttccatgaaatgtgatattaaagtcttcaagtaattttgtaccaaattctctctaggtttactgagatctagtaaaacgttaatgaaactcttatttgtcataggtgtaacatagcagtgatccttttgactgatctcatcattgatcatagtgtgaaggtggaatggggaagctacctccatcttcttcttcatgcaatttttataggtaataaatatttggttctaattctttcatgttatatttttatgataatttaaaagcagtatggttttatgacagtttttatgtgtttctgtttcctgttatttttatgttatttccatgacacttttcactatgattcctctggtctcttggggagttatgtctg

SEQ ID NO: 34781 - DNA, 1025 bp, Homo sapiens
atgccagaatattattttaggtagaaataattgattaaaagtttaagcttttggattataaggtggaaattaatgtacgtcatagtaaacttttgttagtattttgtgtactgtgtcctttttttttttttattgagatggagtctcgctctgttgccagactggagtgcagtggtgcaatctcagctcaacctctgcctcccaggttcaagcaattctcctgcctcagcctccggagtagctgggactacaggcacacgtcaccacgctcggctaatttttggtattttagtagacacggggtttcaccatgttggccaggatggtctcgatctcctgacctcatgatcctcctgccttggcctcccaaagtgctgggattacaggcttgaaccatggcgtccgtcctccttttttaaacagagaaagtgaaacataaagtataaataccattgcaccgtgaactgtgactaacttcagtgatcattcccatagctatgtgcacctggacatttacagtggactaaacagtcatttgaatcggcaacatcacagactagaatcccgatacagtagcagctctggaggatcttatgaagaagaaaaaagtaataaattccaaatgtttttaatataactataagggtgaggtgtattgttaattacattaatgttaataaatatatattttcagtaaattgtttttaaaaagcgtatttaactgccactagtggtgttccaacataatctgaaacatcttgattttaagaagcaacgtaattgggtgaaattttttttaaagcactggtttcctatagataaatcacaaggaacataagaactggttctcaggaagcatcatagaacaaatactggaaacaggctgattttttttagcaggattgctccttctgcatggattcactttttccttaaaagattctcccttggcaattgcaaagtgaataatctacccaagtttcactataacgttaaggcagggtatcatagaagcacaggctttc

SEQ ID NO: 34782 - DNA, 1024 bp, Homo sapiens
agaacagtttttatgtagaataggacttaaatatctttaatgtataatttttaataatattttgaaaatacaatttaacaatatgaaagtgttatttcatgtgtacctaaaaactaatgggacttatttaagactttattttttttagagcagttttaggttcacagtaaaattgagaggagggtaccgagatttcctgtgggtaaatttccctacccacactcatacctagcttcccccgtaatcagcatcccccttcagagtgatacatttgttaaaactggtaaacatacattgacacatctttatcacacaaagcccacagcttacattagagtttactcttggtgtgttgtacattctatgggtttggacaaatgtataatgacatgtatctaccattatagtatcatgcagagtattttcactgccctaaaaatccttcatgctttgcctattcatttctctctacctccctaactcctggctgaactattttgacatctgatatcttatatttaaatgatagaaaagaaaattatgttttctcaaagacattactacaaaatgcttggttgttatatttgtagtatacattatatgttactttagttacattactaacaaacataattggaaattgctgggggagtatatttgaaatttgggatcattatggatctggcagtggagacagggattgatactgcgagtctaatgagcacagtaactgatcctccatttttaattatatcaaatctttatccaaatagatgtgcaaaaatctaaaatgtaaattcacaacaatcagtacatcctaaaactaatcaacggatgtataaagagtttctccgtaaaaaaaaaaaaaggagattattagctacatttcaaaattattggtcatttgagaactttattttttataacagctagaatgaagaaaaagtttgctgatcaaattgtaattgaaatggaataactgattctaaataataataatttaaataatgtccttattctaaat

SEQ ID NO: 34783 - DNA, 1034 bp, Homo sapiens
gtcttggacatttcaaatttcttctaaatagagaccttggtgaagagctgtcttgttttgtgcttattttcatctaacatgcatgtgctgcatctcatgtttatgtttgctgtctcacattgctttatttagatgccatctaacaacagtatcagaaaacaaatagaaacactccaggtgagttgtgtcgacattacaaagtaaaatactgctttatttcctttaagcgtggcatttgtttttccttttcccattgttgcattgcatgtctaatgtatttattccaacctgcttctagtattttaagagaagagtagcacacagcagaaacattcttcagaaggtttaatatcagtgtggccccaagaagatgaatttaagaaatagaactgacactgaatgctgattcttcaccaaaagtcacaattttaaaatattctgtttaacatacattatctagctgttataaatgaaaatgttttaaaaatttccagtgaaattaaggagacagtagcttagattttgaatatagtttgttgttgttgttgctgttatttttaatttttgtgggtacatagtagatgtatatatttatgggatacatgagatgttttgatacaggcatgcactgtgaagtaagcacaccatggagaatgggtattcatcccctcaagcatttatcctttgagttacaaagaatccaagtctactctttaagttaatggaatacagtactgacaaattaatttttaaaagtttatcctattgatttgggtttgttttttgttttttgttttaattttttcagagagagggtctgactagcccaggctagactccaactcctgagttcaagctgagactacaggcatgcaccaccatgcctggctttactgattttggttttaaacaaatcatttttttagttcacagtagaaaaaaagagaagaaacattaaaatgattgttgccaaagactatatttgactgacataccaaaattttgttttatattaagttcattagatttttatt

SEQ ID NO: 34784 - DNA, 1050 bp, Homo sapiens
aggaatatttgttaattcttttagaattatagagtattaatctcacaaaaccttctagatacttattttgtcttttgagaaaatcagtaatgttggtttaagtctgaacaatatgagaaaaagctttgataatatcactaaaatcacatttaagtatgcccggccatatctaaaagttggtactggatctgcacagatgtaaaagctcctgaaatgattctgacttgaatgaaagggtacttgtcattaacactatttggcacatccatattcagcctctcttagtcctgaaaacaaaactgtgagagatagaaggatcattttcttcccaggatgctctgctagcaggatcctcttttcttctttgggtaggaacacaattctgacagtgtgggaatattcttcagctgcatgtcatgcgaatgcttgatttgaatattcttttgatatatacttagatgagcctatttgaatatttgcttgcaagttatagaaatattgcagacatgacattccatttcctggtattcctctaagttagacttgagactgaaaaccttatactttgaagataatggaaccgaggcagatagagaaagtgacttgtctctgggtatgcagctcgttgtgctattgtaggaataggactggatcttctttcatatttcaggaatgatccactggatgttatcctgtacgtctttttcatgattttatgtataattttcaaaactgcctcagtttcttaggtatacggaatatatactactttgagaaatgtttttgtctattttccttctagataaacgttgatattactcatgtttggatgagaatttatatgccttatttgactatttatgaaaattcccaggaccaaatcaaactgattgaactctttatgtcatgcaaccaggaaataaattttatttaattaattacattatacttatttctgttcttatttttggtaatttgtacagatatagggaccaaaagagaattgatcatttttctggatagtatgatttttcatacgttcattaaaat

SEQ ID NO: 34785 - DNA, 1041 bp, Homo sapiens
aactagtgtataaaataggtagtatgtcagattgtggagagtaatgtgaagaaatgtaaacagggtagggggcataggattgccaaaggggtgagggagttgaaattttaaaaagagtatgattagggaagaccaccacatcgaaagagttggtagcaattgagcaaaatctaaaggaatgagacagtaagacttcctgtgtctgtgggaagagcttcttgggcagcaggccccagcgtagacatcctaaggcaagaaattctttgatgcgttctaggaacagcaaggaagctccaaaggctgggtccccatgcacatggtcagagggtgggagataaggccagcaaggttaaatgggaggctttagcactatttctgttaagagatgttggatgcagcttagatgttacttccttgttgagtttttccataggggccccttttgagtgctccaagagcacagagaatttgctctcagtggacctgttatactgtgtcctcttagcctgtattcccactttgttcactcagggctgggactaggtttatcttatgtacttaacatttggtcacttggcacattgtagtacttcagtgagagtctcagtgaattattaaccaatttcaaaccttacagaaagttcttgtattctttgtatagtttaatctaacatctgtatcattttctttgtttgcattatctttttactaggctgttaaaaatgaagtgaatgttccctgtttgaaaaattttgtggagatgctttatcagactacttttgaactgagctcgagaaagaagcattcattggtattaagaaacatttcaaaccttttcatatttaattgggatttttagtaattgatttatgaattcagtggaaatttaagagaatggtaaaatctgaaattgtaaaatccctgaagtgcaatacaagggcaagttttacatacgtatgttttgcgtggctctatttaaatgttctgttcttaattttactagctctgcatttgttgagttgttcagacttccttctaggt

SEQ ID NO: 34786 - DNA, 1028 bp, Homo sapiens
actacttgaatattgaaaatctgaattgaaatgttcattaatagggggctcctcaaattgtgatatatacatatcaaattgtgatatatacatattgagtgtatatatgtatacatattgagtgtatacatatatacatatatacatatttcaatatatacaatatattgaacatatatataatatatgtatatatacaatatataatacatgtatataatatatgtatataatatatatgtatataatatatgtatataatatataatataatatatgtatatatacaatatatacatatatactatatatacatatttcaatatgtatataggtatacatattgagtatatggtttatatatacatatcaaattgtgatatatacatattgagtggctgttagaaagtataaggaggcgctctaaatactgacatggaaagatacattatttggttaagtaaaactaaggaatgcacgcatgcatgtgaggatgtgtaggaaaaagtctggaaggatgtacatgaagttgttaatagtgattatatgtggtggaggagtagggcttttattactggtttaaatgtttaaaatttgttttacataataggaactagcatatactcttttagagttgaaatgagactatttaaatgtcgggtttttaataataagtctataaatagtttaagattgttagaaaagatagtgtcccttgtgaccattttcatgatagttcaaaattgagttatattaaatgtagggctgactcattacaaaggtgcttttctgtaagtgttacagggaggtgtacatgtctttttagtttgctgacagtaaatattaagcagtaataacaactattgcttttcccactgcatagtccatagttcagtgatttgtgattatgaagctaatattcttaaatttagagcttgtgaaatttgatgagtaaccaaattcttagagaaaacgagattctcagaaaaaaggaagattgacagattagtaataatcccatgaacatt

SEQ ID NO: 34787 - DNA, 1071 bp, Homo sapiens
gctaatctttgtctttggatctgtcaccatattattccaacctatagtatcctttctacttacttcttcccctctgttactattatccccatacgctaatttaaatgcactcatcaaaaaatatatacatttatatgtatctcaccaagaacatagatacactttattcatctaaaatcctatgtagggattattcccgctggtaaaaggcaagtctttgtagcttctctaataaaactagagaaaacgatgtaaaaatcaatagagcttgctgaaatatcaccactaactaacccaattttcttctgtcagaataacatgaggtttaatagatccagagagtaaacaatgtaatatatctacaatttaataggacttttacttttgccccatataatacacctatattaaaatgtgattcaggtttattgtgatgaggcacacagtctacagaggattgaagtgttgataaatggttgtttcagtcttgacgagtaaaatattccttataggttagactttgacctcatgtattagaaattatttgtatcttgaataatttgttttgtctgtaataatcacacgtttggaactcttcaaaatgtatgaaggactctatctcttttgtgccaactgatcattgtaataaaccctgggagatggccatggcaagtactattaatatgccagctctcttgcttgctttgtaactttgggcaagttattatccctgactcttccttcctctataaaaatgtgtgatatcatttttgtagaatcataagaattaaatataataacgcctaatgcatggaaagtcctcaatacatattatctattattttcactttacaggtgaagaaatgttcttaattgtagtgatttgctgaagattataaagcaaattcattgattttactccaaattttctctttaatgataaaaataaacttaattctcattggtaaaatatgtgatacattaggtgaaatggccagtatttttttttttattattatactttaagtgctggggtacatgtgcagcacatgcaggttttttacataggta

SEQ ID NO: 34788 - DNA, 1062 bp, Homo sapiens
ttgttttgcagcctatattatttgctgctgatgtttgttaaatattttatttgttttctttgtctctggctgctggatacctttaggtatacagttatattactttgtttgctacttgagtgtaggtcagactgctaccgtcttttaagaagtaatcccaagagtgatggaagggaaagcagcctaagttagcagcagttaacagcctgttaagatagtaggagggagcccctttccttcttgtcttttctcatcatctcaccctctaagctacagaggactcagcccatctatttcaattctgctcagcttcatagcagtcagagaaaagggctacacatctctatgtagttgtcaacctcccccagtccctgggtccaggtatgtttgctggatgaggtcctgcaggattctggtgtttacaggactattttgtgttgattcgcaggtccatttccagctagaggagaaaagtcagccacaatagctttttcactggcagtgaatatttatatcaggggaagagtggagaacaaaaatgaaaacaacattcttgttgcttcttacacatactcatggtagcaatataattcagcttgttcatttgctagaagggaagcaaaagaggttaaatttgaccaagattataaccatcatgagtagccaagtcaagtctggagcccttgtcttctggctcccaggtccatgcacatttttaaaatacctcattatctctaggtttttagaatagtttcttagttgagctcccaaagattaccaaaaaagcacaagaaaacaataacctcaaggaaactatagctgagtgaataatggattatttggatgataggtcatttttcttgagctttataataagtgatatttctgtagtagacttcaagtaaaaaacattggacatatgccaaagatgtcataggacttctatgtttagaaactcttttcaataagaatagtttaggataaataaacattttagggacagctgtccaaagaacaagcagaagtaataatttttctgtccatcgaaatggaaccagaagc

SEQ ID NO: 34789 - DNA, 1034 bp, Homo sapiens
ataagttgtatgaaaaattttagtgtgtgttcatgtgcatttttccagtgagaggtttgtggttttcatcagattctcagagcagggcccagcacacaagaaagattaaaaatggctcctttagaggtataagttacatcaaagacatttgccaatcacctcaacaccaaagcttctgccatctgtcacataccctcccctgatttccatcctgtgtctgtaacctttccttagggacattaaaaatagaatttattgttacccaagtgtttaggaataggccaagaagcaacacaagagttcattattagaggagaagagacacttggaagtcagttatattaccccagcaatcatttttttaagaaggatgttcatacattcacatatggttgatgggatcctgcaaaacaataggctctatgtgtcaagatatgttaaaatgttcataatatctaagccaatatattacactttggggaatgtcttcatcagttctggctgcaataacgaagtaccttagacttcatggttcataaacaatagaaattaatttctcatagttctggcagctggaattctgagatctgcatgccagcatggttggatgctggtgaggaccctcctccaggttgcagactttggacttctctgtgcatcctcacttggtggaaagagagctagttagctctcttgcctctcctgggcactaatcctattcatgaggaatctaccctcataacctgattacttcctaaaggtcccacctcctgtcatcactttgggtagagatgtagccatacgcctaacaatggggatacattctgagaaatgtgtccttagtgacttttgtcattgtgcgaacatcatagaatgtacttactcaaaaccaagatggtacagcctgctacacatctaggctgtatgatatagtctcttgctcctaggctacaaacctttacaccatgttactgtactgaacattgtaggcaattgtaacaaataagtatttctatgtttagatacttactcgt

SEQ ID NO: 34790 - DNA, 1085 bp, Homo sapiens
tgttgtagataagcataatagactttgctctgtattaatggcctgcaaagaaacagggaagtctttaatcttggtaaggtttcattcatcccaaagcacactgtggagtgaaaactactggaaaagcagatgcagaggtgaggcctaactgaatatgtattttctgaaaaatcaggggagtcctttctttaaaatgtgacataaatgtaattttatactatggctatttcattttggtagctacattttcatgccccagtaagaaatcaaacattcgcttaaattggcaaccaagacaagataactttccgaaatcttaaattgaaaattaaatttgctgcttattgctgttagtttttatatattattgtgaataagtcaattcattttcctttttccaggcattatgaaaaacctctatttcagagtcattaccatagttataggtctttattttactggaataatgacaaatgcatcaagaaaaagcaatattttattcaattctgaatgccaatggaatgaatatattctgacaaattgttcttttaccggaaagtgtgatatacctgtggacatatcacagacagcagccactgtggatgtaagtttcaatttctttagagttctcttacagtctcacacgaaaaaagaagagtggaaaataaaacatctggacctcagtaacaatctcatatcaaaaataaccttaagcccttttgcatatttacatgctttggaagtgttaaacctcagcaacaatgccatccactccctctcattggatctactcagtcctaagtcctcatgggtgaaacgccacagaagcagcttcagaaacaggtttccattgctgaaggtgctcattcttcaaagaaataaactcagtgacactcccaagggtgagtacaattttaactaggcagagaaacaatgcttacgtggagttgtttcatgttcataagaattccacatttgttttcaggttcaagggacagctgaaagtaaagcaatttgatcagagcacatataataatgtttcttagtggcattggaagttatagtgtgtggaatttacagctaat

SEQ ID NO: 34791 - DNA, 1065 bp, Homo sapiens
aataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaag

SEQ ID NO: 34792 - DNA, 1030 bp, Homo sapiens
gaaactctggcatgtgcatgtacagatattttcagaaggaatgattattgatatacttaagactgatcatgaacatagtctgcagcagttttgaagtgattctttttgtgttattttctacttctaatgcatgcaaggcagtctttttgtatttatgtatgtccaaagcacttctgtctaattcttcactcaaatcagaaagacctcttcctatatatttcatattagatatataaatttttactaggagcacaaatctgaatgcattttattttataaatgtattttatcggagacttctggtcaagatggcagcataaagacatttttatcttcttctctaaaaagctcgttccaaagtaacaatgtcacgaaacagaaatatctttgaagaaagtcggaagcaactgaaatcctaaatcataataaatgaagacacaaagtaggaggaacaatggcagataacttatcagagaggagaatctgcttgttggggaggggatgttggtggaagtaccttgtagaaccctaaaaagccttgggaattagaagttccagtaccttgaaaagcagaagtgaggcaagaactgaaaacagagaagtcatttgaaaatctgtataagaagcagtgagatccctaggcctcctctcccttccagccagcagttagacagctacccctcctaatgtcatacaaaactagtgtgtctctggacacactggaccagagaggattctatctgcctgcggatactggagggtaggggttgggtttccatactgaaacaggaaagtctgggtcctgagactccctttcccacgctctcttttcctcattctccacctccagctccctggcagccaggcaagagacagaagagccttctctgggattcctgatgcatatagaaaaaagatctgaagatactgtcatttggcaagtcccggtgaaaaagccatgtaatttccctcttgtgacacctgtcagtcacaagccctacccctcaaataattttctatgaattcatca

SEQ ID NO: 34793 - DNA, 1034 bp, Homo sapiens
aatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatgggaattctctttctagagaattatatccgggtaatgctacacacatggacttaaaatcctttttataaagtgtgagtcagtggcaggtcttatgtccaagtaattattacaaacaattttgaagcagtggaaatgtacagaacattctgatcattataatatataaaggcagtattactctcaaggttgataaaaatcaatgttctggagataactcatcactttttttgagtgaaaaagatcaacagaatttaattcaggaaatggtatctggagaatagcaaattgagaatatcagtgaaaagaatttagggatagttaactaggcatcacagtgaatttatttttggggactttgcatataaaatccttttaaccagttatgaaatgaaagatccattccccaaataagaaggcagcttccagtatctggtttctaggaaggagtaggactgtgattggtccctggtgccctgacttctgggcctgtttctgagccatgggggaccccccagcttcagaaatactcacgtgggttcacaccactccctgccccagaaggagggcaggcacaggtccatgccatgtggcctcagtgaagcctacagtaactatgggtagggctgcttttccctgtcaatcacccagggcacctgtgggtggacagaagattgtcatcggaatacatgcttgggcccaattatgggaataaaacctcatagaccaagagcagggaatgtgccagtaagtgttgagtctcccagctgctgtccatcttctcggggcagtgcagttgaacctgactgagctggaacagagactgttgggaa

SEQ ID NO: 34794 - DNA, 1068 bp, Homo sapiens
gttgctgagaaaggagcattaaaatatttttgtgggattgttctgtttctccttttaattctgtcaatttttgttttatgaattttttgactttttaaaaacaactttggtgaggtataatttacgtgccataaacctatccagttagtgattttttttctttaagtaatttgctgagttgtgtaaccagtactgtaacctagttttagaaaattttcatcacaccagtaagatccctcatgactggcagttaattcctgttttatttgaggtcactactaatctactttttgtctttagagatttgccttttctggatgtttcatgtaaatggaatcatacaatatgtggtcttttatgtatgacttccttcacttacataacgtttttgagattcattggtggtgtagcatgtatcaggagtttattcccttttgttggtgaaatagtgttccagcttcatgtgtttttgaggctctattatgggggctatccatatttgactgttgtgtttttctgataagttgacattcttatcattaggaaatgtcctcttttatttctcttaataactttatcttaaaacctattttatctgatattagccctctacaaacttacgctaactcttcgcatagtatgtcgtttttccaaccatttactttcaacctgtgtctttatatataaagtttagctcttgcggacggcatagaaattggtcttgccttaaaaaaacaaatacttccttcaatttttgtctcttacttgtaattattagtccattaatgtttatggtaattattgatatagttgggtttggggctgccatttcatttgttttctatttatttcctctattttttgttcttctgttcctcttctatattttctttttgaattattttttgaatatatttttataattccattttaattttcctcttgatcttttctgagtacattttcgcatgcctgggtgtatttttagtgattttgctagagattacaatagacattcttcacttttcacagtatccttacacataataatgatactatttcacataa

SEQ ID NO: 34795 - DNA, 1071 bp, Homo sapiens
attcattgctgacttttccagataaccttgataaaggcacttcagaattgggtcttggggattttccactgtagccttgcatgctcccttggttattcttttgtttggttcgtaagatttgttagcccagttggagcttaattttgccactgtttattttaattttccctctttccatttaagctgagcttttgctctacaaatctctgatttttccgtgcttctcagtggctttaacatgtttgtatctgttactggagccaaaaggttgttttaagaactgctttattaagtaccaattttacagctcctcattgctttgtttgcagaggttcaaattgattcagtagagtttctgaggctttcgcagataggagtagggctgggtaatggagggaggtgtgatactcagtggagattctgagttccagagattcattcaaattggttgtagttgcacttttccaaagcccaccattgggtaccttttaaagccagcacattttcggctcatgattgaacagtgcagaacagccacctcatcaccttttctactgaacccaagaaaggaatatggggatttagaagctgactttatttatttatttatttagagttagggtctctctctgttgcccaggctggaatacagtagtgcacaccaccatgcctggctattcaataagattttttttttagatggagtctcactctgtcacccaggctggagtgtagtggcgtgatcttggcttactgcaacctctgcttcctgggttcaagcgcttttgctgccttagcctcccgaatagctggaattataggctcctgccaccatgcctggttaatttttgtattttttagtaaagacagggtttcaccatgttggccaggctggtcttaaaatcccgacctcagatgatctgcccacctgagccttccaaagtgctgggattacaggtgtttttgtagagtctgggcctcactatgttgcccaggctggtcttgaactcctggccttaagtaattctcccaccttagccatccaaagcactgggattataggcgtgagcc

SEQ ID NO: 34796 - DNA, 1041 bp, Homo sapiens
tattctctctgtcacagaggctgacttaacctaggggtgccagtgtagaattctcctgggagctgacctttaagctggccttgcaggatgctgggacacaggcgtctgaagaagcagggaaggaggagcactcagatggtaagcagggggcatttgaggtaccggagaacagcaggagggccattggaacaggggatgaggggcaggagatgaggttggaaacagcagtgaaggtcactggaggattttaagcagattcatattttaaaagagcactttttgcagcgttgacagtggggttagaggtaggtaaggtgggcagtagaagccattcaggatgtggttgtaattcagatgagagatctggtagtctggcctagctggtggcagtagagtaaaagagaagcacatgagattgagagatttagtgagggtgaggcaataggacagtgatggatgggcagagagtgcagaggacgatgtcggcatgacccataggtttttgacatgagccaagaagaggagggtattgttcttttctgagcagggaaacaccagataaatgaaaaatctagttttagttaaattgattttgagatcctgtaagacaagtaagtggatttgccagtattcattcagcctggagctcagaaatgaggtgtccaggctgccgagaaagagttggaaatggttggcatgtagcagctgattgaagccatgtgagtggttcctgcctgggcctgggagagggtggagggccccagacagcccttggaaaaagccagccacctaaaagtgccatggagtttgccagatttgaagctcaacagtgatgaagtgagggtagagcccagaaggggcttttcgaggagtgatttggagataaggaagtagagacaagtcttaagattttattaggaggctgggtgcagtggctcatacctgttatcccagcactttgggaggccaaggtgggcaggttgcttgagtccaggagtttgagactagcctgagcaacatggaaaaccctgtccctacaaa

SEQ ID NO: 34797 - DNA, 1035 bp, Homo sapiens
attactataattatttacccaattcaagttactcccattttttttttcctgttagaaagcttgctgcagggatatgactactgattgtcccctcagtatccatttttcagccaggcacaatggctcacaccagtaatcccagcactttaggaggtcaaggggaaaggattgtttgagcccaggaatttcgagaccagcctggacaacatggcaagaccctgactctaccaaaaaaaaaaaaaaaaaaaaaaacccaggcatggtagcatatgcctgtagtaccagctactcatggggctgaggtgggaggatcacttgagcctgaaaggttgacgctgcagtgaaccctgttagcaccactgcactccagcctgggcgacagagtgagaacctgtctgaaaaaaaaaattcacttttcatttctagagacattttacctggtcgtggctgcccaggtaaagaccacctttgccaaactcccttgcagctaggtgtggccatatgactagattagattctagctagcaggattgtgagcaaaagtaatgtgtgcagcttccaggagcatcctagaggaggatcagtcctttcccatttttttttctgcttccccctggcagaaggcatttggtggtaggagctagagtagccatattggttccaaagatggaaactggctcttgaggatgacagtgcaacaagataaaaggaccccgagtcctcaacactgcagagcagctgtatcaggcccacgctgcatcctcttgcatacttacatgagagaaaaataaattttcatcttgtttaatccacacttacattatttgggtctttttacagcctttatctctttttccacttctgtgaaaatatagtagaataaaaaaagtcaaattgcagggttgaaggatatggtcatttaaaactttgatgctactgcttaatttatctttaagcaattatcatcatgatctcatgaaacattccccatcatgtctgtgttcttttattatgcaaacatttacatttaacata

SEQ ID NO: 34798 - DNA, 1108 bp, Homo sapiens
ttggctcagataagaggttttttgtagtggctcaaataatcggctcttggaggagcaccatttgttgaactactttgtagatgatggtctggtcggtgagcttccttgggaggcaagtgagcacatggctgagatatggttggactttctacaccactgttgattgggtatgagagcttgatgttctctacccttgtaaagacatgcttcttatccatagcctgtgggtgatgagagaacttaccttcctgggtcattgtggggcttaagcagagagattgatgtctagtgcttagcctgttgcctgggcattgcattaccactttcttccagtgcccttcttatttccattagtgaaagagtccaccaaacactgtagtagacagagccctgagctaggactcagaaatcccaggctctgattgctttccagctttagcggtgttgggcaggtcactgaggcctctctgggtctataaaataagaaccactcctgctggtgagcagtggcaagaagacgagcatgtgtgttataaaccagctatggttttcagtcaaggagaactagggaagggctgcaggacaaaaggaggaagaagctatgatttctgacaaaaatgccattggaagacacatgctggtggtgtgtggccaagcttttgttgtcactagtcaagatacaatgtttttccttttcctgagaatgagagcacattctgtagtaaaagatatgttgtctttgaatgagcttataccacactcttttgtgtcatttggcacacacagccttcctaactgagaaatacatgaagtagctaagcgcagtttcttttctaaatttttaagtaaagtgtctgaataggtactatgagtttatgtggcagaaatttcaaaatgtgcacaaggttgtatgttgaaaatagacccagtgtccaattcttatctctggcatctatcaatagttatagtttcttatgcttccatttagagttatatgcatatacaagcaactgtgtttatatttctctcttagtttttaaaaacacaaagagtacatagagtataccctgatctgtcctgatctgccccttgctgtttgtgtcttgta

SEQ ID NO: 34799 - DNA, 1025 bp, Homo sapiens
aaaaacaactggacaaggttctggatagttgtctgttgcaaagttgttctgaaacagtaaccgattaactcacaagatgtgtgtaaactggctttccacatccactctagatcatgtgaattttcagagggaccatagtttgatttgaaaaggcatcatctaattaatgtgaattaacattagcaagtacagtactgttacagacacattaaaggctttacagagaagaaaagtcatgaaatgacatgctaatttagtatgtgggcaccggaagagctattacctattcaaaaatagttgtaaaagaaaagaatcagccaagacaagctggttgctaatggttttagtgtgggaggagaaaactgcattgcaattcttggctctgagttagggtcaggaagatcagtagcccagcgttgacctttgtgtttggaatctttcatattgactcaccagacgcttgtaatttggtgagccagataacagaaatgtagacaaggtctctgtgcctgaactttaaacctccgagtagcttgtcctttatgataataattagcattgcttgggatctaaagcagagtaatcacctaagacctaccatattaatctaaattaactcagtaagttaccaccagagaacccactgggaaaatgaaggtgggaagctgagaagctcagctgcataactttatatattgtttgtttgtaagtctgtttggaggtgatttttttaagtgatatgtctcacagaaggaaagaatttcaacaacgttgatacaatcacacatttacaagtgtcagggttgtccaacccctttgaatccaagaggaacttttactccttatttcttctcctgatgttgaagtagtaagtgttcttttataatcaggccaatggtattattttaaattaagtaatatctatttatggtagaaaagtatgaagataaacattttaaatagaatttattctcaccatctagtcactgtaaatattttgataaacttatttcaattcataagca

SEQ ID NO: 34800 - DNA, 1184 bp, Homo sapiens
tccagtaaactaatagcaacagcttatgtgatctactgcaagttactgaattgttctgtgactcattcttgatataggaggattggacaagatgacctaataaatgttcatttattattattagaaataaatgttcatgaggccagccgccgtggctcatgcctgtaatcctagcactttggggggccaagacgggtggatcacctgaggtcgggagttcgagaccagcctggctgacatggtgaaaccccatctctactaaaaatacaaaaattagctgggtgcggtggcacacacctgtattcccagctacttgggtggctgagacaggagaattgtttgaacccaggaggcggaggttgcagtgagccaagatcatgccactgcactccagcttgggcaacagagtgagactctgtctcaaaaaataataaataaaaaataaatgttcatgagtccaggaaagatagaataagtttttaatacagtaaagatgattgagcatttgtcaaactagggtataaatattactggaatttcccatgatttttccagaaaacttgtgtatatgcaaaaatgagaaataaaaattagatcttaatactgaaatatgacccataaaacacaagcacttaaaggaattctattaataaagttttgaatgcgctgatcaaatggagaacttctatttttatgttgttatttttcttgccacactgtgagatcttaaaattaaatgtgatcacacttaggctcataacctatatttatatcccccaaagctagattttctccagagaacaaggagtgttcttccttataggaagaaaatacaatgcaagttctatgatgataccattgggtgcttaaaggatatatacaagatatacatcttagaactgaactgtattcctagacctttacttggcatactttgagtgagcaatatgtaaaatgacttctggtacgtttaaattagggcaattaccaagcatattttctccaagttctactctgctgttgaatgaagaaataatttgttctcaaagaagagggaaggggaagcagcccgtgttggataaatgcaagtgtggctggcagcctactttgagccggtgtagagaaaggctgctggggagctcctgctcatcaccatttaaaggttcattaaatttgatggagaa

SEQ ID NO: 34801 - DNA, 1049 bp, Homo sapiens
aaatattaaagaaaatttcaatgttattcattttttagttacatagttcaaaatccaaaagtttaaaaattacatacagtgaaatgttttccctccatcctggcccccacccatccctagccccttcaccctgctattcttcctggagatgactgatgctaccgtttcttgagtgctcctgcaaagatatacatctctacacacacacaaatacatattttttttctattaccttttaaaatacaaatcatagcattgaaatctgccttggtttttcatttaatatatatcttggagactgttttatatcagcatgtaaagagctttctattaaatttttatggttgcgtggtattctgttgtatgggtattctatagtttctctaacttatctcacagtggccattgaagttgtttaaaatctattgctattacacagaagccttccagatacattatttcacacatgtgtgagtacatctgtaggatatattcctagaagaagaattcctggatcaaaagttatatatattgatatttttgacagatattgccaaattattgccaaattgctctcaatggaaattgcactgatttactctcacatcaatactgtttcttcagactcttgccttaacacatttcattcttctttcagcagccatggtgatccttttttaaaaatataagtcaaaacatgccatcccttgaacaactatttgctgaacacctatcatttgcagtcactgttttgggcactggtataaaccctgtgctccaaacttttcagcagcttccctaggtcagtcagcaaaaaaaagtcaaaatccatacagttgcctacaagaccacttatgatcaactctcctctttttcccaatgttttaacagtatctcctgctcctctgtcctccctcattcaaccacactgagccctctgaaaggcactgtgcacactccagccatggacactactcttctgtcctctctgcttcgaatatccacgtgactcactcttgtacctccttcagagcagcctttctcaccaa

SEQ ID NO: 34802 - DNA, 1034 bp, Homo sapiens
agtgattctcctgcctcagcctcctgagtagctgggattacaggcatgcaccatcatgcctagctaatttttgtatttttagtagagacagtgtttcactatgttggccgggctggtctcgaactcctgacttgaagtgatttacccacctcggcttcccaatgtgctgggattacaggcatgagccaccgtgcccagacagaaacttgattttagtagcaagattacaaatgtttatgttgggcctcttctttccagttacttaaaaatgcatttcaagtctctactaagtaacagtgaattctatcagagttgtttcccaaagtggcttttgttcccccatgtgatatggataccactgaaacaaaagccttttattttattttttttttacgtagatgccttgtagattataagagggaatagatatagtgtggcagttaaaaggcagaagcagggagggaagtcttctagagtcagaatcgaatgtatccctgctaattatgtctgtgaccttggcaagttcttacttctcagttttgtcctttgtaaatcagaagtcatttgtgtcccgccctctgggtggtgggtgggatcactgctcagcccacccttagtaagcactcagccactaatatgttacctttattactgctttactgttattgtaccttgctgtaaactgaacctggaagaaaattctacttattgcaattatgagatgtcatgttttcaaaggattttcaaaatactttttttctgatacaaatatttgatttatctctctttgtgattgaatctcatttcaaattttattgaccaccacaacctctttatttaatcaataactactcaaagacggagaaatgcagtcaccaatatgacttatgtcacttaattttaactaccaggagaccacgaactgcttgagctggtcatttcatcagttgtcccttatttactgagcacctactatgtgccaggcaggaatgggttctgggaaaacaatggcaaataagaaaaaatcccctgcc

SEQ ID NO: 34803 - DNA, 1058 bp, Homo sapiens
cacagaatgtcaactagtgccccttataggaatacattttgggaagcacgttgatactttgagattaacctttctgtgtttattttcatctgcttatcctgtctattaagttttcttggtgcattcttctacctttcctgcctctcacccttgccattattttgctcctcactccagaatccttcaattaattctattctctttttttgtcctgggcttagacatcctactttctgaaatatgtctatctgtcccattcttacattttacaccaattctgtcctctgtgttttctcctttgaaacaccccctccttttctgaacctcctctaaaaatcttggaataattctagactcttttgcttatactccgtattcagtctagcaacaaaccactgcctttaacttcaaaatctctgcaaattccaccagttcacattacattcaatgctccttccttgatccaagccccattgtttctcacttggtttattgaaattgcttcctgtctccctgcctatacccttgtccctctagtttgttctcttcaccatagccgaaatgagaaaacctttaaaacaagatcataccagttctgtgctcagaacctctgtgacttccatgtcagaagaaatgcagaagttctaacaatgggccggctacaccaccctaaatgatctggccccttctctgccttgtcttaccactcttctgtttccattgctaaaggaactaaatctatcttgacaatttctgtaacattgatctagcaccctctcccttctttgcatctgaagcccatgccatagttccagtctatcatctttaaataagctgctcatggagaccatttctaccctgttagaggactttggaatctgattctttttcgtgcatttttttgtgcatatctcttaagtgcatcccatcctttttcatatagtggtaggtatacatacaaaatactgcatttgcacagcatatactgggttcacagaaattatggtcactggcccaggggcactagctgtcgtaggccccagccagctgtcactagg

SEQ ID NO: 34804 - DNA, 1025 bp, Homo sapiens
atgaatcaaacaacagaatgcagggagttaagggttcatgcttacaaacgataaggaaaggtactagactatatacagcaggactttcaacccttccctggccaggcaggcagtagaaacaagatgtaagacaatagggagtcgtggggacagtggtgaacctgaaaacaggtgcctagtgtcaaggggcaactactctttagttcctctttttattaagcagttcaacttcggtgttgcttaaagttgcagatttttaagagaagtcagcagtttgaatttgtaatgggaaatttgttaattttcaagacactctttttgctaaacaaaacatttgactcccagagtccagagctggggattcctgacattaaatgttaatattactgttcccctgttaaggcatgtggggacagccagggctaaacttatctttccatttacctagagtggtctctactggaaaggaaatcaggaaaagagtgctccagggacagggactgttacaagcagtagaagtgggactttttgcatccaggaagcccctttctaattggtgctttctgtttttccaatagacaaacctttttgcagtcacaaagtgtgttcctattgttttctatgacagttacttatttaatttctgtaagagaacatataaccagccaggcgcggtggctcacgcctataatcccagcactttgggaggccgaggcaggtggatcacgaggccaggagtttaagaccagcctggccaagatggtgaaaccccttctctactaaaaatacaaaaattagctgggcacggtggcatgcacctgtaatcccagctactcgggaggctgaggcaggagaatcactggaaccggggtggcagaggttgcagtgagcggagatcgtgccactgcactccagcctgggtgatagagtgagactctatctcaaaaaaacaaaaaacaaaacccatataaccataatttatgaatattttcacacttgatttttttgctaatgaatatcactca

SEQ ID NO: 34805 - DNA, 1123 bp, Homo sapiens
ctgctctactggagcacgctgctggtcaggtatggtccaccagcacaggagctatgatgtgggccccctggaggtacctggagactggattgcaaacaggcacagccaggctgggagaggccagcacactgaggggtgcttgggttggactggccctgtctcatggggaagactgccttgcagagttcagatctgacacttcccttgggggctaaagtctcctatggcagcaagttgagcctaggggatgggtatctctgtccatgctccactatagttgccaccgcaccaaatcctctgggctttgcagtggctggaattctgcccctcgtacttttctgagcatctctctgccaactcatttgtctttggtggttgaggggtctcctcctgccaggattccagaagcctatggtgagagcaggttgctccttgcctattcaactcacctcttctgcaggagttgttgggggctagaaataagtcctggtgctggtagcactgtacagcattcccagcttccttccccttcagtctagtatctgtgtcttccatctgtctgctctcaatgccttccctctgaagatctgctagaagtgtgccagtcttcctgatgtcctggtcccttggtgtgggaggtgttcctcctggccgtgtctagttgaccatcttggagaggtccattcaatgttcttttcttcatctcaaactgtttctaagaaatcgaactcaaggcactggatagcagaagccatcgaccactgccctgtggcataggcagccacttccggatgcctgactgcatgtctttttcaagctttgctttatttcttaacttgttcagaaccagagctgcaaagaggtttttgttttgttttgttttctgtagctattttgagattcaaacagtaatcagaagttgttttgaatgaaatgttttaaatatttttggacaaacgtcaaatgggaaagtattagttgcccctttggtcatttgtatttaatagttgtatgcaaaaagaagttggaatcaatgaaatggtgacataatacaggcaaccttccctttttgaggattaagttgaaaatagtgaaggtcactttccattctgtaaacaaaagg

SEQ ID NO: 34806 - DNA, 1049 bp, Homo sapiens
ggcaacacagcaatagtgggggactttaatactccactgacagcactagacaggtcatcaagacagaaagccaacaaagaaacaatggacttaaattgttcctacaacaaatggacttaacagatatttacagaacattctatccaacaactgcagaatatgcgttctattcatcagcacatggaatgttctccaagatagactatatgataggccacaaaacaagtctcagtaaatgtaagaaaatataaattatagtagatactctctcagaccacagtggaataaaattggaagtcaactccaaaaggaaccctcaaaaccatgcaagtacatggaaattaaataacctgctcctgaataatctttgggtcaacaatgaaatcaagatgcaaattaaaagtctgaacaataatagtgacacaacctatcaaaacctctaggatacagcaaaaggtgctaataggaaagtttatagcactaaatgcctacatcaaaaagtctgaaagagcacgaatagataaactaaggtcacatctcaagaaactacagaagcaagaacacaccaaacccaaacccagcagaagaaaagacataacaaagatcagagcagaactaaatgaaattgaaacaaacaagcaaacaaacaaaaatacaaaagataaatgaaacaaaaagctggttctttggaaagataaaattgatagaatattagcgacattaaccaagaaaagaagaaagacgatccaaataagctcaattagaaatgaaacgggatatattactactgataccacagaaatacaaacgatcattcaaggctactgtgaacacctttacatgcttaaactagaaaacatagaggagatggataaattcctggaaatatacaacccttctagattaaaccaggaagatatagaaactctgaacagaccaacaacaagcagcaagattgaaatggcaataaaaaaattgccaacaaaaaaagtccaggaccagatggattcacagctgaattttatcagacattcaaagaattggtatca

SEQ ID NO: 34807 - DNA, 1051 bp, Homo sapiens
tagatttttgtgaaatttaaactatgacattcattctgcatggactgaatgcctactatgtgtcaggcattgttccaggtgtttgggatatgtcagtgaacagaatacagatcctttgtggcatgtacagtctagtgaggggagggggatgggaagcaaataaaacaccataaccataagaaaatatattaatatgttagaagttctgtgtgctaagaaaatagcagtgcagggtaagggttccaaagacagggttgggggatatgggaggctggtagtgggttacaattttgtataggggagacagggtagcctccattgagaagataacatgagcaaagatgtgaagctggtgagggagtaagccatgtggatatctagaggcagcagattcaaggcaaagggaagagccattacaaaggccagaggacaggagtatgtcaggcatgtttgacagcaaagatcaaagaagacagagtggttggagaggcagaagtgaagtaactgcagatcaggttgtataggaccttgaggctattgtcagagcttggtgtgaaatgggggagcccgtctaactaatcatttaacagattgctgatgtgggtgggtggctatgggaggtttgtgttgttgatctaactctgtgaatgattgggtgaaaattgacgatgcaggaaagaggagaatgtgcttgagtatgagaggggttggtgccagggactcatggggagttttcatagggactaggcaggaaggctgagagtgtgggtacagtgactggtaggagagtatgtggttgtgggagtctgtggaggttttcttctgcttctctcacttttcttagagaaataggtagcatagtaatcacctaagagtaagtggggaaaggagtattcttgaggggaagaaggaagtatgagcttgttctctaggagaacaggagagtgaatggatgaggggaacctcatcctgctgtgaacctcatgcctggctatgaatgccaggcagcattaagggcccagttaagggttaatgactatgaactcaaaac

SEQ ID NO: 34808 - DNA, 1050 bp, Homo sapiens
ataaatatttcaattgccaggaaaaagctgggtgtagtgggcatgccagtagtctagctggggaggctgaggcagcaggatcacttgcgtctaggagtacaaagacagtttgggtaacatagcaatacccacctctctttaaaaaaaataataataagctggggagaaaaaatgtgttctgctggattttcttagagtatatatatatatttgtgatagttgaaagtgagaataatgtagcttaaaaaatttataaaaatgaattttaaaagttaaactagcaaataaaattcattttatctaatgaatttgggcctttttaaccatgtgtccctcttttcttcaacttttctttaacttacaggaatttaattttgttaaaagaaaataattatccttgattataatttgaacattggagatactaaaaaatatatatatatatattccaccttggcactaacttttctttgttcagatatggtagagatggatgatttagaataaatgagacaagtggccagtctctatgtgtggcttctgaaggaaaaatttgtagaatatattatttaaaaactaatagttcaaatgtaggcaaagatagcctttattttatgttatgtattaaaagtgtatattataaagtgtggggatgcccatacctggggactaaaattataaagactgattgaggacatacttgaaatacaaaattatttatttaatgttgactcctaagtagtttaaacatttaattgtcaaattttaaagctgcaaagaatcttgttatctagttcaatgcttttattttatagataagaaacctgagaaacaggaaaatctagctcaaatgaagaagctagttgggagaaagtattttaacagggagctagtgaatattttgtaggcaaatcacaggtcaggagagtggcaaatgtgacagctaagccttagtgcaggatacctagagtaggacaggaatatttttgagccaggtatagaagtgtatcttctttattgaggcagatcaaaagccaggagaactgaaga

SEQ ID NO: 34809 - DNA, 1038 bp, Homo sapiens
tgtgctagaaatgttccactcaaatcaagggttcctttctggttttgtatgttctcacctgctcctcactgtaaatcattgagatgtcaagtgcaatgattaattaagctgcacgtgcaagtgctttttttttcacctgtcaagcaggaaagaagtcttatagcaaaattagatggtgctaattcacagcttttacttcagactgtgaagtgtgtagaaatattttatatttatatgcttattcagaatgtggcatatcagggcttgtttgttttataattcttaaatattgtaagatacaattattataccaagccctatcattaaactcctaattataaacagagaagaaattcagaattcctacttaaatattttggaattcaagatttatactttgtaattatcttttattcaaatactagtagttgatttaagttaaagtaaatatttttaagttttaaaattgtgtgtatgtatgtgtctatatatcataatgagatctattcttattatagcatgggtttaaacttctgatgaaatgatggtggtaactacatttttttctttaagtaataagtatttgcagaatgtagtattaagcttttgggtactattttatacattaatataaaacagtgggcttggaaaacttgttctgctctagttctttcatcatccacccacccccaaaatcatcagtaaaagtaaaacctcaaattgtatagtaatcttaatctattattaaaaggccctagaaagaaagattacaaggtagattcaggttttgaatcggttttgccattggtttagcagcgggtgggcaggcagatgcctgctcagagtagaacctattgccatttttcaccattgatagagtagcctttcagagtcaatgagctctgtcaatgtgagcttgtcaaggctacaacttcatagacctgagaggcggtttgagaggtcagcccttttcaggttcgctgtgatgcaaatgaactttaatgcttaaacaactattggaatttttatgtctgctcc

SEQ ID NO: 34810 - DNA, 1073 bp, Homo sapiens
aaataccactcagaaaaaaacttaaaagacttaagtaagtgggggaaaatattggttcttgtgtcagaagaggaaatacttttttttttttgagacagagttttgctcttgttgcccaggctgaactggattggtgtgatctcagctcaccacaacttctgcctcccaggttcaagcgattctcctgccttagcctcccgagtagctggaattacaggtatgcaccaccatgcctggctaattttgcatttttagtagagatagggtttcttgatattggtcaggctggtctcgaacccccgacctgaggtgatctgtccacctcagcctcccaaagtgttgggattacaggcatgagccaccgcgtctggcgaggaaatacttttaagtggccaatttctccaaactgatccatagatttagtgcaatccaaactaaattcccagcaggactttttttttttagaaattgacagactgattctaaaattcatatggaatacagacaacctacaaaagcaaaacaactctgaaaagggaatacaaagttggagaaccaacgctacccaatttcaagacataattataaagctacaatactcaaagtagtgtggtactcgcatcaagatagacaaacagataaacagaagagacagagccaaaaaatagacccctttatgaactgatttccaccaaaggtggaaaggcaattcagtaaagaaagaacagtcttttaaagagatgtaattggtaaaattaaatgcctatatatatttttaaaatccttcaatctgtacattaaaccgtatattaatagaaagtttaactcaaaatgtaaaacctaaacctataaaactctagaagaaaacataggagaaaaatccttgtgacctgggcttaggaagaattactaggtataacattagcagcacaatccctaaaagaacaccagacaaattggactccataaaagttaaaaatttccgtttttgaaaactattggaggatttaaagacaaactactgactgggagaaatctttgcaaagcagatacttttgtccagaatatataaa

SEQ ID NO: 34811 - DNA, 2096 bp, Homo sapiens
tctgtctaggtactgtatgttaagaaccctcgatcgagaggcatgagtataaaaaattgccagcctgtgaacttctgttttctttcttgtgatgtgaaatcctcttatgtggttagaatggtctcagactctaagacaaatcaggaccaaaggcatacttgatatgcagctcagtgcttttactttcttcacattattcactgatttggaaaactgcagttctgtcttgccttcaaaatccatcccctcacgaggtcaggagatcgagaccatcctggccaacatggtgaaaccccatctctactaaaaatataaaaattagctggcatggtggcacgtgcctgtaatcccagctactcgggaggctgaggcagaagaatcgcttgaaccagggagttggaggttccgtctcaaaaaaaaaaaaaaatctatccccaacttagtgccctctttttatgacctgatattattcccaagaccttgtttttattctgttctattattattattcttattatgattgagacggtgttttactcttgtcatccaggctggagtgcaatggcatgatctctactcacagcaacctcctcctcccaggttcaagcaattctcctgcctcagcctcctgagtagctgggattacaggcacctgcagccacacccagctaatttttttttttttttttttttttttgagacagagtttcacttttatcacccaggctggagtgcagtggtgtggtctctcagctcatcacaacctacacctccccggttcaagtgattctcttgcctcagcctccggagtagctggaattacaggctcctgacactatgcccagctaatttttgtatttttagtagagacggggtttcaccatgtttgccaggctggtcttgaactcctgacctcaggtgatctgcccgcttcggcctcccaaagtgctgagattcaggtgtgagccaccgtgctcggctaatttttatatttttggtagagacggggtttcaccattttggccaggctgatcttgagctcctgacctctggtgatctgcctgcctcggcctcccaaagtgctgggattacaggcgtgagccactgcgcccagcatgttctgttattttgattattttttagaccttccaaattgccttttttcttaactacctttgcctatttttgaaaattgttttttaatatacagtaaaatttttataaacagttctgtgatttttgataaacgcatagagttttgtaaccaccaccagaatcaagatacataacagttttccataaaaaacttacttgtgctgtagtaagttttttacttactacctctgtagttgaaccctcgtcaactcttaaaccctggcaaccagtgatctgttgtctatccctacaatactgtcttttctagaatattatataaatggagtaaaatagtgtatataactttttgagtctggcttctttcatgtagcttagtgcatttgagattcatctattttcttttatgtattaatagtttattcttttttattgttgagtagtattccattgtatggatgtatcacagtttgtttatccatttatcagttgaagacactgactttccagtttttgaataaagcttgccataaacattcacatgcatgtttttgtgtgaacacaagttttcatttttaggaaggggattgccgggttatatggtaagtgaatgtttaatttataaaaaatctccaaactgttttccaaagtgggtgaaccattttgcattccagccagcaatgcatgagagatccagttgcttagcatccttgcaggacttgatatggttagttatagaaattatagtcattctaaaagatacatagtagcatctcattgtggttttaatttgcattaccctcatgagtaatgatattgagcaccttttcatgtgcttatttgccatttgtacctctttgttaaagtgttcattgaaatattttgcctatttaaaaattgttatttcttgttgagttttgagagttcttcatataattctgaaaataagtcccctggcagatacgtgctaatatatatttgca

SEQ ID NO: 34812 - DNA, 1064 bp, Homo sapiens
gtctgaagggggttcagcttcctactcaatgcaggaatcattgctcttctttcaagtacatcaaattattattttatgggatgaaacttggcctttctaatactgtgctgaaccagttgtactttgtcttagaataaaggaaattatttttaccatatataaaaagttttatgtaaacttgtaggtacatttataatgctgtcaattgaaaacaaaacatagatgccattttcattctaacagtctctgcctcctgctgaacttaaaaaagaagccagaactaaggtattgtcaaaattaagtggtttatgtcaaaaataaatcattagaggtgatattttacagttatattatcaaacaagaagtgtgacttttcctatccatttaataaaataagaccgtcttgctaaaattctacctgctactattgttttggttggtctagatttggattaaaaaaaaaggttttggcagggatgaaaaacatagcaaaggagatatttgctgtggcctgtgccaaataagaaattctgacattcaagctctttgccaggagaaagcatgctatatgaaagaagacttgctgaaaagagttgttttcaactactctgatgagaacagtcttattagtaaagaagtgtgtaggaaagcctggattgtggtagtttgaataatgaatgggaggtaacgtaaagatagttaatgtaaaggagtctttcaaaacattagttgaggaaggaaagaaatagatgccatcagacattgagagagaagaagaaataaggattcacatcctcaggtggatagactaattcaggtttgtaggctatgtttaaggagcctgaagcgaggtagaaatacagtgaattgcagaggagactggaggagatgcactcagaagtaaatggttagtttttggaagctttcctccattgagagatggtaaaaatactgaagatatataagtaaatccaaaaataaaagggagggaaggtaaagcagtttatattccatgacatttttttctctcagagttgacaactgtggttatttgcaaaaaaatg

SEQ ID NO: 34813 - DNA, 1032 bp, Homo sapiens
gctaatgctagattattataagactatgtataatggtgaggtttatgatagagtaaatttaacacatgctttggagaattaagtctttgatttcactagtttcctgaatgagattaaactttcataaaaccagatgaactcaaatattgttcagaatgtggttacagagttaagatttttagaattattctgaaacccaaatatacgtctccaactccagggtctctgtatcttttgtataaatagagtatactttcaattagatcccatcctccttgagctacattgatattcagacgtatgttgaatcaaccagataaacttaaagcatgatttatatgcatcaaagcctgttaatttttttccatagttatgactttatctccaaaactagctaaaaatttgagttcattgagctcaaagttcaacattaggaaataagcactctcttcatgtgccatctgcataaccaatatgttcagtttgaaatttctagttcatatgctcataggtcttgtcatatctgtaggaacataaaaattctctgtatctatagatttgtacaggtggaatgtctcagaatccagaatatccaaaatggaattcataatctacaccccaaatcagcttcaacggcagccttccattctcagttgatggcagatcgaggaccctgtttgtttagatcaaaaactttttgatgtattcttgattttcctctttctctttcactacatccattctgtcttgacatcttggctctgtcttcaaaatttggccctattttgccacctacacgactggagtgaattgccagtctcccttctgccttacgcttaatgtatttcttaagtcagttatggtggcatgtacctataatcccagctacacgggaggctgaggcagaaagatcacttgagcccaggagtttgagactacactgggcaacatagcaagaatccatctaaattacaaaaaatatatatatatttttttcttccccctgtctccacctttccacctttgcctctc

SEQ ID NO: 34814 - DNA, 1522 bp, Homo sapiens
catttgtttgggtctccgaagtggggacggacgctgtccttcctcctccacacacccctttagcaggccctacaggcccgggcgatgtgacgatcccagtaggcacgggttttcattagggtctgccctgcgggccacccttcctcttcagggtggaagtacgtgtattgacagggagcctccttgttttctcgcccagttaccctgtggttgtctgtgcctttgcacccagtgacatggctcagaggccagatctgggccgtgtgagaccccagtgacaattggcagcgaagctccgtttcgtgtctatttcacacatacccacaggtctcccagtttttccactaatttccgcagaactaatgcaagttcttgtaattgtacgtgataaaaatatatagttgaacacaaatttaagatatacagaaagaaatatgtttacaacaacaacaacaacaactacgtgagggacatacactctgctcaggttactgagggaaaattgtagtcctgaagctcctccttggggcacgaacttggggcttgttaatttggaaagtcccactagtaacattaaaagtctgatattaataaggaatgaaagctttcggaaagaccatgacaaaggaatgtgaagccttgaaccaaataatgagctgtccggaagcaggaagttttgtaatgtttcactatgaagtccacagttttgtaccacttgatgtattacattgatactctctcattttagatctcttgttcaaataatagatcagacttccatacttgtcaggtatctctgtacttcttcaccttttcagtgaaacaaaagagccagcaagtctgagaatgtctggaatagtcttcattatattttggtgaagagtgagtgggatgtgctgtgaataacttagggaaacagtaagacttctcatataagtttgtcagcaaaataattgcatttctcgtatgaccagccatattgttgtttgagtatgcttatgtaatgctttaatttctttagtacctgttagtttatgttcaggtgacttaacagggtaaaaacactgcataattgccatcacagcaccatgacaagacagtggaatttaattcaccacaataatactttctaagtgttgtcaccagcttaagaagtataaccaaatatcatggatattaaacttttaacatatatcacagaattcataacctgccatttgattttattttgacttttaggacctttttgcactgttttaagcctaaggagtatgtggatgcttaaagaagtgatttccaaactttgtcatgccatctatccctccttctacattcctcatgtcaaagaaaagctagagaattttgtcatttaaaaaggcgacgctgtagttgtaatgtttcctctgttaaggagaagaaaagctaagcactttgttgggcaagtggaaaatgcaatagtgggcaaagtgctcagaacctaggtaatcagtaaacttgattgtagttggctacgtggagaggt

SEQ ID NO: 34815 - DNA, 1070 bp, Homo sapiens
ttcattttgagttaatgtttttttttttttgagatggagtctcgctcttttgcccaggctggaatgcagtggcaggatctcggctcactacatcctccgcctcctcagttcagggaattctcctgcctcagccgccggagtagctgggatcacaaggcatctgccatcatgcctggctaaattttgtatttttggtagagacggggtttcaccctgttggccaggctggtctcaaactcctgacctcaggtgatctgcctgcttcagcttcccaaagtgctgggattacaggtgtaagccaccacacctggtcttgagttaatttttgtatatggtgtaagagattccaacttcattcttcttctctttctttaaatagaaaatgaagccaaaactttctggctataacacataaattttcatttctttacatgtgtatgtacatacaggtacttttgccttgttatagacaaaaactgatttttttgttgttgttaacagtattgtgaatttgagatctctgaactgaaccacaagaaaacatttattttactctgtctccatagagccaagattctgggtcagataatcgtataaacacagtcagtctcaaggaagcattggaaaggtttgatcacagcccaaccccttctgcctcttctcggagttcaagaaaatcatctcacacggccgtctcagacccttcctgtgagtacccttgcttcaaagcagacttcctttaaagtaactaactaaacttttagttacttatatcagcatttctcatcaaacgcttctttaaaattataagtttttacatttctgaaatgtagtaacctttccagtgagttaaagggacattgcccactttcagcaaagaattaagttcttcaagtagcctattaaaatgtgtaggtggtaatggtgatggtgatgtttttaatcatccctcaaaaagaaaggcaactatttattgtgtttttttactgtagggccagtaagtgttcttaggtttgctttttgaaagttttttattgtcttctctttttgaagacttgtataattgtcat

SEQ ID NO: 34816 - DNA, 1047 bp, Homo sapiens
agcacataattacaaatgtgagtagtgcttgtaaactgtttgcagcaaaaacacaggaaagagtatgtcagggagacttttaaaatagttgatttttcaactgagtcttttagattaaggaagacagcatgtcacacaaagggaatatgtgcaaaagcagagaggcagggagacttcattgtcactgaagcatgtttgtgttggaaaattatgggtgtatttgaaagaaaggaaaaagctggatagtataaagttcttatgtgtcattttaaaaggtttcaatgtatatctagtaaatcaacactataaaataaagtatttgttaatagaagaaaatcatcttgacaaatgagtcatggaaagaaaatttaaagaatattaagtattttggtaacagataataatagatttaaaaaaaacctgtaaaaggaaatttcctttttcaaatgcaaatgaaactgtaaaactcaggacagttagtaattagtgcctctgttttacttctgcctagctcagttggtaatgccttacaggactggtttatgctccaccactcgttgaaagtgtttttgttaatttcactaatgacattaccttcctatccctcaataaagcaatagctttttcttataccgcatcttcttctgcatctgtacagcactggaaatttttatccctcctcccttggcttcccttatattgtactttctcctccccttttctaactgaaactaacttctttcctctctttctaccctctaaatgtgacattcctaagtcttatccttgttctcttgctttctgtacactctttctcttgcttatctcattccatagcttcagctattgtgtctctattaacctaccagatttctatttttagatgcaaacattttagccatgtatttccagataacttctagatctttcttttgcatgtcctcaaactcagtgcatctaaaattgaatttattttcattttgtcaagttacctctttctcttaacttgccttttttcatttttataccaccatccttttagtcacc

SEQ ID NO: 34817 - DNA, 1025 bp, Homo sapiens
tgctctagggtgcatgtccagcctattttacttactcctttcccttaagtaaaatgtgtatgtcaattggctggaaagatgaagatcttgtgctagactgttaagagttatatctgaccggtcatggtggctcacacctgtaatcccagcactttgggaggctgaggcaggcggatcaccagagttgaggagttcgagaccagcctgaccaatatggtgaaaccccatctctactaaaaatagataaattagctggcttgtggtggtctgggcctgtaatcccagctactcaggaggctgaggcaggagaatcacctgaacctgggaggcggaggttgcaatgagatgagatcgtgccactgcactccagcctgggccacagagggagaccctgtctcaaaaaaagagagagagagagagatcttacgttgttctattagctggacgacaaataatttttggaagaatattgttaacaacaatagtaaaacagcctaataaagcatcagcctgcatcttctaaactatattggattcacccttctagtagtcagcaaggcttttcctgtagtataacccttaattcttggcgttgcctagtccccgccaccaccccctgccctttttttggtagtttgtcttattttctaccttttgataattaagccatacttactgggtgccttataaggctcagatctggccttttgaactttttactcttaacaattctttttgaattcactgaaatttgccctattacttttatactgttcttcctcttctagtgatagaatcagcctcacttcttaccatgaagataaatatgtctgttggaccagagaaatgtacttaggtggtctttaaattctcttctacctctaaaattctgtagttctgtgttccatctgctgatactacctcagacacttaaaatcacaacttttcatcctggtgttagtcctttttattttattatttctatctttgactctgtcactcattttcttttaagaactcttagc

SEQ ID NO: 34818 - DNA, 1049 bp, Homo sapiens
aggcaaggaaacattctctgctagagcttacaggagggaattcagccctgccaacacctcggttttagcccaccttgattttagcccagtgagacctatattgggctctcaccaacagaactgtaagatagtaaatttgtgttgttttaatccattaactttgtgataatttttatagaggccataggaagcacatagtacctcttcagtttttcactaataacataaagtttatatcatgattagttgaatcttgatgtgaatgacaatatgattttctgtgaaggtcaattccagtttattgtattaagatatttatgttgataatatattgggtactggtggacaaacctttgttttacgtagaggtctttattttctactatctaggaatggtgacgtgattccttagtgtagctggagaataaggagtctgtgtacagtaaagtagaatgggaaatgaggaaggagaaataagactaaagctagaaaggaaaattggtgtcttggaatgtgataaataatcttcagaagccttagagccctgaacaagtttttcattatttgcattatatgtgtttgtgttagtaaatactgtaaattggaattttaaaaagtttttatagtcagcacaacttgaactatattaaagtggtaagcaatcattacattttgccacagaatagcttatcaatatgataagtgtataaaggactcagtggtcaaaaggaaggctagagtttagagaaacatgaaaaagaatgaagcatttctcatagaaggtaattaacaacataaccaatcattgactgtcactatgtttagtcttcccgaccatgtcaaataaacttgctttactcccttgtgcctttactaggaagagaaactgaggctccaacaaagattatgagctggcacagttttttttttctttttaaagacccaacataaataagttagagctatattgtcagtttttttgtttttgttttttgattgtttcttttttttttgagacgacctctcgctctgtcacctaggatggagtg

SEQ ID NO: 34819 - DNA, 1102 bp, Homo sapiens
ccctaggcatggtggtgcatgcctgtagtctcggctgctgaggaggctgaggcaggaggatcacttgaacccaggagatcgaggctgcagtgagctgagattgtgccactgcactccagcctgggtgacagaataagaccctgtctcaaaaacaagcgcaaaaacagacaaacaaacagaaacactggagaacgatcggcttacaaactcaccacagtgcatactcctaatgaaataatgattctagataacaattagtcgtgactactaaagccattaggtgaaatttaattgggaaatggataaaacataatggataggcaaaagtggagtaagcctctctgattagaacttaaaaccccggttaggccgatgctatggctcatgcctttaatcccagcaatttgggaggtcacggcaggaggattgcttgagcccaggagttagagaccagcctgggcaacataatgagatcttgtctctgcaaaaaattaaaaagttaaaaatcaatagggcatgatggtgtgtacctgtaatcccagctacattgggaggctgaggcagggaattgcttgagcccaggaggtcgaggctgcagtgagctgtgttcacaccactgcactgcagccttggtgagagagtgaggccctatctcaaaacacaccactccccccaaacaaaacaaaaacaacaacaaaaaccctctagatagaaacaaaaacaattatctgaagactttcgaaagtaaacagtaataggcaaactgagaagggaagtcaaaacctgaatagcttgtgtagtgcttagcttaccattttttttttctttttgttatccagctttaaccaaatggtaggctgggttgtagaagtacatgttgagtgcagcagttagcaaaaactccaagagaaaccctttatttctagtcataggacaaagaaaattcccccctttttttctctcccagctgtgccctgagaccatctccatttgtaaaattacattgccatagtggtatatgtacttaaaatcccaagaagaaagccgtctctctggccagaggaattgggaaagagaactctggaagctggagcatgctttg

SEQ ID NO: 34820 - DNA, 1029 bp, Homo sapiens
gaggctgaggcatgagaattacttgaacccaggaggtggaggttgcagtgagccaagattgtgccactgcattccagcttgggtgatagagcaagaatctctctgtctcaaaaaaaataaaataaaataaaagggaatactatgcagccataaaaaaggatgagttcatgtcctctgtagggacatggatgaagctggaaaccatcattctcagcaaactgtcacagggacaaaaaaccaaacaccacatgttctcactcataggtgggaattgaacaatgagaacacttggacacgggaaggggaacatcacacaccggggcctgtcatgggcttgggggaggggggagggatagcattaggagatatacctaatgtaaatgacgagttaatgggtgcagcacacaaacatggcacatgtatgcatatgtaacaaacctgcacattgtgcacatgtaccctagaacttaaagtataataaaaaaaagaaaaaaggaagttcatctgatggtcttgaatgcttctgtagaaaaagaaaccaaactgtatttgtgtatgatgtgaattggttttgcccaatacagtcttcagcaaattttccatgacttaggagatacttccttaatattctctatatgtattctaaattgatattttattaaaattttgagtggagcatataatcccattagtgctgggaagcaggaaaaagtaggtcactttgctttattcttcaaaaccaattaactgtagagttcatgaacaattgaatacttggaagtgctacatcttaatgaattttccaaatacatattaaagtgtacaaccatgttaattttcttttcttttctttttgtgtaggatcccaatgaagatacagaatggaatgacattttaagagatttcggcattcttcctcctaaagaagagtcaaaagatgaaattgaagaaatggttttacgtttacagaaagaagcaatgggtatggtcgtagatttggtgggctggatgatgggaataatacagtta

SEQ ID NO: 34821 - DNA, 1049 bp, Homo sapiens
tgaaagcaataactctcctatttcacaatgatttcatctctcttcacatcaaccctaggtgatgtttttattctcaccttatgaacgagaatactgcggctcaaaattcaagagtcttgcccagagttttttggcaagtacgaaagggttatggctccaaactggttagctccgaagtccttgcaaaccctgtccgagaccatgcgcgaccccaaggagcgcctgagcagataaccaaaagtgaaaaagcctatagacctcttcactcaagttagcgcctcggcttcaggagaggcagcgccagctccacgcagccggcccggggtcgctcgcactgacgtcacgtagcgacgcggaagatttacgtatggtgcctcgctctgggatagctttacggcttctgggagctgctgcttcgctgtgagaagtatccgcgacgagctatccgggaaagggccgaatgcgatcaaacctaatccgcgagacttgctaagtgagtcgcggcagggcgcggtgtccggcgggggtctgtgtgaaggaggcgaagtgccgctaggcctgagcctgcttccacatacatttgctcagcttcaggaccactgcctgacctcggatttgatacatcggggtctggcgtgctggtgtggtgcagactaaccctgacctgtgtgtacactcctgcgtcactagcctccgcccctccattcaaatggaaataagtgtgctccgcgctcagctaccccctagagtggtttcgaagagcaatgaagaaatgtttaggaagctgtaaattgcattgttactcgttgcataccgtaaatttagaagccggggaattgggaaaataaagtttctagattatttatccatttttaaaacagccagtggcctagagagaggccccatagcaattgaatttgctgacactcttaagatctttgttgactaaatagcagcttctacagttgtagcaagtaaatttattccttttacatgtaaaatctgcttaccagagtttgcttttttttttccttttttttttttttttt

SEQ ID NO: 34822 - DNA, 1024 bp, Homo sapiens
tgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatt

SEQ ID NO: 34823 - DNA, 1047 bp, Homo sapiens
taatttcatcatttattgcaatagtgaaaaagaataaagtcaaagaacctggaaatggcatatctccctgttggtgaatataatttagtaaattgatatatcagtgtgatgaaatatgatgcagccattaaatactaagaagactgcgtagcaaaaatgggaaaatctattctaataaagtttaaaaaggaaatgtggacactgagtatagccatgtaaacgtacctgatgaaaggcaaaaaaaacaataacagacaaaaacaactctgttgtagtagtaaggtttttgttataacctggtaaattgtatttttctttttaaaatggtaagataagggataagcagaagtacctggtattacaagagaaaagtggctctaggaatgtaaagacatcaaatgagaagtaggatatctagacaaagaaacttcctcatgattaggtgaaagaaaaaaaaaaccaagaagcagctttgtagaaagaataatttattacccatatgttgttactgaatattctgcaaaacaattttgtattgtatttgcacaatgaaagaattttgcatagtcttaaaaaccttgtgtgcaatgatttctttccaaggtacacattcgagtagcttcaccaccaattaaatatccatgcttcatgggaataaacattcctacaaaagaagagctcattgccaataaaccagaatttgatcaccttgcagaatatctaggtaagtattaaaatttctataaactttgattattaacagagaaaatccaaagcttgacagtctttacacctttagtaaaaaggagtattcagtgtttgttaaaagtagttatatatgttaaacagatattgaatactattctcaacagtgagagtagtgggcatgggcagacaccacagagtcttgtgttggagagctaagccaaggtgagatcagagaaggaagaggtggtttccaggtggagggaagtgcaatcataatcacttaaagcctcccaaaagtcagatcccaagaaaaacaaaaataatttaatcagattctaa

SEQ ID NO: 34824 - DNA, 1049 bp, Homo sapiens
agaaaaaaacgttcactaaagcgttcagaaattggcacccttctttttaaaaagataacatcatgaatatacagttgacccttgaacaatttgggagttaaaggtgccaaccctctgcacagtcaaatctgtgtatgcattttaatgcccccaaacttaaatactgataacctactgttgactggaagcctgaccaataacataaacagttgattaacatattttgtatatgtattatatgctgtattcttgcaataacgtaagctagagaaaagtaaatgctttgaagaaaatcataaggaggagaaaatatatttactattccttatgtgaaagtggatcttcataaaggtcttcatcctcattgttgtcttcacgttgagtaggctgaggagggaagaggaaaaggggctggacttgctgtcccaggggtggcagagatggaagaaaacccacctataagtagactcatgtacttcaaacccatggtgttcatcaactatatattcagtggaaaaatttacttaatattaaaataaacgtcttgaattatcttcacaagtcactggaatatttgcttgctactaagtatgggtaataataaagctgtttatgttcatttagcatgatgttgtcagtgttacgctttattttcataaccaggtagatggtgtaactgtagtaatcctggggtataacatccaatattcactaccttggatactttattaacttctaaaagaattaatatgcatacattttagaaaagattaccttgataaatgggttaattacttcctatccctaaaaagtatctcattggtctactggtttttatttatttattttaattcatttctttaaaaattatcattttgataatgaatttttctgacagtgatttaatctttgtcatgtcttcatatgcttactgttatctttcaaaacagaggaataatgtttaagacaaaaacattatgagtcctcacaaaatgaattggtttttccaccaagtatattttgtttagtggtttttctttttgcctttt

SEQ ID NO: 34825 - DNA, 1081 bp, Homo sapiens
agttattgataatagccgaaaggcagaaacaacccagataaccatcgatggatgaataaacaaaatggtgtatccatacaatggaatattaaaatgaaggaaattctgataaatgctacaacatggaggagccctaaagatattataagtgaaataagccaggcacaaatggacgaatattgtatgattccacttatatgaggtacctagaatagtcaaattcacaaagatggaaaggagaatagtggtcaccacaggctaaggagagttgggatggaggagttattgtttaatggctacagaagtttcagtttggaatgatgaaaaagctctggagatggagagtggtgatgtttgcacaacaacgtgaacgtacttatgggtataatggtaaatattttatgtatattttaccaaaatgggaaaaaaattgtaccagaatgttcatagcaacagtattcataggagccagaaaatggcagtgacccaaatgtctgtcagttgataagtgggaaaacaaaatatggtatatctgtaaattggaatattattcagccataaaaaggaatgaaatactgatatatgctacaacgtggatgaaccgtgaaacaaaagaagccagacacaaaaatgtatattggagggtaccactcatgtccagaataggcaaattcttagaaacagaaagttggttagtggttgtcaggggttacagaggtgtggtcaagcagttaaactactgatggatatggggtttctttcttttttttttttgagacagagtcttgctcagtcgcccaggctggagtgcagtggtgtgaccacggctcactgcaacctccgcctcctgggttcaagtgattctcctgcctcagcctcccgagtagctgagaccacaggtgcgcggccaccacgcccagctaatttttgtatttttagtagagatggggtttcaccatgttggccaggatggtcttgatctcttgacctcgtgttctgcctgccttggcctcccacagtgttgggattacaggcgttagccaccgtgcctggcagatacgggatttctttgtggggtgat

SEQ ID NO: 34826 - DNA, 1030 bp, Homo sapiens
gagaattatctattgtgattgtcctttttggcaaaaaggaaggtaggaaaaacgctgcatctcattatttatttatttatttatttatttatttatttatttatttattttgagacagagtttcactcttgttgcccaggctggagtgcaatggtgagaccttggctcacggcaaccttcgcctccctgattcaagtgattctcctgcctgagcttcccgagtagctgggattacaggcgcccaccaccacgcgggctaatttttgtatttttagtagagacagggtttcaccatgttggcaggctggtcttgaactcctgacctcagctgatctgcccgcctcagcctcccaaagtgctgggattacaagcatgagccaccgtgcccggcctgcatctcgctttttaacttgtaagtgggactaagaactccaggggacaaagtggatggtggaaatttttccccaattttcgtgtgcttaagaggacacttgttagcgcgtttgttggtctgtggatctgtctcttgcttcaacgatgtttggataaaacggacctgggactccctttcttctagcctctgactgccctcccatctcctctccacctgcaacctccagaatcaccttctccaccatctcctgcttctggggctgttgcaggacttttccttagttcagctaaagatggagtcattgtcccacagccacgagagtttaggcttgaagacggtttgaagggtgagtaaagcagagctttattgggtgaaaaggaaaaaagaggggaacagggactctccgaaaggccgcagttcctcttggtgctcttcctgcctcgcagtttgaatcccaggttccacacaggaagaggaggggccaggctcttccgtgctgcaaactgcgtgaacttctcaaggctccaccctagcgcacaggctagttggagtttttctggtaacccttcccacctgactgtgttaggaccagccacaccatttttgtggttagctccctattgctgaccgaccaac

SEQ ID NO: 34827 - DNA, 1055 bp, Homo sapiens
cctacccgagcggctgccagctgcgcgccgccagccagagggccgagagccgcggggagaaggccatcacccaggtcagcaagggcacctgcgagcaaggtgggcacgagcgcttccctctccaaccctgcgccgctcggcccagcgaagggcacatccgacggggcgtccgcggcggcctcgccccgcgctgctcactgcgattcccccgcgggcatcccaggagccagatgggagggaaagagttggcagccgcggaatgccaggagcggtgggcgacgcccccccttctcctttttggtggttttattttgagagtttgctgcgtgcgtccagaaagtgagggccgggtgtatatgtagaaaagattttccgagacctcagacttccccatgcccaaagcgcacccaactcgtgctaacatctgtccatttctcatcattcttggcttggggatgtagagagaggtgaagtcaagagatgggggaaaggagtttgacaattaaatataaagtaaggacttccagacagacttttttttttaaaagataggatcttgctctgtcgcccagggtggagggcagtggcacgatcttggcccactgcaacctctgcctcaagcgatcctcctgcctcagcctcccaagtagctgggactataagcctgtgccaccacgcctggccaatttttggttttttgttttgttttgttttgttttatagcgacggagtttcactatgttgcctaggctggtctcgaactcctgagctcaagtaatcccggcctgctgggattacaggcataaaccaccgtgcacagccctgatttcttagtattgaagaaaatagtccactttctaaaaattataggttctcaaacagtaatctaactagctaattatttgtgggcaaaaataaaatacaaactctttgaagactgtttttgtgatgcactttgttgtcaaccttctgaccattttgtttttccttcctatttctttgatttgtattgttttgcataatttgtccccaggatacactgttcagcagaaatg

SEQ ID NO: 34828 - DNA, 1057 bp, Homo sapiens
agtgggaaggaatgtatcttgtggtttgactgccaattcatccactgtatgataaaacaccagtttgagttctaaggcttttgactccagtccttgagtcccagaaattacctttagacttgcctagcatcttgggagaactcgctgccctgaagggtaaaacacaagcctagctggctatgaaacctgctgattgtagagccccaggtgctgactgtagtgccccagggccttggagaaacatacgcagtaggcacgcagttgttacagtaagccttggataaaacccagtgctgtactggctttaggtctgacccagagcagtcccagtggtgatggccacagtggtgcttgtgtcactctactcccagcttcaagtatctcagaacagagaaagaggctctgtttggtagaaagtaattgaagagaacaagagtttctgcctggcaatcctgagaattcttctggatcttatccaagatcggcaaggcagtacctctacaagtcaacaagagtttcggcctggcaatccagagaactcttctggatcttatccaagatcggcaaggcagtacctctacaagtctgcaagaaccaaagtgttactgaccttggggtgcccctgatgcagatatggcttagatcacaacacctaactccttttgaacatctgaaaagccttcctgatatggtttggctatgtccccaacccaaatctcatcttcaaatgtaactcccacaattcccatctgtcatgggaggaacctggtgggaggtgatttaattatgggagtggttctttcctgcactgttctcgtgatagtgaatgagtctcatgagatcaaacgttttttaaaacaagaatttccctgcacaagctctcggtttttgcctgctgccattcatgtaagatgtgacttgcccctccttgccttctgccatgagtgtgaggcttcccaagccatgtggaactgtaagtccattaaacctctttcttttgtaaattgcccagtcttgggtatgtcttgttttttttttttttttgtttttttctgag

SEQ ID NO: 34829 - DNA, 1034 bp, Homo sapiens
accccctgtctgccattacctgttttgctgccataacatattatgccataatccaagtccctaattatttttgttatcccaagatggtatataaggttctgcaccttactgagggttaagtaatctcacgttgaggttacctgtgtacatgttaataaattttatattgtttttctttaattaatttgccttgtgtgaattgatttttcaacaaacctttagagaacaaagaggtgtttttttttcttttttttgactcctacagtttctatgtgtcttttagtagaatacaaaaaaaagtaaacaaatattcattttttataaatatattttacttcactgttctttacatagcagttagttgcattttaaaagaaattgtgagtattgctatttatttaataatacagttaacagagctaaggaggaaattagagcaataataaatgtgttatcagtgaaataattgctccattgtggcttcctcattaaagaccataagtcaatgagctgtgaaaaaaaaaaaaaaaaaaaaaaaaaagaatcactatgcattcttttttgttttcagttacctgaagcaccttttttaaaaaaacactttctatgtaccttttcttttttctttgtttttagtgagtcttttatatgccatataattatgtcttctttgtgagtcaaaataaaaatctttttttttaaacaggtgagttaagctcattctaacttattattatgaatcataagtttttttctcaactctgtaataatatgttatcattttaaaacttttatttgctacatttaattttctaaaaatgtgtattttttctttatttgtgtatttgcttgttgtatttagaaagttttgtatttcttcaagttctttactttttacttatgttttaatgtctttaaatgtttaatgacttactttatcagtttattgtgatatcctataatacacatttgcttatataaaaataaacttttccattttcttttttctattgccaaaatatatttattttaaa

SEQ ID NO: 34830 - DNA, 1050 bp, Homo sapiens
tttccacctagtatcctagatctttatttctgctctgtgaaatatagattcttctcttcttgtttctccatgctattgctataaattgagcagcagagtgtattaaaatatttatttatgctaaaatattcataaaatgtttgggcttttttagagattcagattagagttttccaatttgtttgtttgcttctggagggactttggaaggtcagggggcagaaagatttcatgtatatgctgaactcattaatcactttttctcatataatttgacttctgcaatctatagatgcttagtgatttcccaaagactgtgtgtgtatgtgtgtgtgtgcgtattatgaatgctcccattatgtgaaaaaaagttttaaaacatacagaataaatgtaagtgtatattcatagctgctattctagtcatttcttaaatttaactttgttagatataaccaagcagaattgaatagaaaaagccaaacatatatctggaattttggactgatatgaaatgtgtttatttggcatgtttgaatatgttggatagcagacaataagaggaaaatttaccctttagtctaaattctaagcaatttataagataaatatatccttagtagttttagtatattagtcataaactacatgtgaaaggaatatttgatctacagtataatattcaaaacttttttattataaaagatttcagaggtatatttagaaacagacttgtctctgatcaagcaggacaaatattagcaagtgtatctgcaagtgaaaatttaaataaatttagtaagtaaagggttcatgtccactgctatgaattttggaggtggccctgaacttattcagtagctgccactttttgctgtctggagatatatttgtaaacaagcattatttgacaagtgcttttcacagcagggattcttggccaattactgctgaacagccctgcattgaaaatgattcacccgcagtgaatcaagcttaattcattgaagctacagtcagtaatgtcccagtaaagtgcttctgacagtt

SEQ ID NO: 34831 - DNA, 1090 bp, Homo sapiens
agagagagtgtgactctaccccacatgcaagcctgaacctggagggcactcttcctgtggggatgcagtcaccctgacgtgttccagaaaggctgtctaaaggtgcacccacatgaagctcccatgggagaagccccagctctgtctgcagtggtagattaagggggaaaagaagtctctgctctgttgcccaggctagagtgtagtggcgtgatcttggctcactgcatcctctgcctcctgggttcaagcagttctcctgcctcagcctcccgagtagctgagattacaggtgcccgctaccatgcccagctaatttttatatttttagtagagacggggtttcatcatattagccaggctggtctcgaattcctgacctcatgatctgcccaactcagcctcccaaagaggtgggattacaggcataagccactgcgcccggctagaagtctctttctttaagacccttcatgagcatgagggctgcctgacaaagtagagctacagactttctacgctaagcccagcaccgcacctgtgcttcccacaaatgaaggttctggaactcaaggcctgccatctggattcttttgtcatacgggatgctcccttgatacggtatactcccctttccttcagtagtgggagtccctgagagccagactactgtgaatgctctgctggggctagccacccagtggggctgccacactccaggctggtgcaggggaatgtctgcaaggaatccagtgatatgagctgtcctcaaattttccagcagtggctcccagggccagctgtggtgggggtggcaggggagtgacataggctctgagactccttggttataaatagccttagtgtgtttgctttctcagaggccagttgcagtagttacgaactggtcacatggacagactcaggacctcctgcttagccaggatggtacaggcaatggtgatagctgaagtcacacacaggtttctcccttccttggcactgtgttattctacctagacgtgctgtaatggactgtgttggttggcctccagctaggaggtggtgcttgccaaagagtgccagctgc

SEQ ID NO: 34832 - DNA, 1033 bp, Homo sapiens
tatgctttttggttcatattttctgttggaggcagtgtccttcgccattgctttctgtatgtggcctcaactttccctttttaatatcaatcaatacatctaagctaaaaattctaatcaaggtttttggtatggttagcatataattctcattaactctgaagaaattgatgttttacggtaaaaatatttttaggccaactcccttttcaggtcttatttaaccattaaatacacacatttaaagcaactctggtgtaggacttaggaagaatgaagtgtgatggctctttttttatactttataattttctattgtgatttctcttttattgagtcatttttaattttttttttacttttatttctttgaatatatttgttatgaagtcttattgaaggcttgactaatcaagtatctgggcccatacagatttagttttcactgaatgctttttttcctttagtatatttcactttcatatgtttttacatgtctaataatttttggttgacagctggacattttaggtagcatattgtagcaactcaattttgttttatatctaagggatttgtattgttttaaatttagcattttgactggactcaaattgtggaatctatcttatatatgatgtgaagttattgctgtctgtgctcagtttttaagttctttatttcaatatttattcttgcttgctaggggtagttcctgtgtctgcatagcttagcagtcagccaatcatttggacaaaggttaagatcaaacacttgagtctataagccttccacccactgttggttgttctgtgtgggatgggggatgcattcattgtaggaggcagttcccaaattccccttggtttttacatttgccatgctctcttgagtctcccctgtgcatgcatcatttcagtttgccaaagatgtttggagagctcatgttacccttttctgcccttctgtttccaggaccttgttaaatgtctggctgctctgttgctcttcaagaactaggactgtaaccttt

SEQ ID NO: 34833 - DNA, 1013 bp, Homo sapiens
tttccacatgctgttctgtccatctgagtgggagctgcaagttagtcctactttctatcctccactttttcctgtatgtgctatacttttatgtgactggcagttcagtagatttatttacatcagcatcaccacaaacatgtgagtaatgcttttcactgggacatcatgatggctgtgaggtcactaggcaatacgattttttaaatgccattgtaaccttataggaccactatcatgtaggcagtttgctgttgactgaaacatcgttaggcagtgcatgactgtatcacaaatttaatggcttaatactcttgggctgggcgcggtggctcacacctgtaatcccagcactttgggaggccgaggcgggcagatcaccaggtcaggagatcgagaccatggtgaaaccccgtctctactaaaaatacaaaaaaaaattagccaggcgcgatggcgggcgcctgtagtcccagctactcaggaggctgaggctggagaatggcatgaaccctggaggcggagcttgcagtgagccgagatcgcctcactgtactccagcctggatgacagagtgagactccatctcaaaaaacaagaaacaatactcttgtattatctatctcacagttatgtagagagaaccatgagcttgaccaggtattctctttagagtattacaagactggaatcaagatgttgacaggtttgtatttctttctggaggctgtaaggacgaatctgcttccagtctgcttccagtctcgttcagactgttggcagaactcagttttaagtggttgtgggactgaggttcccatttcctcactggctgttggccagggtgtcattcttagattttagaaataactcatgtttcttggcatatggccccacatctttagtgccagcaacggtgcaagtccctttcatgcttcaaatttctgtgactgttccttctctttcgtttcttctctgcttccagcaggagaaagtactctatttttaagggc

SEQ ID NO: 34834 - DNA, 1035 bp, Homo sapiens
tatgcccaagctatggttaacatagacatttctaaagtgttttatatacctctatctcacttagagattatgcaaaacatcacttaataccttgataatgcaagagtttacatgttaaggcttacagaaaataggaagtttagggtgtttgcttttatattaaatcattatgggtttttaagtttgaatttttgtttatcagagtgatttataaataggaagagacttctttgcgtttgacagttttataacttctctatagctatattttgtactgaactttttgggattgagaataattttaagtaagtagtttgtatttcaatggtatttcttttgcagagactaacttaatggtaaatctaggtatacctcttggagatcctttgcagccaacgagggtaaaggacccagaaacaagagagattattctcatgggtaagatcaggcatgatactgaaaatacttaattaaacaatttgtaagaaaatattgcttgcttgatgattggcctgtctactttccctttctctccccaattctatcagtgctaaagtccagaagagtctaattccaacgagcaacctatgtgaagacaactgtgggggaatattgatatcagacagctccaggggacacttaacaccccggacttgtcctctggggcacaagtagtgctacaatcaggaatgtcgtctcccccaacagggtctaggccttctttgaccaggaggacacatgggaacagaggctgtttatggggaattgtagatagatagttggcagactcaaggatacgcttatcatgaagccaggcagggattgtgggtagggcacagacaaacttctgggcctacagatggcagtaatgttacctgggatatgaatcctttgtgaggatgactagcaagggcatcaatcagttgtacagatgccaggtttaaccttaaagctggtgctgcaaagtcctggaagcctcctgctgtattggattaaatatttagtctctagcaggtcatgtaagatccccaaggg

SEQ ID NO: 34835 - DNA, 1045 bp, Homo sapiens
aagagcgatgggaagccattagagggttttgagcagaagagagacatgacttgacctgtattaacagaatcactgcagctcctgtgttaggagttgactgatggggttgaagggatggaggaaggttggaagcaaggagactagctggagagatgttgaaataatcctagtgagaggtgttggcttagaccaatgtggtagcagtagaaagtggaaagcaggaggaggatttttaggtatttttgagggtaaagtcaacaggattttctgatggacgatacgtggtgtataagaaaaagagaggcgttagagagaacttgaaggtttttggcccgagctcctggaagaatggcaatattactacctgatctggggactactggggaagaagcagattttgaggaaaagaacaggatgttagatttggacatactaagcttgatgttctcaacctatgtattctttttatttgagatctattaaggactgctagagttgaagtaaagtgttcccactgcaactgtctttgcccttgtattttctgtagtctttgttatgtacatttcagtgctgttactgatcacataagccttcatatggagtgtacctgctttggtcaaatttatctgcttcgttgtgttaaatgctttttactttgtagtttgttttgtctaatattagtattgtgacttctgctttcttttggttggttgttgtttctttatctttttatttaacttttattagagaattaaaagtggctaagaaacagcatatgattgaattgtttttgactcgctgtgtcagtactttttcctttaataaattgtttaatatatatacacttattgtcaacagatatacttgttacttctttgtaaagttggtagacattctcacatattctagcaaggactcaggattttttttttctttttaaacacaatgaaccaccagctaaatagagaacataatcttgagtcatgatctttttttctttaaactatcaccgtattgctattttgcttcatgagagttaatgctt

SEQ ID NO: 34836 - DNA, 1046 bp, Homo sapiens
atacagtcactaggaagagtgtatcttgtttgcatatatttggagtaaactaactaccaaagagatgagctcagtccctctgaggaccctattgcccctcagtaggctgactagggatatcaaagaagccaattttagttgtttatggattctccagtaaaccatgatagattaactgtaatatatatcaagctgcttatagataaggtctccttatgtccctttcaccaccttccttggcaggtgtcttctccatttctctcatcagaatttttcaaattgggactcttggtaggtcctagaaaccagtttccttccttagctagttgcaagtctcagaacctgaacagggtgatctgatattcgttatagccaatattacattgtctttgtacccacctgtgtatcgtttctggaagaaaattttattttgaagaagtataaacactcatacatttatcatttttatagatctacaagaagctcaaagaatgaagataacattatgactgcacagaatgttcccctaaagcctcagaccagtggatatacatgtaatataccaacagagtcaaacttggattctggagagcataagacttcagttttagaggaaaggtatgcgtgtattgtaaggataatagttgtatatattagttacccattgctgtataacagattacccaagaactttattttaattttgttaaaagcttaaaaacacttattgtttcatagtttctatggctcagcaatctgggaggcttagctagctagttttggctcggatattctcaggaggtagcagtcatctttctggttttaaccctttaaagtcttgtctggaactggagaatccacctataaaatgtctcacatcgctgttggctggagaccccagttccgttctggctgtttccagtagaccttagtttcttaaccatgtggccctctcagctgctgaatatggcaactggcttcccacaaagcaaatgctccaagagaaggtgtgactatgatggatatcacagtgtcttttaatgact

SEQ ID NO: 34837 - DNA, 1029 bp, Homo sapiens
cacctgtgactaattcatcaccagttttctatgacaaacgtctaagtataaatgtcttagtatgcatagacacattaatttatcattttcagctttgctgtccctgctcttttttttttcttcaatctacccttagacctatcacataggttttgtcatgtactctctctgtatcacagagagtccctttgcttttctcctgaattgcaactcttatttcttggatctgaaatcttccttttttcttggcctctccttttttggtgggactcatcctttagtagctttctgagaatttgagaccttaattgtttaaaaataccatggttttaccttcatgatgggtaatttgggtgagtacagaattctagattagaaattattttcctttaattaaaaaataatatatattttttcatatcaagcctcccttttagtcaggtgtattttcccttagacttacaaatgttgctttcttttattttagcttctcctgttgagaatactgttgtgattccatgatcctttgtgactatttttttcctctttgcaggcttttaggatcatgtcatctgtctttagtgatctaaatttttattatattccttgacattaggttcatctaacccttttcataaatatttcttcagtttctgttttctgcaagtaccttttttacttactttgctcattacctcgcctttttcatatgtccagtgatccttagctgtctcctcttgtttgaaagtgggaaactaaaacacattggaagctctatatgcctagtaaaatttgtagactggtggatgtcactgtggtgtagtttggtccatttcatcattggtatcctggtgttaatatctgtagatttcttttctcttggcctagtaagtatttctgacaaagaaatctttcccgcttggcggttcaagtctaactgcgattgttttcaatttcagtcagatgtggcaaaggggaaagtgcagtttaaatgctcctacttaatatctctggttttcatgtattgcc

SEQ ID NO: 34838 - DNA, 1024 bp, Homo sapiens
aaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcat

SEQ ID NO: 34839 - DNA, 1032 bp, Homo sapiens
taactgttaacatgtatagagtaggttgaaagtttgaaagtataaaatatactaaaagtatacagacctgtaataagaaatttatattactatagtcccatagctgcttttactatccacagagaaatgcttgaaaacgtgaaagttgaatagatgcaattaaaatcacggatagttttaggctgtttatattatcagatcaccttcttttatctaggttgccttggagatgatcaaagtaactggtggctatccatttgaagcttacaaaaattgttttcttaacttagccattccaattgtagtatttacagagacaactgaagtaaggaaaactaaaatcaggtatgtatgaaagtctatttctcttgtataatgagaatgaaataaaatattttaccttttaaaagggaaaaatactagcttcacctcttttttcttctattgtgtatgtgtaaatttttgccatcacttcaagatcagctcaaacctcatcttcattaaatatttctgactaaagtagccaaagaacccttacagcactttatctgccacattatttggcattatggtttcatctgtgtctgccagatgaattagaaggtaccctggtgtctgactgtaggtcatgagatttagaagaattccacaagcttgagacaaagcagaacaattcctgggcctgtactttttagttttcagattggcaacaaccaaaaacttgaaaaaaaacctaccttaacaagggtgtgagaaagcagacactctcatacattactaatgagagtacaaaatactataatccacagtaagggatatatagcactatatttcagatacatttgcacaagtctcaaactatatatttgcaagataattattctggcattatttatcgtggccaatgattagaataaccgaagtgtccagtaatggggtactggaacatccacacagtgaaacccattttaaaaagagagagacaacactgtcttgctaaaacatactgatttataatacactggaaggatc

SEQ ID NO: 34840 - DNA, 1049 bp, Homo sapiens
cacataaaaaattactaaatattagctgttattcttacctccagttaaatatagttgctggaatgtgtgttgccttctctttagtctttccctctctttaggatcttaagttcatcttccttagaaacaactttaaaaaaaaacaaaaaaacagggtttccctatgttttccagtctggcctggaactcctgggctcaagtgatccctgcctcagcccttaagtagctgaggctgcatgtgcacgccaccacaccccacttaaaaaatatttcgtttatacttcttctttttactttcaacagagctctacttcttggaaaagtggtctgtactactcaatgttaccacttctttacccagtaaatttgacttctttgctcattactcttcagattgttcttaacatggttatcaatgacccgtttcaaaaatctaaggaactctttagttcttatcttctgtgcattttttttaaactttttttataatgaaaaatattcagccatagaaatgtagaggaaatagtataatgaaccctaatgtaattgtcaattacctatcacccagggttagcagttatcaattcatagataaatcttgtttcatcaccattcccgttcattcttaccttcccccaggtgattttgaagcaaatctcaaacatgtatcaatttcaaaaatacaaagtactgtgtgttttttctggttttgttatttaagtactagctctttaaaaagaacagaatgacatgtaaaatatgccatttatataaaaaggagtgaagtaatctacatttgtttgctgtagataccacctcccaataaacctacaaatagtgatagaaaatgatatttgaatttttcatttatgagggacattgacaggagaatggacagatggaatacaagggtggtagggagacttcactgtgtctcttttaatgtgttttgatttttgaatcatgtgcatatatttactacacacattttttaattttattttttaatttttcctcagataatattaagtagtgggtgtctttaattc

SEQ ID NO: 34841 - DNA, 1080 bp, Homo sapiens
atttatttttggatttttaataggcttaaagctcaaaactagattaaatcaataaaaattggtcattgcttccccttaagtacctgttgtcatattttataaattagcgggatcccccagaagaggaaataccattttgtactctaaaatcctttccagctgctattgaacataccatacagtgggcaagagataaggtaaaagttcctttttaaatttattttctttgaagtgagaaagaagatatttctgactttaaacagacttctatttgtaattttttttttcttttctctgttacagtttgaaagttccttttcccacaaaccttcattgtttaacaaattttggcaaacctattcatctgcagaagaagtcttacaggtaaaaatcagtaaattttaatacaaacttaacactttgtgtcagtgtaatcttattttcaagtcatctacaagtgatttattttacctccataaagagtgattgtatataaaaaatgaaatgatacataaggaatcttgaaattaggtcacaaattatcattttggttgtttgaactacatggaattgtcgatatttgagcatgttcgactcacaaaacagcaattcgtatggtgcgagctaataaagatatgataattatgatagaagggctacaaataataaaagggcttttattaagccctttggaaagaaaaaattgaggtaagttctagttaaaatttcatgagggaacaataatctccaagacttattactcttatagtgaaggcaactttaaagatgttttctcactttcttttaatcttttgctaacaaggcccactttttagtatcaaatattcatagcacttatagtgagtacatatattatagtactaataacttacagctaggaaaatatgaggataacttgtaagataagaaatcagagttaaaattttgtatgctatctcttaccattccccttctcaaacagaaaagaaaagaaaggttaaagaagaaggaagggaaaaggagcttgaggtgaaaaaagaaaagcataaaacacatgagttgacacttcaaacttaggct

SEQ ID NO: 34842 - DNA, 1033 bp, Homo sapiens
ttccctttgtgggtaacccaatctctctctctggctgcctttaacattttttccttcattttatccttggtgaatctgacaattatgtgtcttggggttgctcttctcgaggagtatctttgtgttgttctctgtatttcctgaatttgaatgttggcctgccttgctaggttggagaagttcttctggataataccctgaagagtgttttctaagttggttccattctccctgtcacttttagttacaccagtcaaacgcagatttggtcttttcacatagtcccatatttcttggaggctttgttcatttctttttactcttttttctctaatcttgtcttcttgctatattttattaatctgatcttcaatcactgatatcctttcttccatttgatcgaatcagctattgaagcttgtgcatgcatcgtgaagttctcgtgctgtggttttcagctccatcaggtcatttaaggtcttctctacactgtttattctagttagcaattcttctaaccctttttcaaggtttttagcttccttgcaatgggttagaacatgctcctttagctcggagaagtttgttattaccaaccttctgaagcctacttctgtcagctcatcaaagtcattctccatccagttttgttccgttgctggcgaggatctccaatcctttggaggagaagaggcactctggtttttagaatttttggcttttctgctctggtttctccccatctttgtatttttacctacttttggtctttgatgttggtgacctacagatggcgttttggtgtggatgtcctttttgttgatgttgatgctattcctttctgtttgttagttttccttctaacagtcaggcccctcaactgcaggtctgttggagtttgctggaggtccactccagaccctgtttgcctgggtatcaccagcggaggctgcaaaacagcaaatattgctgcctgatccttcctctggaagcttcgtcccagaggggcacccacctgtatgaggtgtctgtc

SEQ ID NO: 34843 - DNA, 1074 bp, Homo sapiens
cagaaatttatttggctcacagttatggaggctaggaagtgtaagatcaaggggtcatatctggtgaggggcttattactgcatcgtcccatggtggaaggcagaagggcaagagtaagagagggcaatagggggctgaacctacttttagatataacccactcccacaataatgaaaccactcctacaataatggtattaatcaattcacgagggtagagccctcatgacctaaacacctcccactaggcaacacctcccattaggtcctacgtaacggggtttaagtttccaacacacaaactccgggaaacacattcaaagtgtagcatttgctcctggccccccaaatttttgtcctcataatgcaaaatacttttattacctcccagtagtaaaaaaaatctgaacttgttcaaacatcaactcaaaaaagtccagtctcatctaaattgggtatgattcatcctgaggcaaaagatgacactagagaactaagcagggactagttcatgaatgccttgtgactaaagaatttagactttattgtaaaggaaatagaaaaccactggggttttttaagcaagaaaatggtttgactagatctgtttcagaaagatcatttatctttcttagtaggaagttaataggtaatatataaaactcaaaaaatcaagaaataaaagtatacacgtgttatttagaaatatgggagtaaatattaagagaaatgactaaaaaattgagactagttatctttggggagtgggaatcagggtaggaaagaattaggtcagggaactgatggttgtttttttctctctctcataaaccttgaggaatgatttggctttcttaatctgtatgcattgtggcataatagttaagagtatggatgctaaggctagactgcctggattgactcttaacctccactacttacttaattctaggtgcttatgtattcctatctgtaaaaatgagaataataatagaaattatctcatagtatttttgtgaggaataaatgagttaatacaagtaaaacacttaaaacaacatgtggtgcatagt

SEQ ID NO: 34844 - DNA, 1498 bp, Homo sapiens
atttagcataattggcagtatatatggataatagttgaaggtcatcactagttaatatctttggcctaaatcttactgaagggatcagatggaaaagtcattaaagttaagtggaaaactgcataaagagatttgaataatctgttgtagatgtctaatgaggcatcatcctttttctaaaccatgtcagcatattaccttctgtgaattaatttattattgcatttctttggattgttctctccgccgattataatacagagacttttctttttttatattttaaaattgtttatataaatttttttttcaaatcagggatccacttaacactatttgcctttttgacatacctaacacatttctttccttttctagcatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgctttttttgaggca

SEQ ID NO: 34845 - DNA, 1034 bp, Homo sapiens
gactgataataggcacatgtatcagaataacatgatggaggaatatgattcgtcaaaagtttgtcctgcggtaaagaagaaagagaaaatcctcaaatcaagctgcatggactagtttgtggcttcattgaggatttcacatggtcaccttggtctcagtcatttttcaagaggaaaatggggatctttccttatgcagaaaaaagtataaccagtgataaccagtttagattagataatactctgataatacaatgtatacaattgaaatgaggtaggcatttgttgctaagaacaggctagaaaggaggaagaggaggaagtctttatttgcaaaaattgttaatactttttaaaaagccttttctttcaggtatgtctctggataagccttatcagatatgggacttttataaaggatcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaa

SEQ ID NO: 34846 - DNA, 1986 bp, Homo sapiens
aagggacttgagcatcctcagattttggtatctgcatgggtcctggaaccagtccccagtggagactgaggaacaactgtaagcacttagtttgaatgagatgtcatttgtatgagcagatggtgtgagctgaatgatagcatctgccttattattccatttctttttatctgttatgaatgaagaattggttaaaatgctttagaaattaacaaatatcttccagctgtaggtaaaacgtaggcctcttcagtcaaactattgatacataaaaatttgaacttaaaaactgctttaaaaaacgaacttaaatagaaaaatgctagattcttgactaatagagtaattttaaattatttgatcaggtacggttttgcaagaagactaacttctaagtggcgattcaccttcaaacaggatgtatttaccacagtaaatggttgtaatattaaaataattgtagtgattggttttactatatagaattctagtcccttagatttgaacctcatctccatctatttactacttgctttaatggttttgtaaaattggtaattgtctccattttttcccttaggtttttataaattattactacgttattctgacagctgataaataaaacctttcttcattatagcttacttaaattgaaagcacaccaaaatatgtagttttttttcaaacataactggaaacacaaaagagttgtagttaatttcactttgtggtctttatgttatttatgtagggtgtatggtccacgctccctgtaaatgagaagaaattaaatcttgcatttagatctgcaaggagtgttatcttaatattttctgtcagagagagtggaaaatttcaaggtaagaataaaaataatttggacatataaaaacattaattatattagcatctacatattatattatgatatgattctcttagggtttgcaagactttcttcagaatcacatcacggaggatctcctatacactgggtgcttccagcaggaatgagtgctaaaatgctgggaggtgtctttaaaattgactggatttgcaggtaaattatacacttcagtatagataactgaaattttgaatacactaccagtttagaataatgtgttaaagtgaaaaagtcactgtatacttatcttaccttgttcagtaactacctttatctaatgtgggacacaacaaaggcgtatttagtctaaagttacatgtatttgatttgttttgtatattagtaataaagcagtaaatgaattggacagttgcttgaaatgttgtctggcgtatctgtataattttagtgatttaacatgtcacttaagttattgaggaatgggaaataagtactatgacttggctaacaatttcggaggtaactagtttagtcgtggacagtattttttaaggaggttagcaaatgatgtttagttgccattgtgatcttctgaaactgagttaagatttaactgtatttattagaaaaataatcaggcttattttgaacactgagttgtcactatttttaggtccttactgcacactgaagtattgtacacaagaagctcattatttaagtgatctttacgtggcatacacaaatgtattacctgtaaaattaattttagttaaaaagtgtctgaaaggagatggttactttgtgagttttaagttgtttttgggtattagatcttgatgagcctgaaggggtcggatgaaaaagaagaaaaatgctatgcatatgatggaaatcagcctaagccaagaagagcatggaaacaaactatggggttgcagggttgtggggagcagtgggagggcatatggatgtgtgagtgggatagggagctacctttttttatgaaggagatggttaggaaaagagaagaacagagggcaaagatggataagaatgaatgaatgtgagtcagcctaaatgtttattgtaggatagtgaggagctgtgaagat

SEQ ID NO: 34847 - DNA, 1046 bp, Homo sapiens
agaagtggaagctctgcatcagagtcatatgcaggtattctcattttgtgatcatatctgacttgattctaatgtaatctgctttagaaagcgtgtggaggctgtagtttagtgtgaacttgttgatgtccattagcactgatttttggcatgttcagtgtaataattctagagaaaactaagctttttcttattattttaatcctgttctgttactgcttaagtggaattttcactttttttttcttggaagatgatgattcagtgactagttttctgagtgggaaactgttcaaatatacatacttttaaaaaaatccaaacaacccaaaaagcaaaacactcgtacacattgagaagttttttttgtgtgtgtgggtgcgccaggaagaataatttgtcttgaatgagaattttatgtgacaagactgtagaaattttgtcttatctctattaaagctcaatctgaacaaatgtactttggctaaatacaggttcagaaaagaagcatgagaaattatcatcttccgttcgtgctgtccgaaaaggtatcatttaaatttgaaattgttttcattgcatgctgcatagtcattatttttccttattggttctccattaatagctgcttttaatgtagtaatgttccgatatattacatgaagcaaaaaataatatcttaacatagaaagctctgtgtctgcttcttactgcatattttttagaataataccaaacatttcaggatattttagtttttggacaaaatgggatgggtgtgtgtgtgtatgtgtgtatgtgttatatatagatgtgtgtgtatatatatgtatgtatataatggtctgttattcttgaatctgagtaagaaaatctataaaacttggtaaccattttcatacttaaatatggatttgatatatcggaacatcactaggttaggtttactttcttgcaatatgctgattgtcttttcttagctttgctttattacatgtggcttagccttccaggttgaatgggtgattgttgcgttttaaaagttt

SEQ ID NO: 34848 - DNA, 1059 bp, Homo sapiens
ggagtggggtgatggagcagtggtcgtcgttgggggtggggggtgggggttggggaggttagctggcctcgcgaggagccggtggcccccaccgagacacttagactctggcggagaccaggcctgccctttcgtcctcagtctccatatggcctagcacttcatctcagtagggtttttctttgatgcggatttcacgcttgactttccgtttagctgtcttgggctgagaggggccctttctgagttgcaagctcctaggtttatttcctggtaggatcatgcggatgtaacgcgtattttcaggacaaccatttctgttaggctaaaatttgaaaacccctaatgccgcgatcaacactggtggtgtggtaagtgagcaagtttaggaagtggcactggcaggttattaatcttgagaaatatctgcaaataacttctggctgttcctgttaaataggcaaagtgaattacccgttttgttcctcgaatacttattttggaaaaacatagtacttggaaaaaggaatacttagtttggaaagatgactgtgtgacttaggctggcaaagaaatcctgggtgctattatgttagaaaaaccgtgtgtagctcccagagggtacagtcagaaacaaatgaatgcaagttacagagagttggagggataaatttcagtgaaatgtagagagaactgacgttgctgtaatggaaagatagtaatactaagttcccaagccctagagatattaatgtaggtcctagatcagtgtctctctggagagtggtctagattaaatgctgctttaagatctttttcaaccctaagattaacataatagtcttggaaagattatagttaaaaatatgacacggtcgctgctctgtgtctcacacatctcttctgtgtgcctaattgatttggggtttttttgtcgggggttgttaagtgggctctagagtcaagttacattaggcgtgtaatccttttttcttaatttttctggtttctgcatcaggagagtcttcatgcttcaatgaactgccctaggttagggac

SEQ ID NO: 34849 - DNA, 1050 bp, Homo sapiens
tacagatgtgcaccaccacgcctgactaatttttgtatttttagtagagatggggtttcatcatgttggccaggctggtctggaactcctggcctccagtcatttgcctgcctcggcctcccaaagtgctgggattacaggcatcagccaccacacccagccgtcattggagtttttttgagggagatttgcagtaaggtgaataaatgttaagtgtatcatttgatgaggttttttctttttttttttttttttttgagatggagtcttgtatcgcccaggctagagtgcagtggcctggtcttggctcactgcaacctccacctcctgggttcaagggagtctcctgcctcagcctcccgagtagctgggattacaggtgtgagccaccatacccagactcatttgatgagttttgatgtaaaagcatgtaactcaaacccctatgtctggaacatctgtattacatctgaattttttcacctagtcaattcctgcacctctctctcctgtcccttcttccctcccctggcagtcagctactgttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaacgtttcacctgttaggtgaacaactaactggtgaacaatgggctgtttctagtttggggctatcatgaataaagttggtatgaacatgtacaacctttttgtgaacctacattttaatttaatttaatttggataagtatttaggagtgagattatcctgagttgatgtattttaaattttactagaagacgacaaaccttttcctaaatggttatcctggtttacattcccagagttctagtaggtccatatccttaccatttgctgttgtcagtctataattttagccattgtgtagtggtatcttctggttttaatttg

SEQ ID NO: 34850 - DNA, 1027 bp, Homo sapiens
ggtgtggcacacgcctgtaatcccagttacttgggaggccaaggcaggagaatcgcttgaacctgggaggcagaggttgtagcgagccaagatcacaccattgcactccagcctgggcaacagagtgagactctgtcaaaatcaaaaaaaccaaaatacaaaaaactccattgttctgagagtttcccctaaattatcggaagacactcacattgaattggtaggacctatagtatagaggagaatggtatgtatgtcagcagtagagttccaatccaaattgcgctatcgcattagaaatacattaccctcccactccccaagttcagcaaattagaagagaatctgaagtttgtaggaagggaataaagctgctataaacatttatgtgcaggtttttgtgtagactcgttttcagctcctttgggtaaataccaaggaaccaggttgctggattgtaagttaagagtatgtttagttttggaagaaactgccaaactgttccaacatgactattttgaattcccattgacaatgaataagagttcctgtagctcctcaccctcattagtatttggtgatgtcactcttgcattttagctaatgggtgaatagtggtctcatcgttttaattcccaatcccatagtgatgtggagcaccttttcatatacttaatctgccatccttatatcatcattggtgaggtgtctggattttctgtccagaattttagttctagtggttttcttatttttagaaaggaagtataggaaggaaggtttaatctgtcttaagcctgattatatgaaaatcaagaataggctaggtgtggtggctgacatctgtaatccccgcactttgtgaggctgaagtgggaggactgcttgagcctgggaagtcaagcctgcagtgagccatgactgttgctgcactccagcctgagtgacagagtgagaccctgtctcagaaaaaaaaaaagcaggctcattttaaagttgtttatattttattttttgaaggaaataa

SEQ ID NO: 34851 - DNA, 1050 bp, Homo sapiens
tttctccatgttggtcatggctggtcttgaactcctgacctcaggtgatccgcctgcctcggcctcccaaagtgctgggattacaggcgtgagccactgtgtccggcctactttttattttttttgagacagagtcttgctttgttgagcagactagattgcagtgatgcagtctgggctcactgcaaactccgcctcctgggttcaagtgattctcctgcctcagtctcccgagtagctgggactgcaggtgcccgccacaatgcctggctaatttttttgtatttttagtagagatgaggtttcaccatgttggccaggctcatcttgaactaactcctggcctcaagtgatttacctgccttggcttcccaaagtgctgggattacaggagtgagccactgctcccagccataattccttatgatttatatggtagctttgagcattatctccatatagaatttttatgcataatttccaacatcatgctgtttgccaaaaaatagccacctttagtagctataaatcgtaatagactggatatgtgacttgcattagctttttttccccacttaaatttaaacacgttttccattttctcaggttacttttgttttttttttttttttttttttgatatgaaatctcactctttttgcccagggtgaagtgcagtggcacaatctcagctcactgcaacccctgcctcccgggttcaagtgattcttctgcctcagcctcccaagtagctaggattacaggcattctctaccacatccagctaatttttgtatatttagtagagacggggtttcaccatgttggccaggctggtctcaaactcccgacatccagtgatccgctagcctcagcctcccaaagtgctgggattacaggtgtgagccaccacgcccagccattttctgttttaaggtatttttaaaaggataccatgtgaaaccagagtgtatcatccataaacacagttaatgtgccactgtttccttttcctaaaatggcattttttttttgccttaggaagtacat

SEQ ID NO: 34852 - DNA, 1969 bp, Homo sapiens
agtattttcagtagagatggggtttcaccatgttggccaggctggttttgatctcctgacctcaagcgatccactgtcctcggcctcccaaagtgttgagattacaggtgtgagccaccatgctcgctgagagcagatatttgaaatgtcactttgagttctgagaaaaagtaaaaagccagaagacatactagatatataaatatattactgcttaaaaagatttcctaaaaagaaatgtatcaagtgtatgaatcaaagtctgaaagaaagatgaagagccaccagacttctaggtaggtttacatccatcatgttcctcttgactgcctttgtttgtcgtttagttttttgctccactcaagcctgttagaatcaccatggaatacagctccagtgggaaggccactggagaagctgatgtgcactttgagacccatgaggatgctgttgcagcgatgctcaaggatcggtcccacgttcgtaagtcctgcctttggcttttgttgtcatttttgatgcttgtctttgcttacaaatatctttttctgttttgggattgtagaatttttccttgagaaatttgtattcttttagtactagtaaattaaacgtaacagataaaacactatattataatttaaaaaattttgtctgctaattatcctgcaaatctctttctttcttttttttttgtcacccacgctggagtgcagcggtgccatctcggctcaccgcagtctcagcctcctgtgttcaagcaattctcctgcctcagccacctgagtagctgggattacaggtgcctggcaccgtgcctgactaatttttctatttttagtagacacaggtttcgccatgttggccaggctggtctcgaactcctgggttcaaatggtccacctgcctcgacctcccaaagtgccgggattacaggcatgagccaccgcatccagcctgtttgtccattttacattttgtttgtttgtggttgtttgagacggagtcttgtctgtcgcccagtctgtagtgcagtggtatgatctcagctcactgcaacctccgcctcctgggttcaagtgattgtcctgccacagcctcccgagtagctgggactataggcacccaccaccacactggctaatttttgtatttttagtagagatggggtttcgctacattggccaggctggcttgaactccttacctcaggtgatcctcccacttcggcttcccaaagtactgggattacaataggcgtgagccaccgtgtctggcctaaattttgtttttaattagggaaaggaaagggcaaagggtttgagttgctgtctgaactgtgagaaaaatggctgtaatatttttctaccttttcaactttttaaaactaatctttctcattatcctcagatcataggtatattgaactgttcctgaattcatgtccaaaaggaaaataagactctaggggctccagataataaggtaaatttaagaggtaatactgtgggctgggtgcagtggctcacacctgtaatcccagtactttgggaggccaaggtgggcggaccacctgaggtcaggagttcaagccagcctggccaacatggtgaaaccctgtctctactaaaaatacaaaaattaaccgagcatgatggtgggtgcctgtaattccagctactcaggaggctgaagcgggagaatcacttgaacccgggaggcagcggttgcagtgagctgagattgtgccactgcactccagcctgggcaacagagcgagactcaaaaaaaaaaaaaaaaaagagagagatacaactgtggaaattatttgctattgataaactaataatcattcactcactaatttgtaatatggtagaaaccattctctttttatttttcaaatttttttagggactaggtcttgctctgttgcccaggctagcagtggtgcgatcatagctcactg

SEQ ID NO: 34853 - DNA, 1041 bp, Homo sapiens
gtaatagtaatttttctcattataattcttgtaataaaaaaagtgaaaatccaaattgaataggtgtatttcactcccacgggacttattgaaattattttgattatggatggacaaaattcatgcagggagaaatttcagttttcttgaattgttctttttgtataaagttctcagctgcactgtgctgtatcttcactggaagaaggaaaagtgtgttcaaagtcatgtgagaatataagctctcaaggaggttgctgtgcctgttacgaaaagtgtgattgcatatctgctttgggccaggtgctgaagccactctaggcctacttgttgaagaatgaactggcaagagatgaagtggttttgggctgagtgaacatcatatgcattgctaaaaagttcagactgcatttttttaaggaaaaacatattcatggaagtttttaaacaaggaaatgatttttttcccctatgcaacaactttactggctttgtggacagtaagccaaaatttagagaaactagtggcagggatattcatgtgtggatgtgatgtttttgctattgagcaatttatccacaataaacatatcttttagatactaatatcttagtatactttgatgtgtggatataaaatggaatttagaccttcatgtctactgaattttgtttgaaaaatactatgaaactcatctttcatttgtccactttgacacttttttgtgtaattagtattatataattgtcaccatttttttaggcagtaacaagtaacctttatcaaaattgtgaagtttcaaatattagtggtattttaaagtattttggtttattcctatttgaagtagaaaagctcttaactgattttctgcatatattttgaaattttgcattggcattattagatatagttctttaaaaagtcataagtaaccatctcagtgaatttgtaaacaattgagtgaaaaaaatacaaaaataattggagaaggaagcaacttttttttagaaaattattgcctttggaaatatatttta

SEQ ID NO: 34854 - DNA, 1027 bp, Homo sapiens
cttataattgtctaacagagataatgagtttacttcataaacaacaacaacaacaacaaaacaagagagtatgaaagaagggtataaaatattctatacattttaaggataaaacttagtagtttgttttgaatcagtctttcataattctaagaagacagtatcatgtagtaaacaacccatgctgtggaatctttctaccttagacctgccactggttagctgtttcatttttacaattcaggataaaatggaataatcgtggacctacaggctagggttagagcaggcaaagtttttaacaaactgcaagtcctcaataaatgtttgtttattggtaacagaaccatcttttgttgtctcccagttttaatgacatatctaggaacaaccgcattttatttaaagtaaaacgaccacttctatttacagtaaaacatctaaaaatgtaactagttcaaagaatcatgtaatatctaatttgaggtagttctcattcctttctgcctgactaatactagaccactgaatattccaaacctcttaagattttattcccttatactacaagtcaattaaagtgctattactgtcatttatgtgtttaatggttttcaacccataaatgtaaaatggtttatctttaatttttgttatgtcctgccagtttcttgtaggttatgcctatgggcaataagcaaacggaacctgataaaatttgcttataatgtagaacatttcaggttaccaaacaaagctcactttgtttactaattttaatttctattataaatgtagcacatctttatttcatgtggtatttagaaatactaaaagatattttaatcatagaagaagaaaaaaatgctcacatccctacacctcaaagatctctacttatattttgggtgacttccttccatgatgatttctacaaacttaagactacgatcttccaataaatgccactttgaatatgttcactttaacaagtttctcaaagactttcttttgtcttttaatcctt

SEQ ID NO: 34855 - DNA, 1068 bp, Homo sapiens
tggccaataggtatatgaaaaagtgctccacatcactaatcatcagggaaatgcagatcaaactcacagtgagatatcgcatcacacctgttgaaatggctactaggagaaaagtgaaagataagtgttggtgagatatggagaaaagggaatgtctgtacactactgatgggaatgtaaatggtgcagcacttatgaaaaacagtatggaggctcctcaaaaaattaaaaataaaactacatatattccagcgatctacttttgggtatatatacagcaacttccttatctgtgagaaatatgttccgagaccctcagtggatgtctgaaaccttagaaagtaatgaaccctatatatactatattttttcctgcacatacatgcctatgattaagtttataaaataggcacaataagaaattaatacaaataactaataataaaatatgcatgtgaggatgtgagatgataaaatgcctatgtgatgaaatgaagtgaggtgaatgccgtagccattgagatgtagtgttaggttattattccgtttctgactatacctcagaaggaagaacatctgcttcaggtgatcctggattattgggctatgatatggttggctgtcaggagcagacgatgttgatgattaacaagtgggtagtatagacagcaaggacttgctggacaaaggaatgattcatgtcctgggcaagacagagctagatgacattagatttcatcatgctacagaaaacaacaagcaatttaaaacttatgaattgttacttctggaatttttcatttaatatttttggactgcaattgaccatgggtgatcgaaaccatagaaagcaacactgcagataaaggggggctactgtacaagaaaaatcactatctcagagagatgtctgcactttcatattcattgcagtattattcacaatcaacaagatagggaaacaacctaaatgtctgtcaatgtatgaatggatagggaaacctttctaaacctttattcagctttagaaatgaaggaaatcctgccatttgtgacaacatggatgaa

SEQ ID NO: 34856 - DNA, 1026 bp, Homo sapiens
gtctaaaaccttatctagaggaaaagaaggtcattatacattgataaaagagttaattcaacagtaagttataacagttataagtataaacacaccaaatatcacagcatctaaatatttagataatgttttatctaaataaagtaaatattgatagatctgaaggcagaaattgacagcaatacagtaacacttggggactttagtaccatatttacaagaataggtggaacattcaaatatgaatatcaaccataaacagatgactcaaacaacactggagagctaaagggtcctatctgatgtatacagaacttttcacgcaacagaacttttcagtacacacagaacattctctaggttagatcacatattaggtcacaaaacaaatctcaacaaatttaagaaaataaaaatcattccaaaataaaaatcactttttctgagcacagtgcaataaaagttgaaattagtaacagcaagaaagtgaaaaattcacaaatatatggaaactaagctctacactgaaaattaaaagggaatgtaaagtgtatctcgaaacaaaggaaaattaaaacaacatatcaaagcccatgggattcagcaaaagctttaataagaggaatctttgtaggtataaatgcctatattgaaaaaaaaaactttgcacctcaaagaactagaaaaacaagaataagctaagcctagtgttagcataaataaggacacaataaaaattagaaaagaaataaatcaaatagagaataaaaaaacagaaaaaaatcagcaaagctgaaagttgtttttcgaaagataaataaaagttttaaaaaacccttagtctaagaaaaagagaaagaagattcaaatatttaatatcagaaatataagaggagacattaaaacaatttttttctgaaataaaaatcataggcactattataaacaattatatcccgaaaaactagattacataaaagaaatggatcaattttcaattttgagaaactttcaaactaccaaaat

SEQ ID NO: 34857 - DNA, 1109 bp, Homo sapiens
gtacatagcccacagacccaataaagcaaccaaacagtagaaactacaaagcaaccagtcaacaacttcatgatagcatcaaaacctcacatatcaatattaaaatgtaaatgttctaaacatcccacttaaatggcagagtggcaacttggataaaaaagcaagacccatccatctgctgtcttcaagagacctatctcacacataatgacatccataatatcaaaataaagggttggagaaaaatctattatgcacaaagaacacaacaaagagcagggataagtattcttatattagatgaaacagacattaaaccaacaacagtaaaaaaggacaaagaaggatattacataatgataaagggttaaattcaacaagaagacttaacagtcttaaatatatacacatccaacattggaggacctgtattcataaagtacttctagacctgttaggaaatgtagacagtcacacaataatactgagggatttcaacaactgactgacagccttagaaagctcattgaggcagaaagctaacaaagaaattctggacttaaattcaacacttgaccaattggagctgatagacatctactgaatactttacccatcaaccatagaatgtatattctcaattgcacatggaaaatactccaagatagaccacatgcttggccataaagcagtctcaataaaataaaaacactgaagtcataccaactataatctcagaccacagtggaataaaaatagaaatcattaccaagaaaatctctcaaaaccacaaagttacatggaaattaaacaacttgcttttgaatgaattttgtgtaaacaataaaattaaggcagaaataaacaaatactgtcaaggctgggagtggtgtctcacggctataatcccagcactttgggaggctgaggtgggtggatcacaaggtcaggagttcaagaccagcctggccaagatggtgaaaccccatctctagtaaaatacaaaaaattagccaagcgtggtggtgggcacctgtaatcccagctacttgggaggctgaggcagagaatcgcttgaacctgggagggaaaggttgcagtgagctgag

SEQ ID NO: 34858 - DNA, 1045 bp, Homo sapiens
gggtacactggaagcccaaaccttaccattatgcaatatatttatgtaaaaaaactgcaggaaaaaagaaaagaatatttaagatttaagcatacagagacaggaaagagggaatgctagtgtccaaatgaaggaaaatctgaaagtaaacatatggatgtgacaagtatggggaaagaaggaagttcaaacattaatttggcttcatcatagaacatgaaaagagctttggagtgtcaataaacaagagtcttctgatcagaattttactcaagaaggttaatccgttagatggtggggagtgaaacggaagtggaaagacagtggtgggcagtagtttggaggctactgcaatagctagataatagacagtataaagaggaagtagaacagtagctgtggtcattgaaaagggaaagatggtataacattattgagtggaattcctaagatatgccaactgctgtgaatgaagagggaagaaaggagtgtgtgtaagggatcaaagatgagttggaaagttttgagctggcatgaccaagaaatatgggaaatagaataggtaaagtagaaaacataaattttatctaagacacattgcatgtgaactgtcaacaggatgtgcaggcagagatgtttagaagacaggagatgggagtcgtgggtactctccagagacagtacatggctagggacaggaatttggaagacatggaacttttaaaggaggtaactgaagctgagacaatagatagaattaaggagtgtttggagaggagagctgaagtatgatgtcttgaagatgtatttttaagagcatttttaggctgattggggatgcagaaatttcctatgtaccctctgcctccacacgtgaaaagaatacccactttttggagagcaggaggagaagccagaagagacaaaaagaagtggctgagccaaggaaacaaaacttcaagaatagcatgctcttagaaaaaatgaatgtaaattttagggtcaagcttatttttttatttatacttttaatttttgtgggtac

SEQ ID NO: 34859 - DNA, 1090 bp, Homo sapiens
cacctcatgcatggaaataattaaatgtcaaaatgagtcattttgagtgggttgcatattggtaagttcactaattttttgaattaacagaggcaatagagatgagtcatacaattatttaaaaaactatggaaaagttttaaatatagatctttgtttttaatcttaattaaaatgtaatgtaatgtaatgtatagtattgtttcacatgttatgctgggcagacaataagttttctgtgtatttctttatatttcattttaatttgagtgacatttgcatacagttatactgtttggtttaagttgttttcataacactggaaaatagaatgcccatcaaatatataggatagcagtatcctcagagttttgattttgttcttttgatgttaattgtgttaacaggaaggaactttagaaattatgcttttcagaaataaacaaagagatattactctgggtatgtaattgtaaaaattgtaaaagtttaaggaaattattggttcgaaatttactggacattgaaagtttttgttttaatgcacatgtcaaatgtagattgtacactgtgcttttcttactttttcttttttttatatttacctttggaatagtaatttattaacttggtgatatgagaaattattgggtaatatctaagactcttataaagttaaaatttaggttattaatttcagacattatttcttccatttattttgatagaagagactagtctaaaaataagtctattattttctttcttgtgggattaagattcatgttttatgtttttatgactgaaaacaatactgttaaacacttgctcgtgttaagaaactagctcactttggtactggctcagtcttagatatttctttccttttttcaaacactgtctgaagttaatgcattaacttttataaggttataacctttgaaaaatgttttaagcatttttaacactgtcaaaaatgaagattgttctttttttgttggttatgattatttctgtataaagctgttatacaaggtgtagtgattgaatagaacagaaactgtgtgtgggagactgaaatattccactt

SEQ ID NO: 34860 - DNA, 1042 bp, Homo sapiens
ggcgtagagtgtgtactcaacaaattaatattgacagactgattggtatggattttggaatggagaattaaataccactcttgagaggtgaattgagggcttttctttgatgttttcagttttcccttttgtgtaactttcataaaataaagagagtgttacgaacttgaaagtttttgaggtacctaagattttatataaataaattccatcctcctgagtagtgtttttatgcttttgtttgcataagttcttttttcctctcattttccatctcatctactttcacgtacaagctagtgaaggagaagcagcatctgttttttttttttttttttagttttcacttttaattgacaaacaacaattgcatatatttatggggtaaaagtgatattttcttatgtgtatacaccatagaatgataaaatcagagtaatcaacatattgattgcttccaatatttatcattcctttgtggtcagaacatttaaaatactctcttttaactactttgaaatcatcttgaccaaatcctcacttgagttcaacctaatagtagatatatagtgtgtctcttaaattagtttactcctgctaagcaacagaaaccaatacaaattagcatggaaactttttttttttaaagagagaattaaaaaaagagagatcataaaaatattcttggaattatttccttggacaaatacaaaatatgtgtatgtactgacttttcagtcagtgttattactacagcaacttgtagttctgtgagcactggccacatgtacattacttgtttaatgtcctgtttctcctctgaaataaagtggaaattccatgagagtggtgactgtgtctgtcatgcttacttctgtatccacaagtccaggcactacatctcatgtggtaggtgctctgatgagttactgactgaatgaagacacagaacataaatttgatgacactacactctgctccctatccccctctaggtttcaggattcttagttggatgaattcttcctctgggtagaatccc

SEQ ID NO: 34861 - DNA, 1027 bp, Homo sapiens
tcagatatatggtttgcaagtgttctcttccattctgtgtgttgcctttttactctgttaatagcgtcttttgatacacaaaaatctttttattttcatgaagtccaatttattttttcttttgtttcctgtgcctttgatgtgaaatctattgcaaaattcaatgttgtgaagcttttgccctatatatatattttttaacaagagtttttagttttatgtcttatatttaggtctttgatccattttgtattaatttttgtatatggtgttaggtaaggatccagctttatgctttgggcatgtggatatcaagttttccaagctccatttgttgaaaagactgtcttttctcaattgaatggtcttggcacccctttctgaaatcatttgaccatatatgcaacaatttatttctggactttctattctattccactgctgcatatgtttatctttaggctaatataactttattttgattactgtagctttgtagtaagttttgttatcaggaagtgtgagtcctccagctttatgcttctttttttctcaggtttgttttggtgatttgggttcccttgagataccatatgaatttaagatgggtttttcaacttctgccaaaaaaaagtctttggcatttattgcagaaggtgtagtggtaatgaactccttcagcctgtatttatctagaaatgtcttaacttctccctcaattttgaagggattttttgccataccttggtgtaccttttttttttctcttgttattctgaatatatcagtccactgcctctggaatctaaaagtttctgatgagaaatctgctgattgtcttgaggatcccttgtaatgtgatgaatcacttctctcttccttctttaaaaattctctttgtctttgtctttcagcaatttaattacaatgtattttggtatgagtctctttgaattcatgctacttgaagtttattgagcttcttagatgtttatacttatgtctttcatcaaatttggcaattttc

SEQ ID NO: 34862 - DNA, 1085 bp, Homo sapiens
cctcagcctccaagtatctgggattgcaggtgcacaccaccacgcccagctaatttttgtatttttagtagagatggggtttcaccatgttggacaggctggtctggaactgctgacctcaactaatccaccctccttggcctcccatagtgctgggattacaggcatgagccacctcacccagcattttttttttttaatttttttaatgagacagagtctctctctgtcacctaggctggagtgcagtggcacgatctcggctcactgcaacctctgcctcccgtgttcaagcaattctcctacctcagcctactgggtagctgggactacaggggtgcaccaccatgcccagctaagttttgtatttttagtagagatgggatttcaccatgttggctaggctggtcttgaactcctggcctcaagtgatctgcccaccttggcctcccaaagtgctgggattacaggcgtgagccactgtgcccagctgagatgtttcttattattttggaggtggagaggattttagacctctttgagcatctgaaaaaaggctatatatgtatggttttctcttcagaaaaatcttaagactcacaatacggggacttccttgttaccaggaagattttctggcaattcctagttaataaatcttattctaatggaacatacattgatcttgagttaatgcgtggttgaaaaaaaaagcgggggcaacttgaaatatatgcagtaaagtagtccatgcatacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggtgattttaaacctgtttatttgtaaggattaagtaccctaataggcttaaactatgatagaggtttaatacagaaaaaattgacaggtattataaattgtggatccagttacttgcttatttaat

SEQ ID NO: 34863 - DNA, 1022 bp, Homo sapiens
tttttttgtaaatgactacgtatagtcatttttctcctttggaaaaggtaaatagcttattaactaatcctgtcttgttcttcacaaaaataatagtccatccgtgttttgactcaaataacctaaatacacattttgtaaaaattttgtaccctatattacttatttttaaaacagtacagtgttagactaaacaggaaaactcaaagttataaaatctcttcagatcctctagtttattaaatctattttcatgttgatgtttttcacaacacttattcccacagatctggcattacagaacatttaaagtgtaccaaaacattgttttaataacagattttaaaatcaggattatttcaaaatgattaaaatagcaaagaacaaccaagtcactgcttttaatcactataagcagaaattcagtattccattctcagtatattttacttacgtaaatgaatctatgcagatatcttacacttttaatgtttgctgtccttgacactaaattccgaatgttccttaatgtctttggaaatacatatactattgataaatgcttgcttaagtcacagcatttgattaactcaggtgactggaatttaagatgggagcattatcagtgctttaataagtcttaatgtgttgcacaccttgattgcaaaaatatcacttgaattttggataagtgtaaaagaaaatgtgctactgtggctttgacagaatacctttgtaacgtaacaaagtacaaacctaatatctgtggtgtaggaggttgcatattatacttctgcttttaaatggattcacacttctgaaaaacaaaagccaactttgcattttcaatgcttgaaaaccaataataagaaagatggcaaggggatgtctttcaataaagagaaaaaagccaattctaaattaggtagctttggttttgagaagtagtgccttaagtaagaaagaaaaactgaaatcttaatctgattctaagggatcactaacaattgctcatggaaata

SEQ ID NO: 34864 - DNA, 1053 bp, Homo sapiens
atccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcattttcccaagtacatatttataatacttacggtgcctatctagtattctgtgaatatatactgttaatttattccttcccattgacagacttaccttgtttccatgtattgccattataatcaatttgcaaagaaaattgctgaacccttgttttttcactagagatagacattttatataataagttgttgggataagcagtttgtaatttttgttaggaagctttcaaattactttttctaaaatgtaaatattcatgcccgcagcagtacaggagagaattcagtttctcaaacttgtgctgatatctgatacctttttaaatttcgccaaattaatgatcaaaaaatggtattttgtcggttcaacttacatgtccttaatgattaaaagctatgtatctgtttattatttacccattttaaaattagtcttatattgttaatttgatcttgatattgtaaaaatattgtctctttagagtggtttgaatatgatcttgataaaacaatgaattgaactagatgactttgaattttatgatatcatggtttccttatgattaaatgattatgtgacaacttcttctccagggtaaatttcaacgttatatttctgctttattgatctttaacagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaaggtattttctcttaacaaccatcccatttgttttatattctagttaaaattatatttacttga

SEQ ID NO: 34865 - DNA, 1168 bp, Homo sapiens
cttttgtctggtgtatccacttagtagccctcagttatcagattgactgttgaggtatcacagtgcttgtgttcaagaaaccctaattttacttaataatggccccaaagtgcaagagtagtgttactggcatattgttataattgttctattttattgctattgttgcttatctttcattgtgcctaatttataaattaaattttatcatgggtttctttgaaaaaacatatatatacagggtccagtactatccaaggtttcaggcatctaccagggatcttggaatgtacttactcatcatggataagggggcactactgtatttttaatttagtagatacttgcagaatactttcctagtaccattagcaatacaccaatgtcatttccttgtattcttgccagcgttatttaaccttaatgtttatactttcaagagccttagttttaagagaagtcaagagaagcttcttttaaatatcgttgtatatttttccataatattaaaaccaaaagctaatgaagaattcttaatcattaatcaattctatctaaattgattcctgcacatgcattatatacttttatgtatagttttgagtgaacgtggaacatatgtaaaatttttaattatagagaagccacttttttcctgaactacagcccatatttttatttgaaagattatcacattgggatattagagtttggctcactattttttaattataatttacatctgggaaaatggacttctttagccttttgagatatattacattctggcttcatcgctggagttggtcttgactggtccaagttgagattctccatacgtaagttattcctcgtataaaagtgcttctttggtcagtctttctaatttggaaaatttggtttataaaaactgctgcagaaaactgggcatggtggtacatgcttgtagtcccagctactcgggaggctgagcccaggaattcaaatccggcctggccaatgtagtgagacccagtctctacaaaagaaaaagagatcagtggccattatgttaaggccagcagattttttaatacttattaagtaaacatttatttattgagcatttactaagtggaagagtccctgctctgaagtagttccatctggtcaagttatggaatcttct

SEQ ID NO: 34866 - DNA, 1018 bp, Homo sapiens
gtaactaacttttagttttaactaagttttagaatgaattggctaggaattttgcaggaaatgcaaattttgcaggaaattttatggaagataaaactgaatcctattagagatcctaattgagaccttctcctggagacatacattttgatttggagtttacactaacacttgaataagatcctaacacatgcctctgaaaaccaaagaggacaacaaatcttaaaaatgtcttcttatgacgtttacacagttgctattacatgatagtgaacagcttttccctataagttttaatttaaactagctaggtcactgtctttcctagctctagacttgtccatgacaattaacattcctatatatcacaggtttttaggggcagagggggagattaaaaataaattatttttaataatactaagaataagactggttcagtggcacacagctgtagtctcaggtacgcattagtctcatgtacttgggaggctgaggtgagaggattgcttgagcctaggagttaaaggatacagtatactatgattatgcctgttaatagccactgcatttaagcctgggcaacatggcaagcccctatctctaaaattaaataaataaaaattttataaaaataaggaagtagtgttttactgtcctaaagtgtgacttgagaatgaaatcactgagaaaattatgtaagtacatgtatctgattcctttgtaaatgattattgtacacaaaattggagcaacaaagcttaaatatttgaggacatttcttgaaaaattttcacatctgttttctttgttgacattatttcctttagcctgttaaccagccaacataaattattgtagttctgtttgctgtacaatttcttatatttaaattagaggataaatgactttagtttctgaagtgcctgctaaatggatattattttgaagaatagcaaaagctactctttgattcttcatttgtatatattcctaaatataccatgtcaattacgtt

SEQ ID NO: 34867 - DNA, 1047 bp, Homo sapiens
aattttccgtgcttatcttttgcaaattttatgtacatctcttcattttctatttaagctttcctaaattactctttaaaccctggaagaattttagaaaccttataaacttcatcataaaattgattcttctgctgattgcatatgcaccaacgtagagtggacataagacacatacacttaacattatattcagcacaatctgctttgccttagggcccctctgtgatatagtggggagagcaggattttgttatcaagatcttcttgggttttttaaagcacatatctaccagttgttagcttatgtggccatcggaaagttatttatcagagcctttatctccttttctctgaaatcagatataatttcttcctataaacctgaaatgaagatcaaatagtataacacagtcagagctgtcactcatttaagtttcatgtccttctccattgttgtagttggtgcatctctcccttgtggccatccctgatctctgcagtcagtagctctgctctctgccagcctcttctgcagagcagcttttgccgtctccctcttcatcactgactagtaggctttttcttttttcttaactcttactgattttgccttttgtcttttgtttttcatttcttataatggaatttggtctgtagagttatttacattctgggagaatatgcttttcctttttataattattatgtacattctacaaatacaatgtgtaaatgtaatcaatgctacatatatagtcccttgcttattatgtttattagtaacagtttttgaatctatgaccttttgcagctattgccattcattttacttaactatcatttattatttcctaagtaatttatcactacaggtagaaaatacaaacatggataagacatgttccttacctcccaggaatttatagtctctgtgggtgataaacatataaggcagattggtgataagtactataatagagatacatatgtgaaagtgagggaaatgcttagagcaacactgttcagttgaaaaatatgatgaga

SEQ ID NO: 34868 - DNA, 1048 bp, Homo sapiens
ggtttgaaatatataatggattgcatgtaaaagaaaaaaggttctaacataaaattatatttttgtatgtcatacacatgattgatatcatatatcatctttgaaaattctcatcttactgattgaaatatgtggtgagtctgtgtctgtatttgtaaaatttagctgtacgggattccaggcactttttgaagaaataacatggagtggggggaggacactgtttaagttaagctttagaaagtttgagagctattaagtataattttttattaaaaagtagttgaccatgaaatctcagggcaaggtgagattggagagaatagtgcgtgttttatcctgaagaaaagttaagaggtctagtttagaagactgctgaataaggtcaagagtacatggccatcaggactaagaaatgtttgcagtttacttagtttttgtattttgatggtacctggggtgtgtacattataaaacttttaattttatatatgattatttctttataataaagcctgaattttagcaggggtaacgtggggagaaagagagaggagtgagtgtatgtgtgtttgtgttggatggaccattaagggcatgtactcttaacctattaaaaataaagtttcctttttattaaaatgatcctcagtaacactatgaaaaaggaattttatttctgctcttacttgttggccaaatgtctgttgttttttatgtactgacttttgttgttgttgagtacttaaaattgccagggactattttaaggaattgtctcatctaatcctcagaccacatacatgatgtagctactcttaatatccatctccctgaagaagacattgtagctaagagagaggttaagcattttgtttagtcacttcatttaggctaagaagcggcagggctgggaatcattcagcatgacttcaaagacaccattctttttttcttttgtaatgggttcttgccatgctgcccaagctggtctcaaactcctgtctcagcctcctgagtagctggaattacaggtgtgccaccatcc

SEQ ID NO: 34869 - DNA, 1075 bp, Homo sapiens
aggtttttcagtagtggggttgatgtttgatttttgtttttgttttcatttttttcctttaagttcagaatactgagattgaattttggcattttgcttctgtattcacaccaataaactgggaaattgatagaagttgaagtgcaaaactagtaggacacatcaggaagcttatttatgaacagaaatactttatatcctaatggatcagacttcaaacctgatggatatttaaaaaaaaaaacacttttacaaaattaataaagttcaaaaccaaatagggtttaattatactgtatgtaagtgattttgtcccctgtgaatgttaatgtgtagtctctttctaactgtatcatgagaaggtgtggcccccctgaaagtatcataaatgatatatttttagatgtgtagccagataaattttattcgattataactagtttcattgacaagaagatacactttagaagactgtttttatgcttctagtttttggtacttattttttgtgttttgtaacaaagtaatgggatgaggttttatagggttgtgaaccataagaatgctgtactgagaaggataatttgcttcattaaaaaaagaaaatttgaaaaggaaggaaaacagaaaaatgaaaggaataaacagtggaattttggtgacttccatctgatctcttccccttttttattcattcatctgtacttagaggatgattgactttttctaatttaaaaactgtttcagtagcattaaatatgatgagcttatttttttttaagtttcatcttttaaatggataataggaaactaaactgtatagtgtttagatatttaggtaacgttcagacactaagaatccagctgagatagattttatacttaaaaatatctgtaaagtttgctagtccgcctttaatagcacctcagtagttataacatgtggaatgaaaatttctgctagtcttaagggttaaataaccacattggaaaaatgctagtaataattactagtaagaattgtacgactcttattgatgagtgcaaaatttttctatagatttgaaagtcacta

SEQ ID NO: 34870 - DNA, 1049 bp, Homo sapiens
tttatttactttagaataatccaagatgggagaggagaattaatgtaggatatttgtgaaatgagattggccttgtgtttataatcattaaagctcggtaatgggtatgtggagcctcataatactattttctctactcttcatgatttttaaatttaccataattttaagaaaaaccattctactaatatgattttccatgccttttctgttttaggagcgaatgtgaatagaaccacagctaataatgaccatactgtactgtccctggcttgtgcagggggtcatctggcagtggtggaactacttttggctcatggggcagatcctactcaccgtttgaaagtatgtaactcaaatgtttgtgcagaattgtgaattagtatttctctcttggtcattgttacaacatatcatgtacaagttccattcataatggcattctaagtgtaaattttctcctttttcacttgaagcgttctttaccaaacctatgattttaatgcgtctgggacctgttggctttatcttcctaagtgattctgtaaactaacttatttttcttcactttttttccccttccatattcactcttttaggatggctcaactatgttgatagaagcagcaaaaggtggccatacaagtgttgtttgctatctcttggattatcctaataacttgctttcagcccctccaccagatgtcactcagttaactcccccatcccacgatttaaatagggtaagattttaaaaattaaagcattttatggtatgtcttctttatcctaattctttcacttacagtttctgtttaaattagggtttttttttgttctaatatgtagttctgtttgtaaatatgtacttgatacagttaatgaacatctggtacaatattcagatcctagatgatatgattatgctttagcttttaaaggtcacaacttgaattcaaagcctactaaaaaatgtcgtggtaaacaatttggtgccaacatattttaagtaaatatgtcattgtctaagatgacatattaaaaatatt

SEQ ID NO: 34871 - DNA, 1050 bp, Homo sapiens
agataataggaagtctgtaaagagatggtaatgatgtacttactaaaattcatagagatgggatacactcataagaggaaaataacttggagtggatgaggataatgctcattatattgattgttcggagaaggccatgctagagtaccatacatgcatattcaagtaccgcaattcattgtgtagagagaaggacaaattactcagatgcgtttagatgagggcatcatgatcacgtgactataacttcaaatttaaaattatttccagtgctcactttggcagcacatatactaaaattatttccatagaacatgtttatgatttgagattttttttaaatttaaaagtatatttcttaatttgcttcaaagcattatatttaaatatttagattcagaaatcagtccaattattttccttttgatttccatgaaaaagaatacttgttcactggcaattaaatgtcaagtctttttttttttttttaaacaggaacatgaatctgaaggtggaagaactcctttaatgaaagctgcaagagctggtcatgtttgtactgttcagttcttaattagtaaaggtaggtttgtataaaacagttgtctttttttgaaaggtatctacccctgccttcatttagagatttaagggtaaaggtcttttgaaggcaagagggtatcatatgaggagggatgctactgacatttaatgattgagtggatagttgataaacatcctgccatgcacagaccagcttcaaactagaaataattgtcataccaagtagcacacttgttgtgaaacgtataaaggaaagggaaatttctctgtgtaaaaactgaggatttaggtaacaaactctgctgtgttcatgtactatagcactttcttgaaacctggaattttatgatgtttctgccactaaaaaagtttgtggcaagtaacatttctactatttccctgcttctatgtttccttttttataaaatacagggagctggttataaatatagtacaaaaaatgttcacaatagaaatgtgacaaat

SEQ ID NO: 34872 - DNA, 1048 bp, Homo sapiens
gctgtggtacatcaaatctgggtgtgattttaatagttttatttatttttagttttaactgccttaggagttaggagagaggcactttcttatttattatagtaatataaatgttcattttaaagattcagtttattaagaaacaatcatgtttttcatatctctggaataagttaatgactttctttaaataattagaatctttattttaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggtaggcatttttgcatttgggagaagttttttacatgatttgtttaagtaaaaatgtcataatgcaaatatttttatgatgctatgatacactgaatgtgtgagtttaaaaaaacgtgtgatatacctttgtatgtattctgaacagtttaccttactgctgtttgaagtatctgcagctttaatttcaaccagttttgtttgtaatttttttaatgcctacaatattctctgtttctggaaatgagtgaagtttgaatttgtttaacttgaggaggtatgacttatctagaagaagtttttattttcgtcatatatgtcttatggctcctttattaagtctatgtattatttgttgactactacaggagctaacgttcatgcaacaacagcaacaggggatacagcactaacatatgcctgtgaaaatggtcatactgatgtagcagatgtcttacttcaggcaggcgcagatctggtaagctatgttactttttaaatcttaatatttaacaataagaaattaattttaaattatggagagtctagacaaaaggtatttctttaccttcagttttattgttttttttatttttatttttttgccattctttctctcacttagtcacatttttttccacactg

SEQ ID NO: 34873 - DNA, 1027 bp, Homo sapiens
ttgagggtggcttctagttgactttattatgcttataaatttaatgctgtaagttaaatataacttttcaaaatattataattttaaaaaatattttggaataataaaatattttcaagtaatcttgtacacttttggtttaggacacttagagatggtgcgatttcttttggaagcaggcgcggatcaagagcataaaacagatgaaatgcacactgctctgatggaggcttgcatggtaagattggtgaaatatgtcaaatatgtttatatattaaccagggagagacagagtagtatacaatgaatgcctttccaatgggtgctatgattctgtttgtcagaaccttattgaatcagttgtacaacattaacttctattaaagttactttctgaagctttacaatgctacctgcattttcttagtctcatataactataccaaagtcactcttgtaaagattggttgaggatatgaaataggaaaatatggccaggcatggtggcttatgactgtaatctcggcattttgggagaccaaggtgggaggattggattaacaaattaaaatggatgccagcagttcaagaccagcctggccaacataccaagaccccctctctatttaaaaaaatgttaaaaaaagaaaaaaggaaatataattcagagtatgtacattattaataagcataacatacctcaaaccaataaattgactaaacaaaaatttaaaagtagggcctaatttatgttacataatttcccctctctcgaggtcttttctgagccctagattgtcttttgaagagctgcattttagagtttgtattcgggaatggctcataacagtactcttaaacctttgtatctttgtttatttatgacacagaaatgggccaaaatatcatagaaaaatttatgaggagaacaggccagcggtagaaagggcccccaaagaatctgaagtttcttgtctcatcttcccttcagagagtaattattgaaaggatgttaaattttatttac

SEQ ID NO: 34874 - DNA, 1042 bp, Homo sapiens
ctcaccctagttctggccctggtgttgttttgttctatataagagtagccaaggttgtatgatgccttttggaataatttcatttataaacatgaaaataatccttatatatttggattaattgactaaaatttaacttaaatttgaaaaatatggtttatttataaagtgcttttgattatctgatgttaatagattttcagatagggagcacagctgaggtcccttagttcccttccccaatcctgtttataattaggcagaggctgatcttcactgggaggagaggaggtaagccttggagtgggttgattgggtggctctctccccttctcacaaatacttttgaacccagtactggctgcatttcactactgagtccctgctggctagagagctttgagatggggctgcttgtaactactctgccctctcgcctttgcttgtagccccaccctgctatccaaaagggggatctgaggttggggcttgcaggctttaattagaagctggatagcaaactgagctggtggagaacatctctgctacttccaggtatccatggacccccttcccttcctctccttctggtgaggttttgtaggatatagactgacaaggaggagttagggaagagagacaagtcaggctgagactgagcactaatgtggattttggggaggggagaatgacagagaggaaaagggatggtaggtagttgacaaatataagacgcggcagatactacacttacttatggaagtaaattttgtttaattgtttacctgtgactccactatctgtccttctcccgcctcccagttgaataagaattgattgtagctcattccaaataaagctggaaaaaattaaataatttttctattgttttttgcataggatctgaagtcttttttaaattataatttgtcgtctgctttttaaccacttgtatctttaaatgaactgaagcatatggtttatttgaaactgcattaatgtgtgtacatgtttatattataattaaatatataaatataaa

SEQ ID NO: 34875 - DNA, 1032 bp, Homo sapiens
aaacattaaaattaaaaaaaagcttgtgaagcatttctctgataaacattaaaacaacttttttctcatcttaaggtaaaacttagctctggggcagagttgcccagttcttttacaactccccagtctggataagtgtatatgattttccacatgtatttgactttggttttaaatggaaaaggagaatagggagttgatttcagaaagataaaatgcagtaggaaaggaattttatatatagatatatatttacatatatgtatatgtaatttaatatttattatggttgtagtcttctgtttccattttcttaatgtaaattagcactttaatttattttggtattttatgttaatgtctttttatttttcctaattaaaataggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggtacagtataaacctttcttaaaacaaagtttttaaatatgtgaaattataattattttatgtaatcttgtttctaagttaaaaaataaaacaatgatagtatatagtatgtaattaaaggttaaataagtgtttgcagtgttgcagtttgtttactatttaaatttttaaaatatagatttaactataaatattgtcactgaaaaatgagtattaattgatctaattgttttatcagaaacagttcttttaatatgaactgtataatagctttgcatgttgggaagattttgcttggtatgaaggggtacatggtattttaaatgatgtcaatgaacctgaaaatattgatagtacagaaaatgccctcctttggcagaccggacaattgcctagaaagatattttgtct

SEQ ID NO: 34876 - DNA, 1039 bp, Homo sapiens
ttcaaggaagcaactagaaaagaatcattaatacatgttaccattttcaaccgttggtggcttctttttgcctcctctaataaaatgaagccattttatttattttagcaattgccttaaaacaattgagaacatctgaatattctatttgggtttagagagtaaattatagcatttaagaattctttgttgtctaatggtgttttcatacaacatttttaagagcataaaagagaggttagatagtattaacaaggtcatgaatttgctgtttctcttggctctttattagtgttcattcatctagatttttgtgtttgtattaacttgctttaccattcttctcataggttgactgactcccttctttagttaacctcggtttctattccatagtaaatgttcagttttactagcctacaatatcattggtaatctccaaatattttttaatgtggtgcctactaagattggcaagagaaagaattaaaacaccttgaagggtatactaaaaccagttcaagcaggaaatagaatagaaaaataaagtcacaaatgattttgcattgaaaatactggaatttaacagcaaaaaaaatagaacatatttgtgagaattatatttattcaacaaagtttgagaaagatggtggacttaagtgcagtgagtactatgtgccacatttttatattagttaaggacagtgccatgtgccaggcttaatatgcccttcgcccacaagttcttaagttcagctgttgctagagtagatcctgtaaggttgttttcaagctggtatacacacatggaaattgaatgaaaaattcaaatgataatgtaaattagggtatatgcataaagaagtgaaagagacagagagagactactttgaaagagagaaaaggtatgctcttatacaggaaatgtcttatgggaaggatttgttctaaacatgcttaaaaatgatagcattgagtctagggactgtcagtgtcctgtgaaatgggaaatcagaagagatgtttaaaagacaaattt

SEQ ID NO: 34877 - DNA, 1050 bp, Homo sapiens
tacctattatacatgcaatgcatgtaaactgctactttattatagcataaaactgacctaatactgttcaataatgctttcagtaaacatcttgtaatacagtaaattttttttttttaatttttttttgagacggagtctcactctcccccaggctggagtacagtggtgggatcttggctcactgcaagctccgcctcccgggttcatggcattctcctgcttcagcctcctgctgtagctgggactacaggcgtctgccaccatgcctggctaattttttgtatttttagtacagacggggtttcgctgcgttagccaggatggtgtcgatctcctgacctcgtgatccacccacctcagcctcccaaagtgctgggattacagacttgagccactgtgcccaaccggtatttaaatatttgaaggattcatggttaaacttgatttccatccaaggtaaaattctagaatggattattaaaaggatcttaaccaaatagacttggaaacataatcagggcatgtgcacggtcctgtcttggagtaaagaaaactatttgtacagaagagtagagacctaatttagcattttccggcaatttgacattgctctagaagtttatgagagagaaatgcagattatgaaattatttaaaaatatacctcagaggagcagggaatgtttctcctgaagacaagaagactcaggttgaataaagtgttcttcaaatgcttaagagactgtcatatagatttgttttctgtggccccaagaggcacaagaagattcaaagatgttacacggaagtagattttacataaaagctgatttttggagataagataccttttcatacgatgcaaatagttgcttcatttttctaagttgtgtaattatttctattttttatattttctttatggtagctaacaagctagccttccccctacttccctttctttctttctccacctctctttcacttttcctctccctcactcctttatttccttccctttttaaatggaaattctcacatacaaatc

SEQ ID NO: 34878 - DNA, 1032 bp, Homo sapiens
ttacaaggctcttcccactgctgcttctacctttatatttcatgtggctccctgtattcatttttgttataggtgaggttaaatccttctcctgtgatctggattttcagattccccagtggacatgtgtgtttggagacaggttttcctgctcttgtactttgggaactcacagttatttgactgtcttgcagaatttgcagcgatgtgtcacttctttcagagaatctgtgaattattttggttttcctggtaatgttcctgcagtggttcttagagccggagtttgtggtgtgagtctccacatgctattctgcccatccaagtgggagctgcacattagccctgtctcctctcctctctgccatctttctttctaagtccaatgtttctttgttgattttctctgtggaagatctgtccaatgctgaaagtggaatgttaaagtctacagctatttttatattggggttctatctttacctttagctctagtatttatatagctttgtgctccagtgttaggtgcatatgtatttaaaattgttatatcctgttgcttaattgacccctttataattatataatgatcttgtctcatatttttgtgttgaaatctattttgtgcaatgtaagtatagctactcttgcgcttttttggtttccagtggcctggaatatctttttcaatccctttattttcactctgtgtgcatctttataggtaaagtgtgtttcttgtaggcagcaggtcattgggtcttgttttttatccattcagcctctgcatgtgttttggttgtagtcctttaagtccatttacattcagtgttgttactgataagtgaagacttactcctgtcatttggttatttgttttcaagttgttttgtattgttaacttccttctttccttcctgcctttcagtgaaagtgattttctctggtgatatgttttaatttcttgctttttattttttgtatctattgtatgttttttgatttgaggttaccatgaggcttgcaaatact

SEQ ID NO: 34879 - DNA, 1063 bp, Homo sapiens
ttcttggatgggtttttcttcttgaagtaatattttctctaaattcagaaaatgtttgtggcttttaaatttcatagtgtttacatacctaaaaaaatttcattatacagtttggaattttactttcaaactgttcatcagaacttttaattgcacagatatcttctagcatctggtgctgtatttaggaagtctgatgtcagtctgacccctaacaggtccccactgctaccatcctggaagttttctagactttatatccttagaagtttgaaatgtcaccaggcttatgactacaggttttgtggtgtgtatatatgtgtgtgtgtgtatctgtgtgtgttgtaaagccatcttataagaatatttatattctgcagctgcttttacaataattgataaatgataattcctggagcaggctaaattcataattgaattgcatcctactattgataagtaattttgggagaatttttgacaaaccatataactttaattctgttacagaaaaaccacttagaaactctagatttgagaattccatagaactttgtcttatttgaaatattcataatttgtccactttgtaaagtttatgttaaaaattttatattgaattgttagtaatgtcatactcaattgttgcaggcaaatagcagtttgaagcataagaagtcacgttttacgaaagtgctatagaacaaagctgtgttaactgttatatcactgattcctagattatagtagctgcttaatatttgtcaaattgatagacaagtatgaatgaaaaaatataagaatagatcagtggtttattctgtaaatagactttttgaaaggtaaattatctttaatgaggttcactttagttttatttactataatctcagaataccataatgaatcattgaccattctttttacaagaaagattttatttctttaagtgggtttttattttctttcaacttttcaaatttcagtcttatacttggattagtgttctgtgacattactgaagattttgtctttgtatgtatagaaaaaatatttgaattgt

SEQ ID NO: 34880 - DNA, 1028 bp, Homo sapiens
attatatatttttcaaaattcgtagatttgtaccacgaaaaaagggtgaattttactctaaagtatacttcaataaacctgattttcaaaaggaaggaaaaagaattaaaagaaaaagaattaaaagaagagaacataatatgttcctgattttacttatcttgagaaaacgagcagttgctttaactaattcttacaatattttattttgttgccaaaactttttctttcatttaaaaagaatgaggttgcatatgcatactttcagatgagttacatgtaccagcaagttaatcctatatatctcaagacaatacaaattgttatgatagctctttcagaatttattctagaaatatgtaaatggttgggtgattctttatatttttgtttgaaagtctaaagaagttgttttttctcattaattgtttgctaaaaatcacggtagaaaactgcattttttttttaaggtaagcaatatagaagggtatggagtaagtaaaaaggtacaattctctctttgatttcattctttgattaccactgttaataacttgggtttacccatcttgaaattttttgtgtacattcttgcacatgtgtatatgctttattttgctttttaagtcaacttaaataggtacataccatgtttttgtttttgtttttgttttttttgcttcaggctgcttttttccacctaacaatgtgaagatcattctgcatcaatattaatgtatccatttggtaaatattttttaagtagttaatgtttaaggcactattctagatacaggggatagagcaaggaacaaaataggttctttgtccaagtgaacttatattcaagtgagaggaagacaataaattggggggaaatgtcactattaataagttcatgaagataaataatgtaggcaaaagagatgagaggtgatgggacaaaatgagcagcacagatagttgtggtttaggcctttatgtgtaaatctgctttattcttaaggtagctattattccatatataa

SEQ ID NO: 34881 - DNA, 1050 bp, Homo sapiens
cccctcttgtagctggggagtgcacccacaagatctaacagctgtttcagagctgctcattttagagtgattggtagggagttggtggctcagaggtcctaatcagaatgtgtcctgggttctgaatgactagcagactatcattaaccaaataaattatgggattttgtcttaattatatacatatacatatacacacacatacacatacacatacatgtgtatatattccctaaaacttaataaagctcaaataataaaatcagatttcttaagtattccaattccctttaaaatgtaaatcagattttataattcttttgttcaaaactgtccattggctcccatttcacttaaatcaaaagctagtttttacaataagctaagatagcaaacattattatctatttacttatgagttacttatgtaactcagcatccaataacactgtaggtgctcaataaaatagttgctgaatggataactttcactatttggatgagatccaacagaaaagaatactcttagcttgacaaacaatggtaaacagaagtaacattagaacactagatccttgctcacttaaaatcagacataagtatatgtttgtgtgtgtgtgtaaatataaacgtatatatgtatataaacatacacatacgtgtatatatggtacatatttgaattaaatgaaatatatcagaatttgtggtacacgattaaagcttaggtcagaaaagaagaaagttttcaaatcagcgatataataatttccaacttaagaaactagaagagcaaattgaaccaaagcaggcagaatggaagaaagaataagataagaaaatcaatgaaattaaaagcaacagaaactaaggccaggtgcagtggctcatgcctgtaatcccaacacttcgggaggccgaggtgggcaggtcacgtgaggtcaggagtttgagaccagcctaaccatcatggcaaaaccatctctactaaaaatacaaaaataagctgggcatggtggcaggcaccagtaatcccagctactcgggaga

SEQ ID NO: 34882 - DNA, 1118 bp, Homo sapiens
tctggctggttagattttgatatttctccaccaatcttttggagtttctataattgtttagtttacagctcctcaatagttcttttcccaattctccctagttttctgcccccacgttttagctgcattaatttctctaaactctgatctttttctcctgaactaagtaagacttcagttctgtgcctttttttttttttttttttttttttttttaatcctgttcctgccttgggtttggtaaatactgctaggtttgacagaaagatgggaaggagtaggactgacttcatcgtttcttttcagtgggtcatactcttttatgcctgttcattgtctgaaaagaggtgggaagtctttccaagtcccaattgctctgttgtgcctataagccacatcgtactgtatttgaactactgattggtggagagaattatgctaaagtagacctactgtgctgtggcaaatttgcagtgaaaaatctttcatggctaataaagtgccacatcttagtctttgtagccctttctgtttagttgtgaagtcatttcattttgtgtaatatgtactcaatagaaatagtgtcagtgcagtgccattgtagatgcttttgccacagatgactgccagatagtgtccatgtttgtatagcagcatctaatatgtttatgtttcacagtatgtcttaaggaaacctaaacatttttagtgagaaagcctgaaaattgctccaagcagcttatgtttagaaaagtgaatacattttaaagcaatttaaaataaactgtttcaggttattcctaatggcaattactatattattagctctttaggaatgacatggaaaacttaattacaaaatctcatagaaaacttggaaaacataaaaaggttcaaagagaattataagcctgtgttagaaaaattaatggtgttatattttgatacatttcctttcagttcattctctgtgcaaatacagatatatacacatttttaatatattgggactgtattatttaaaaatatttgtttcttgctttttttcctcacgcactgtttacattttcctgtagtttttttttctattttattaatttttctgaaaatcattattt

SEQ ID NO: 34883 - DNA, 1023 bp, Homo sapiens
ctggaattacaggcacacaccaccactctgcgctaattttttttttttttgtatttttttagtagagacggggtttcacaatgttggccaggctggtctcgaactcctgatcttaggtgatccccgtgccttggcctcccaaagtgccggtattacaggcgtgagccactgtgctggcctaaattcttatatttcacaaagaaataactagttaagattttccaaaaacatgtggtgggtttaaatgttcacacatatcagaaagttttcgtttttaagattttgtatcacatctgcacaagtactttttttttttaatatctttctcagtttctctgttctattattttttagttttctccatgaaataaagtcaagggagatagctctagatagaaatatgctctcttctgaaaactttcattagacaaccagaatgttaagattaagccctacatatatcatttaaaaaataatcttggcaggtggatcgtttcgtaaatgttttatgaattatggaagaatatatcttttataaagtgttaggtaaatggaaatgctgaattatgttgacagtgattttaagtatttctagacatttaatgggtttcctttttcattgtcttgagcttttagtgttatagtctgattttctgtgaatagctttgttgttggtatcttcagtgactcaacattgtacttagaacatagtaaatgctggtttttcattttgagttattcttgtacagtgaaagaatcgccaccctctttccctctgcccaacccacaccttgggagtgtgtttagactctccttggctttggttaggtgtatatattgtataaagaagaactaaaagtaattcatattaactcagatcaatccaggtgatcagtaggttgggattttaaggataataagctttgtacatcatttgaaatactatacatttttctttattcctgtgttttttaatctctaaaatttagttgtaccatatagtttctcttaagaccccttctg

SEQ ID NO: 34884 - DNA, 1028 bp, Homo sapiens
cagcctctcaaagtgtgggattacaggcgtgagccactgcatttattgagtaccttcagtgtgaggcacttgaaattcaatgaggttagtccagctaattttgtctcacagaggtggaagtgcagaagtagaagaagatgaagaagaaatgtctgccattggtatctttttttttttttttttttttgagacagagtctcactctgtcacccaggctagagtgcagtggcatgaccttggctcactgcaacctccccctcaggggttgaagcgattctcttgtctcagcctctggagtagctgggattacaggcatgcgccaccatgcctggcaattttttgtgtttttagtagagatggggtttctccatgttggccaggctggtcactaactcctgatctcaggtgatctgcctgcctcggcctcccaaagtgctcagtaatggcttgagccactgcagccggcctctgccattggtatcttaaacagtcttgaatttaggatgcatagatacatattttaatactagtattttacttcattgattccatctgaatagtttgaaactcatgttttcagcagtggacttaaaaagcggatatcccttatgcattctgaatttttcagtaagcagatatttttctttatctggacacctttatgttgtcacttttatgcaaatctttttgttatatgtatttatgaatgtggtgctgacaagaacatccactggttctcatttttacctataaaccagcatacgcgtgtgtatacacatacctacaatacatatattcacatttatacttacatatactccacacacacacaaacatacacacacatactcatacactcatgttctgctttaggtggaatatttcttatctaaaatgtttgggaccagaagtgtttggagtttggattttttcaggttttggaatatttgcgtatatgtaaagataacttggggatgggacccacatgagatttacttatgttttatatataccttatacacatagtc

SEQ ID NO: 34885 - DNA, 1071 bp, Homo sapiens
ccataatcacatatgtattgttaaaaacaacagtaaatgtcagaaaacagaagcaccccataatcctagaatggaagagaaggggagagtgaaaggttttattaactttagtcttaggggcccccatttcttgtcagataaaggatttggaaggcctattcttggtttatggaaaaggagagtgttccagcatacgttccttgaactcaaacctatcattgcttgatagcattagaggaaaatttgaggaagggaaactttgttgacgacttgttttaagtctaaagatggagcagtttatttgaagcatagaaagaattgacctgggaggcaggaaataacaaaagccagtttgtagtttctgtttaagccaggtctcaacaatgtaaattactttgagcagcctttaaatgccaggcatacccatacctaaatgtaaacactaggtatggtatgaggtaaaacatagtgtcatttgtttgccattaattccacataccctttgcaatcagttctggatttgcatctggatttgactctgcatataactgtgtgccctgtctgatacttggttcccttattcgtaaaatgagattatcacagggaagaagtatagttgatgattctggatatggactccagtctggtgcaaactgcctgaattcagatctcaactcttcaacttaattagcttagcttgaaataattgggcaagttgcttaacctctttttgtcccatttccacatacgtaaaatggggataataataatatgttttaggattactgtgaaaattaaatgagttaatatataaaaagcatttaaaatggcatatagtaagcaaaatgtagtttaaaaatatgacatagctgggttgttatgaggataaataatatgtttatttttttaaaaaaagaaatcatatattgcttgacacagtatgggtatttcttaaataccagaaaccgtgtagtaggtactttatatcatttaatcttcatataaactgttaagaaaccataatctgtctagttgactgcacctagagcagtttctgatatttcaagttga

SEQ ID NO: 34886 - DNA, 1132 bp, Homo sapiens
cctgtattcttgtacattagatttttttaatatgatggattactttagaatttcatgctttaaaaagagtaatttgaacataaatgtagaaggcaaagaaataaatgtatccagcagtattttatttagtgagaatatacccaaatatttcccaaacaattctgggtctttaaaatactaaattctggcagaagcatcttttcacaacttactaccaggttaaaaaacccattaaatattggggggaatttgtattttatcagaaggagatttttttttaaagggtagatcattggactccccattcttctctcttctccacctgtatatcagctgtatatatatatatagactctgcattgtggttgggttttttttttttaaataatcaattgaagttcttaatttgttggagaatttatgtgttttttttgataaggattttttaaattttttttgaagttagatgagaggaggtgtaactttgatttgtgattcttgaaaagtagaaatgatgaactaagaataaatctggatacatgatttaaaactaatattgatttcagatctggatttttagtagacttgtgtcagtaacactttatatttgtagggaagcaggcagtctcactcactgtcagtataaattagttcaacttttttagaaggcagttaattgggtaacatctaaacttttattttattttattatactttaagttctagggtacatgtgcacaacgtgcaggtttgttacatatgtatacatgtgccatgttggtgtgctgcacccattaactcgtcatttacattaggtatatctcctaatgctttccctcctccctccccctaccccacaacaggccctggtgtgtgatgttccccttcctgtgtccaagtgttctcattgttcaattcccacctatgagtgagaacatgcagtgttcggttttttgttcttgcgatagtttgctgagaatgatggtttccagcttcatccgtgtccctacaaaggacatgaactcatccttttttatggctgcatagtattccatggtgtatacgtgccacattttcttaatccagtctatcattgttggacatttgggttggttccaagtctttgctgttg

SEQ ID NO: 34887 - DNA, 1894 bp, Homo sapiens
aaagattgcaaggctgggcacagaggctcatgcttataatcccagcactttgggaggccaaggcgggtggatcacttgaggttaggagttcgagaccagcctggccaacatggtgaaatcctgtctctactaaaaatacaaaaattagctgggcgtggtagctgcgcctgtaatcccagctacttgggaggccgaggcaggagaattgcttgaacctgggaggtggaggtttcagggagttgagatcatatcactgaactgtagcctgggcaagagagtgaggctctgtctcaaaaaataaaaagggggggtattgcagacatgtggtggcctctacctagttgtttaatactgctctttatgaagtaaatatgttctcgggccaagtgattttcggaaattgtctgaggtacaaatagaagacacagggattaattctaggaaattagaaagttgtgtagaatacaaatgtgactcttttaatgtaagatgcctaattctttcttgactggcttacatgctcgattttgagtgttaatttctgatccctttccatgaaatttgacaggaaactctttttaaaaaacaaatgtttattgtgaaaaattcggaagtacaaaaaattggaaaattctgaggcctacttccttccagtgcctctaaataagatgacattttatccgatggactaaggaccaagtatagaaactagtttgtccttaaggtggaagtcatgtgatcaaggagagctacaactactggaggcaaggtatgtctcctggaagagctagaagaaggaaggtggaaatagaaattgcctttttctcccccttccttctaaagacgtggctgatcttatatacttagccctctcatctttgctgaggacccattgtgtgtcccatggcctataaatcagggttctcatgatccccttcttgagtttgattaatttactgagcagctcacagaactcagggaaacacttatgtttaatacattttattgtaaaagatattacaaaggatacagctgaagagatgcatagggtaaggtatgggacaaggggcatggaaattctgccctctctgggcgtgccaccctccagtaacttccactgtgttctgttctctgaaagcccttcacgccctgtccttataggcgtttatggagactttattacataggcatgattgattaaactatcagccgttggggatcgatttcacttttattctcccctttttggagtatgggagttggggctgaaaatcccaaccatttaatcttcccctggtctttctgctaaaaccaacccttattctgaagctacctagggcctgtcagtcttcagtcaaatcttagcatataggaagccacataaccactttgaagattctaaggattataggagtgtatgccaggaaactggtctaagaccagagaccaaatgtatatttcatgatatcacaggcagtcttttggtactttaaataattgcttgcaaaagttacatctttaaataattgcttgcaggcaaaccattcaaggtttgttatgaatagattaggctggaaatagcagagcgcagagtggtaacagatatcttgagaccagactgattggagcttgtcagggaccccagaccattaaggaaccagaggagagccagtgatagcaatgagattccatggttacttgggtagtttttacttcctgattattttccatgcccttgatgctatcttgagttacttggaactgtttcttcattcccccagagtggtagaaaccggtgactcaagaaaattgtctttagatttaagctttttcttgtaatttaaatttttatccccaggtcccctagacctccattttgtgtctgtgtgtgtgt

SEQ ID NO: 34888 - DNA, 1038 bp, Homo sapiens
cctcctatacctcttaattcatgctgttaggtaagtgtgacatgtaaaaattaaatatctcagtctctcataaaaggggcctggtaatactttcttttgagggaggttaggtgacctaatgtttgtgaaaatatttgtgacctataaggattttcataaattaattgttaaaactgaagtatgaataaaaatagagagtcttatgaaaattctgactactgagatggttggttttttttttttttaatttaggagaatcccttattttaaatttctaattctattaaatttggttatcttattgaatttatagattgctagtaaatattttcagttctaattgtacattttggttaattgttttaggtggagctgatagtagataggttaaggggttgggattctgtaatgaacagttcacaaaataatggttgtattctgaatttgttaagtttttagaatttatgtagaatatgttcttaaattccttgagaacttaaaaatttgtagtactttatcatactgttaataaagagggagagataagggttatgggaaatgcacatccttttctgactcttaagtccttttctgggaatatgaaagcaaaccatatgcctatggcgtctctgctataggcttagcagataatactagggttctagataaaatgaaaagtatgaaggcaaagatttgatcatgctgttttctaaatctcaggacctttagaatgtatctctaactcactttgtggactcctttcacttgtaccttttcttccttttcttactctgcatccagatccccacctcacagtccaagatcctctctaccactcagtccagctttctggctgccacctaaacttcagtacctggcttctcttggccagatcgaaggactgtaatatgatttaagttgtgaatatgccttagtatgtgagatgtcttttcatatgagggagttcttaacctactttagcttaatcaccagatccttttgtcttttatgctaacacataaaaaacacaggcttggt

SEQ ID NO: 34889 - DNA, 1045 bp, Homo sapiens
cttacagattctagtacagaagtacttttatgaagaaaatataagcaatgccagcatctatatagtgttcttactgatttgatgatgcccttaggttgtctttgaacttgaaaatctctatacattattattgcaggacctataaactatgactgttgtgtagttctcttgcactatctttccaatgttctttgaagaactgtttcactgtttattttatctatttcaaatgaactaggagtaatttaaaacttacatagttgctgttcagaaaatgtcaaaaaagaagagcttgtataagatacaatgtagataaatttaattctattgagggggtaatatccttttaagatacaatgtagataaatttaattctattgagggggtaatatcctttaaaccaaacttgtctaaagttttcaccaaatgttaaactgtgagtaatgttttctttttatttatccatttgatttttttatattggaggaatcttaaaattgcagtatctttttccacttttattaaatcatatagtaactgtgaactgaaaatttaaacagtagaggaagatacagagtaagagttgaagattttttatatccctaggtgtaaattgtaagtgtatgtaatcctatgcctttttctgtgcattttcacacatatacagatatatctatgtaattttgttttgcataaatgagatcattataaaaatattgtttgaaactttctttttaaattaatattccatcatagattttcacgttaatacacatatagttatcttagtcctttaaatggctgtgagtattcccttgtcaggtatcaggacttaattgctttccagtttatggaaattttggttgtatccaaagttctgctgttacaaacaatactgaagtggactttttgatattgtttctgtattgtggtaagatatattccagaggtaaaactgctagaccaaaggtatgggaatctatttctgtaactgacattttattgtgtgtcagcactgtattttaaaaactagtgattttgtagt

SEQ ID NO: 34890 - DNA, 1067 bp, Homo sapiens
ttcttagaactacaaacttagtaggcatatgatgtgcccttccaattattgcaggcaagagttttactaaatgttctgcaactgtatagcacagatcattagatctccagcctgagatgtttccttgctacctgttctctaagccttaccagagattttaggagtttgttagagcagcgtgtcatttccaattaactgtattagttaaggtataggatggatcatttgaacaaagagactccagaacacatcaggcaagatagaagtttgttattcttttatgtgctactccagaggtagaccttcaggttattcacacatctaagtatctgctgtcttgcacttgatacaccatcccttaatcagtgctgtccaatactgtagccactagccacaggttgctgctgagctcttgaaatgtggctagcgcatctaaggatttgagttaaattttttttaatttttaatttaaatattacatgtagctagtggctaccatattggagagtgcatatgtagaatatttccatcacagaaagttttattggacagctctgctttggagtgttcatctacaagatctactgtggctcactagcatcatgtccatgtttcagcctgttatgggctgaactgtgtgtccccaacattaatattaatattttgaagccctaaccccaagtatttcagaatgtgattgtacttggagataagtcctttaaaaatgtaattaaggttcaatcaggtcatatgagtgggccttaatccatctgactgatgtacttataaaaagaggacatttgaacacaggacaccggagatacatgcccacagagaaaaggccatgtggggatacagcaagaaggtggtcatctgtaagccaaggagagaggcctcaggagaaacaaatctgcagacacccagatcttggacttacagtctccagaactgtgagaaaataaatatctgttgtttaaactacccagtctatggtattttgttatggtagcgctagtaaactaatactggagaaataagaaacagaaaggtcagcataggtaacttcc

SEQ ID NO: 34891 - DNA, 1059 bp, Homo sapiens
tcataaaatttaaattttgttgagataaaactagtaataatttaaaactgtgaagatgattttagccccgtataaatcctatacttttttggggcatctatgttcatttttggtgtaactgtgtgccttatgatcatagggatcattttgttttggtttttgaatactagtagggtagactttatatcttttatgagtgtctcctggaatactcagtgatttttgatattttgtttgttcttaagatgaggtctgtatgtacgatttttctagagtgtccttgacaactagattatactaaagagtcatccattctaattttaccttgaaggttttatagtaagaaaggagagtatctatattaatatacttgtgattgatgcaggtggagatatgttaaaatatgaagattgaattacaagacagtgtaggatgaaaattcttaagattttaaatatagcgttacatataattaaatgttattcattaatttatacctatttgtagaaacacatatttgcagaaaacttgacaaactcaaaaagatctaaagaatagaaaaatcacctattattctgtcttcagaattaatcattacctgaaatacgtcttttcattctttttccttgttatgttgtagtgaaattatcacaaagagcagaggtaccacttagaaattttgcttgctgaaatttttattgatgagctttcttcaaatatatcaattgaagagatgagtcttcagattatgatttttatatatttaaaaataaaaactaatgacggtatttatacttacaaaaatgtcttctagtatatagggctttttattccattcttagagtaaatgctgctaacagttggtgtatatcaaatgtttgtttctttcttgagactgagtgcgtgtgtgtgtgtgttagagtatgttaatatttgccacattattctcatttacttatgaatgttccataatataaatgttcataatttatttgatcttttattttggtagacatttagattgttttcactacattgctattagtgaagtgaacatcc

SEQ ID NO: 34892 - DNA, 1050 bp, Homo sapiens
cttcatgttttgccctttaattaatgaagcagtttacattgtgtgctgtggactgtcatatctgaaagcaaaagccttgtcttactcatctgtatatctcctgctatacagtaccatgtgtcttatgtaagtctttgtatctctgctaggttctcatgaagtcccatctctgtagtaagaataactcataaatatttctttattagccacctactgtgggaaatctttgggacttcaagtcttgaggtaacagaacttggttgcagctattatttacagtagatccctgtgggatgttttaattgaaccattatttttagtttagtcatttttaacctcaccaacttaactggagttagtattgtgaaagttttcagtgtttaataagcatcaaagtagcatattttgactctcggaaattcactagactatctgtttctgctgttacctgattatgccatctagttgattaggaaaacagtttttaggtccttgaggcagtgcagttgcatttatgacagtagtttatctgaatttttataaggataatttaatgggttaaaaaatgtggatttaatgaggaccttcataatttttccatacttgaccacagatgaaagggaatttttacttcacattggtatgcgaagtagtgcctgctggtaccacttatatttttgttaggaccagtaggaggcaccaacatccatggtgtaacctacaccaaacctaacttttttcagctttcatcttttcaaaaaaaaaaaaaagtaagtcattagggaattgaaggtggtgggtaaatacgaatacccttctagtcccttgaatcttacctatctggtacagttatgtccatccacttcttacccagaagcaaaataccctttctgacttaacagtgcttcacttcttaacatttttttgtctttagaaattattattattcattcctgaagggatgtagagttgtgggacaatataggtatcatttttataatgatttataatttggggtttcagttattgaaaagggaaatgttaactgtt

SEQ ID NO: 34893 - DNA, 1023 bp, Homo sapiens
ggaattgatgaatgcctggtaagtaccttaagcctcctaaaatttttaaagagtaaataaaaatgaatacttattcagtacctactgtttgtgaagtctaggtaaaggttaaaagtatggattttggagcttggatttaaatccttgatccatcatttactagcattgtgaccttggccgagtttttaaatctctactgcaatttcctcatgtaaatggtataaatggtaatgatagtagattctaccttataacattgttatgagagttaaatgagttaatacaattttctcgtattctcattttattcttgccataaccctatgaagtaggtgctgctatatttctttcattattcaataaatgtttggagttcctactatgtgctaggtattgtgctgtactgcgtgagcaatggtgaacaaaacttgtaagtcaccttgatttaaaaatacaccaatgaataaatattataagtttggggaggtgtgagagtgagcttaagtggttaaatgtacatcttgaataatgtgtgagtttcaaagtatacaaatgttggcagggagcattcattttacaggtaaacatactggcatagaaggattttaggcaacctcatcagggtcacatagctaataaatgtcagaatgggattgaacctgggactgttagattctacgcctcctcattcattcatttattctctcactcattcacatgctctgttatgctgtatggtgttgagtaccatatttcagatattggcacattcggcttgtataaggggagacgcttttttgcagttggacggccattgaagacaagttggtcaccccaagttttctttccagttcttctgaaaaactcactaaagaaaaagaaagcaagaaatacagaaaagtatagaaaaataatccatattcccaccacctagaattaagttgttaacaagatgaaaacttcatactgaaaaaccaccctttctagaggcgatttaccacttattccttgcctttcaaaata

SEQ ID NO: 34894 - DNA, 1025 bp, Homo sapiens
cctcacagaagcccttacaacccaaaggctcagtaaaacataccatactgacaaccaactgagagttagctttactagttattagctgttttaccactctcttgtctccttcctgaaatagaatctagaaaaatctttatttggagagggaaatctttatcagcagagggaaaacagctttaaaggctgattttaaacttagttctaagaggagaccaagtgattcatctaaaagtaccacttactatttattctcttccacaaacatggaacttattttgatgcaagtctggttttccgaaaattggaattattgaatcctggtctctgttgaaatagagaagtaccttttaaaggatttgacacatgtctatttgtagaagaccagattctcttttatctcagactggatgaagttgtataggtagagatattaagtgctgaagtatgtatgacaaaaatatgccagtccttgtttttattcccttttagcctgttggattctgagaataggtttgtattgatagacttatattggcctacttggatgtttaggatagtgtgttgctctggcggcatttgaaacaaggaagagaaagatgtaatggggtccttatccctaataaaatttgttatggtacttagaatcattcaattgtatgattcttctcaaaggtgagaaacattttacaggtaattcagccctttattttaaaaaggaggaaaacaaggtttagaggaaagtggttgtggtgggtagtagcaaaagtacaaatcaaagttttctaatgtctcagacctgtacactttttaataataatttatttccttttatcaccctcctgatatcattcagaaaaatagttactgaatagcaaggtaacacaatcatgcagctataggcaaaataccattacttaaaattttaaattctcgtgaaactattaagctctggtttagagcaaggttatgatagttgaatgcagtacttactgggatattctgctgcaaacttaacataccta

SEQ ID NO: 34895 - DNA, 1017 bp, Homo sapiens
gcctggcatggtggctcatgcctataatcccagcactttgtgaggccaaggtgggtggatcacttgaggtcaggagtttgagaccagcctggccaacatggtgaaaccctgtctctactaaaaatacaaaaattagccaggtgtggtggtgcacgcctgtaatcccaattacttgggaggctgaggcaggagaatcacttgaacttgggaggcagaggttgcagtgagccgagattgcaccactacacttcagcctgggagacggagtgagactttgtctcaaaaaaaaaaaaaaaaaaaaaaaaaaaagacaaggaggagccaccgaaagttgttgagttgagcaggagagtgtttggagtagttctttgggaagatgcattcggcaactggaggtaggataaatggagagagactgtatattggggggtgggtgtcagtgaagagttggttcttcagggacagtatgtgtgaccagtgtgaaatcagacgttgagttaaaggacagctcttgtggagctataggctgcctaaacttaacaccagcaactagccagtactccttggctgaagttgccactctgttatcaggaaggcgtggcaaagccagaagaaaagatgaaagcagatgcaagacaggcagcatccattgtccccacactcaaaagtaatcagatgtattaagtcacacgggagctttacaatcagtgctggggctttggaagtgccagttggcagaataaaagattgcgtgcagttggctgtgctgaaacagattcacctctcaggagggccttcccagggaaacgggggtggcagaatggagtggaaagatgcgaagaacgaggtggggaggcaggggccctcctgccatctgaactgcctacacatcacatcaaagctgtgggggtgaaatgtggcagctccagccacctggatctctctgacagggccacagagcagagcctcagcctcttcacctgtaaaatggcagacatcttgaggattaaattaaac

SEQ ID NO: 34896 - DNA, 1037 bp, Homo sapiens
gtagtatattttgaagttaggtagtgtgaagcctctccagttatgttttttttttttttttttgctcaggattgctttgactattcagggtcttttgtggctccatataaattttaggatttcttttctttctcttccttccttcctttctttaaatgtttgctataattcagcagtgaagccatcagattgtgggcttttctttgatgtgaaactttttgtcatggcttcagtctcattacttgttactggcttattgaggtttttttgtggttcaatctcagaaggttggatgtgtccaggaatttatctattctaggttttccaatttgtggttaaatagttgttcgtaatagtatctatctttgtatttctgtggtctgagttcttacgtcttctcttttgtttctggtttttttttttttagtctattacatttttttttgattttatcttttcaaaaacaccagcttttgttttattggtcttttgtattgtgtttttagtctcactctcatttttttctgctctgctctttattatttctttccttttaccaattttgagtttgtgaagtctgtcccgggggtaatccagtcatttttatttttctcctgtgcacgtcttcttttctttctttcaaaatagctgcttttaagattttttttctttgtctctggttttgataattagattatgacattccattgtatagttttcttcatgttgcttgtgcttagggtttgttgagctttttgaatccattggtttatagtttttttcattaatttcaggaaagttttggctattactatttcagatgttttttcggtcctcctccttcccctgcttcctaccttagggatctccaattgcatgtgttaaaagaaaaacttaagacaaattaaacttaacagagtttaaattaaacttaacagagtttaaattaaacttaacagagtttaattgagcaaagaacgatttgcaaggtgggtagctccaaaatgataataggttcagaccaaccttggctctgc

SEQ ID NO: 34897 - DNA, 1072 bp, Homo sapiens
aatatttatcaatcgttatgtgtgagacactggaaataaataagtcaatctttcttttcaaggacttcatgatctagaggatcagcaaattaaagcatagtatcatattgtatttagacagagcacaggaaggaccattattattctcagcatggcctccagaatgtttctcttttgaagttaggtgaaaccctcatcattcttctgctaaacttcctccattagcttcttatcactgaggaaaggccaaagtccttatagggtctataagtgcctgcaggattgactccaaccaaccctctatcccatctccacctactctttctccatcaatctgttctaccacactgatttccttgttattcctggaacatagtcagacatactcccacctttgggcttttgcacttgctatttcttttgctttggaacattcttcccccagataacccaatggatttgctttttctcttcttagctcacatgaaaccttactgtgaagtcttgtaactcattatgcctccctttatgttcgatgccttctccttgcttatttttttttccattgcatttacctgacatcgtctatatactcttatttatatattgtctgtctcccccagctagaacgtaagattccaaggcagagatttgtgcttttgttttcttcactgtacttttccttcctatgcaagtagaaaaaataattttttttttttttcgagtcagaatctcgctctgtcgcccaggctggagtgcagtggcatgatctcggctcactgcaacctccgcctcccagatttgagcgattctcctgcctcaacctcccgagtagctgggattacaggcacctgccaccacacccagctaatttttgtatttttagtagaggcggggtttctccatgtcggccaggctggtttcgaactcctgacctcaggtgatctgcccaccttggcctcccaaaatgctgggattacaggcgtgagccaccagggctggcctaaaatttaaaaatgagttcaaactaccagattaatatattcaaagagtgaaaataaaacacaaaata

SEQ ID NO: 34898 - DNA, 1024 bp, Homo sapiens
ggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgact

SEQ ID NO: 34899 - DNA, 1092 bp, Homo sapiens
gagccactgtgcccggcctagtcactggttttaagagttcaaaaccaagctgccaataacctactctcttagcagtcttatctctttacagataaacaataagcccattttgattcttaggtattaagtaagttgccatgatttttgacttgtttaccttgttagctacacatgtaatacttttatttgaactctgtaagaatgtttagattgctttggggaggagatgggagagatggagatagtatatatcacatttacaatgtgaatttttaaagtgatatgttaccaaactagaagtcctaaatttgtcagtgattaaacttgggatcttgagtgaaacccttaaattctgagcttcttttatgtcaaatattacacaaattattcttgtattgcctattttcctcactgtgttccttgtgttattgggagaatcaaataagattttatgtatatctatatacatacacacttaatatgtatagactgcataaatgtgatgattgctgttaaaatttactgattgctgtaatgtcataaagccaaagaattttgaatttcaaaaaactaagcaaatatttagtaagctatacctcactatctgaaatctgcttggttcctgggtgatggcaacagtttggttaaggaggaatacctgtagtactaatatttgatttttgtataatccagtagatctagaagaagctattttagcaacctagtcattgtcctcactttacattttagtgtcatgctgttttctaacctactagtaataagtacttttgcctctttttcaagaagctcacctagtcttattaaactaaaacaggaatatcaatattaagtgatttttacattcactcctttgaagtagtttttatgatattgtaaactttagtatctgctctatttctattctcaggcagaggagatatggaacagaatgactctgacaaccgtagaataattcgctatccagatagtcatcaactttttgttggtaacttgccacatgatattgatgaaaatgagctaaaggaattcttcatgagtaagtgatttattttgctgttggagtttttaaat

SEQ ID NO: 34900 - DNA, 1021 bp, Homo sapiens
ggcatcatcagatatctacttaaagtcagattcctaaatcaatggcatgaattatttgtaagatgttggaaattattaatatttaactttatctgtttttaattttcatccttaaagaataaggaagaactttattttgctacttgtagttactcgtgttttgataatctgttttgaaaagaatttaaatcagtcaagaccagggcctcaagttctttgataacatttggattgaatgagtctaaggtttttcttaaattttgtaataaaggtgcatttagtgtttttattaattgccagtaatacactcactttattaaactttgacagagtacgtttattctctaattctgtttatattcatactgaagtatgcctttagacccccttagttgaagtttctaaataactgcctttttcagcatcacattttgcatcaaattattatatagaattaaaccccaaatacagatagcggtggtctcagggctgtcacttacgtatctttgtcagacatagaacattatcctgcatgttttgggtcagagaactaaaaatgtaatttaatttaaatgaacaaatagttactgaacatctgtgtctaatagcactgtgcttggttctttgggtgatgtaaaagtaagttaagatatgggccttgggcactggcgtgcctgtagtctcagctgcttgggaggctgaggcaggaggatcacttgagcctaggaatttgaggttacagtgagctatgattgtgccactgcactccagcctgggcaatagagtaagactgtgtctctctaaaaaaataaaagatacagactttataggagtaaatacatataaataacaacaaaacctggagagagttaaaaatattcattttataactagtagaattctagaatatggtaagcaacttcatcttgagggaaataggacattgacatagaggaaaacagaatttaggaagaggcaggcaaacttggttaaactgttagcataggagttaatattcctt

SEQ ID NO: 34901 - DNA, 1026 bp, Homo sapiens
gtgaatcagtacacataatacactaaaaacattgcttagcataaaggaagctcttacatgttttattactataggagttgtgttttcattgtgaaaaaattagcttcacatctttgagcttaatttagaaagatgttaattctaattgctttggataatgccaataaaagactaatttacacatacttaagaacagtacaaaaatattaaaaagaaattagatgctggcgtaattttggattttagacttggtctctgaattatttcagttattttaaatctaaacagtttaagcctttagagttagtaatcatttggagatctggatacagtattaaactctgattcccaaacaaatctaggtagctgagtctttgtatctgaagaaaaaaacagggtcaattactatagcatctgtatttagaatgtactaaatcatcaaaaatatccgatttttccacttaacaaaaaatagatgtgaatatctaatgattgtctacttactgtgccagataaactaagcattctatgtgcattagtcatttaatccttacaacaaccatatggagtagttcctgttcctgttttataaccaaggaagctgaacttgaagaccttaagtaacttacctgtccaagatcacgcaactaattagtgacagagcgggatccggaacctagtctatgacaccagaattctgcttcttaggcttctcttgacaattcagtgttaatcattaattatggttttgcaggttttatggcaggaattcttcctatgttcatggtggagtagatgctagtggaaagccccaggaagctgtttatggccaaaatgtaagtatcaatttcatatgtagtttagaaattttgtgttaagatggagattttaaaaaatagccttcttgtgtccatggctttttttttctttctttctttctcttttttttttgagacggagttttgctcttgttgcccaggctggagtgcagtggtgcgatctcagctcaccacaacctccgcctcc

SEQ ID NO: 34902 - DNA, 1041 bp, Homo sapiens
gtcaggagttcgaggccagcctgaccaacatggagaaaccccgtctctactaaaaatacataattagccaggtgtggtggcgtatgcctgtaatcccagctactcgggaggctgaggcaggagaatcgcttgaacccgggaggcggaggttgcagtgagctgagattgcgccattgcactccagcctgggcaaggagagtgaaactccgtctcaaaaaaaaaaaaaaaaaattatttcaggttagtctgatggtagtgggttatcagaacttattaacattagtgtcactaaaattggtatacaactccccactgctaaatttggctaaaaagaaaatttatttcatggtggttgatgacaaagatgactttttaatagttattcttgtgtttgctccctcagcatttgacattgtgcagcaaagaaatggttatggagaagcccagtccgctgcttgtagggcgggagtttgtgaggcaatattatactttgctgaataaagctccggaatatttacacaggtaaattttaaacaaataatttggtatttttatctactttttttcttgggtatgactatatatattttgcatttcctgtctcctcattatctgacagtatctttgtaaacatgtctaaactgtattcaatattttattcatttgatggcaaaaagtgtttttaactgcaactcacagtaataaaaacattttatgtcatattctggtacataacacattcatatctatatatgcacacgcttattcttatatgtactctagtattttatttttagagtcatggtctcctctgtcactcagggtggagtgcagtgatatgatcatagcccactgtggcctcaaacttttggcctcaagcgatctcccagcttgcagcttgcattcccaaagtactgggattacaggcatgagccaccaagcccgacctttatttcattaaaaaaaaaaaaaaacaaactttgggggcaggtgctggagaactatataaggtttacatgaggctggacacagtggctctct

SEQ ID NO: 34903 - DNA, 1029 bp, Homo sapiens
aggcaaatgcagaggaaacattttaagaaacaggaatgaataaaatattctgatgaagattcactgggattttaggtgcgataggcagagttggagagtaaaaagcctctaaactatactggataatgttttcggttttttgttttttgagacagagtttcgctcttgttgcccaggctgaagtgcaagggtgtgatctcagcttactgcaacctttgcctctgagttcaagcaattctgctgccttagcctcctgagtagctgggactataggcgcgtaccaccaggcctggctaattttttgtatttttagtagagacgggctttcactgtgttagccaggatggtctcgatctcctgaccttgtgatcctcctgccattgcctcccaaagtgctgggaagtaggcatgagccactgcgcctggccttggataatgttttcatttgacaagtaaaagacggatttgttcatgagagagctttgactgtgtatagagctaatgtatcagataaaattttacactgtgcattcctgtgtgagattcttcacattttcaggtgtcattggaagaagtggagtgtgatatattgtatttaactttttctaaaaaggttgttaggtgaggctaacaaccaccttattgaagatggtagttatctttgaaggtgctaatctaagaactttctaaagatttctttttgtgtataagtatcctttaatcttggctatctttttttttttttttttaaacagtgtctcactcctgttacccaggtttgagtgcggtggtgccatcttggctcgctgcagccttgacttcccgggctcaggcattcctcccacctcagcttcccgagtagctggagctacgcttgcacactaccacgccccgctaattttttgtattttttagtagagacggggttttgccatgttgcctgggctggtctcaaacacctgagctcaagcgattcacccactttggcctcccaaaatattgggattacaggtgtgagccactgcacca

SEQ ID NO: 34904 - DNA, 1029 bp, Homo sapiens
ctagtgttccgtcgtgtttgaccaacccccctctccctgccaccgcgggtttaatccgaacgtgttcggatactggaactgtaacgtgcgccttcttcgtccccctcttatgcagacgatcccttattgactcgggaatggcttttgggggatgggttcccgcttttgttgggatggggggacagaaaggaacagaagcttccctagattgtgttgattttgttagtggaatctgatagaatttttcctgcgtctctaaaagcagatttcttaagatggccctttgccgctttggggcgaatatagattttcgtctataatttcctgcatagatcagcttttttccccaagacatacttaatgttctaacggatttggggggtgggaggagagtgccttttccttcataacaacaacaaaaaaaaggcacttgcacttttagctggaatagtaaagtcctgttctccctgtatgattgttgtgggatattaacttggattaagatactgtggttttaggttcaaggctctgtaccttgttctggtctttcaaacgttagtgttgcaggtacctggatctaggaaacattaactgtcgttaagagagccccggtgtactagagtgggagatgatggcaatttttctctagctccatatttggcagttaatatagccttaggcatgtgaaccaagtttctaagtaaacttttggccctgttagcatccagtggtctttttgataatccaagattcctggtcttaggagataaacggtacgatgagtttgaacctcaggattgaattatcctttctttggcagtaacatttttcttaaatgtttaagattactcttatgggcctttatgttatgatttaatctttacaaactaattctgaaaagcagtcaaggaattgtaggaataataaggacctagaatgaatttcttactaagagctgtcatagttcagattgatattcagggtcgaaatattagtaatagtgaaaaaacatcaagagtgaaccagaat

SEQ ID NO: 34905 - DNA, 1763 bp, Homo sapiens
tcatagctcactgcagtctcaacctccctgggctcaagtgatcatcccatttcagcctgttgagtagctggaattacaggtgcacgccaccacaccctgctaatttttgtattttttgtagagacaaggtctccctgtgttacccagtttggtctcgaactcctgggctcaagtgatcctcccactttggcctcccaaagtgctgggattacaagtgtgagccactacacccagcagtcgggatcatttagatagtaactggcagaacagggctacaatctgaatttgggattcatgcttctctgttcttacaccatgctgcctaaacttgtagtgataattccaaggaaaagttctttagattatctgtgatgtgctcaggtctttaaaaagcgcactttgaagaatgcagataaggcaaaaggagtgtttttatatacttttgcattatctttttctccatgtgatcgtcaacagtttctactaagaatttctctactgaatgtctgtactgagaaagtcatgtaatacaatgtgacaaacttaaattttatttttctgcagtttctacagcagtataatcactacaaatccaatgtggagattttcaaattgcaaccaaataaacccagcaaagaactagcagagctggtgatgtttatggcacaggtaagaatataattgcttaaataaagaccagtattaacacacagtttgctgaatgttttttcactaatactcaaccttattccactctggaatgggaacttaattaaaatatttttctaactttccctttttgcaaattttattttctccctatcatgagttagagaatgtcactagatctttttgcataactaaccaggacaaaactttaagactattttttttcttcaaattcatcataaaagcaggtactaaatcatgccataaatattactaagactagagaaaccatgataaatgttggagaaattaacatgtagaaggaaaagaaggttgtttggaaccatctacttctatgaaacatagccttttactctcgttttgcagaacatcctaaatgtatgcatctgaattataggagagaaagagagcaacttcagaagagcctttgctttgttacagattagtcactgctacccagagtacctaagtaattttcctcaagaggtgaaagatcttctctcctgcaatcataccgtattggatccagatctgcgaatggtaggaccagtagttggatgaataaattgtgctgtgttcatgtgtgctgcgttcatatatatttaaatgagaacagcctctaagctaattatcttcagaaaacgtaaattataatgtattatcctttcctaaaaatccttctatggcttctcatttatacttagagtaaaacggaaacttaataacctggctcaaaagtgcctgcatgatctgcttccagcctgtgtttctgatatcatattgttttcagctacactgtgatctttctattcttccagcacactaaccctacaggatgctctttaaccttttgagatgatttcttctagtcattcaaatctcatatgcatgtagaatcctaatcacaacttgtcatttttataatgccttaaattagtaaacttacccattagacagtcagtttgagcatttcatcattgtccttttagtggttggggttgagtcctggctgacattcccttcacgaggccggtgtacctgtttgccccacttgttgtgaatgtcagctgctg

SEQ ID NO: 34906 - DNA, 1031 bp, Homo sapiens
ataccaaaagttgaccaccattaaatttagcaacatggggtcgggcacggtggctcacacctgtagtctcagcactttgggaggccaaggtgggtgaatcacctgaggtcaggagttcaagaccagcctgaccaacatggtgaaaccccatctctactaaaaatacaaaaattagccaggtgtggtggcgggcacctgtgatcccagctactccagaggctgaggcaggagaattgcttgaacctgggaggcggaggttgcagtgagccgagatcgcgccactgcaccctagcctgggcaacaagatgaaactccatctcagaaaaacaaaacaaaaaaaaattagcgacatggatgtcattggctaccctgattcattgagcagtttgggaagaggaatgggtgcaaaaatctgattacagaaggtttaaaaacaattggagtatgattctatgtatatgaaatgtatatgaatagaatatgtccagaataggtgcatctatatggatggaaagtagactagtgtttgccagagctgagggtaaggggtataggaaataactgctaatggattggggtttcttttggtgatgatgaaaaacctatggttgtacaacttggtgaatatactgaagaaccgaattgtatactttcaaagggtaaattttatggtatatgaattatatctcaatttaaaggattttttgaaaaaggagggcaattaggtaacatatggacaactctttaaaggactttttctgaagagagaaatagagtagaaggtacagagtaaagtggaatcaagaaaggatttttttttttaagacacagtcttgctctgttgcccaggccagagttcagtggtgtgatcacggctcactgcagcctcaacctcctgggctcaagcaatcctcccgcctcagcctccagggtagctgggaccacaagtgtgcaaccaccattcccagttgatttttttgtagagatgaggtcttgctagttgcccaggctggtctccaagctgaaaccat

SEQ ID NO: 34907 - DNA, 1099 bp, Homo sapiens
ttatttcaggaatgcaaggttggttttaataacaggacatctatcaacatgacttattatagcaacacattaaaggaaaatatataatagaaactgtaaccaaaaatgaatagcaaatactccaaaaggcaaaacactaaaatcgcatttagaaactagacaacggacacccaatattatcatcattatttgttgctatcttggaggttttcataaataaaacaagcaaagaaataatataaacattgggaagatgattaagtgatctatttttgctgatatgattgtatatctggaaaacccaagggaataaaccatagaattaatgtagtaagctggctagatataaaagtacaaaaatcaactttcctttttactatctggaaataggaaaatgttccattcactatggtgacaaaactgtaaaataggaatatatttctgaggaaagtataggtatttacaaatagataaactatattcttagatgagaatacttaatacccactttacaaaattaaaaatgaattacagctttttaaaaatagattaagctgggtgtgatgacatggcacctatagtcacagctactcagaaggctgaggcaggagaagcacctgagcccaggagtttgaggctctagtgagctatgattgtgcctatgaatagccactgcactctgttgcctgggcaacatagggagaccctgtctctaaaaaaattttgattaaaatttctttaagtttataaagaaggataagtgtttgagactagcttgttcaggaacaaaaaagaaatagtgaaggggacttctttaccagatttcagaacctattttaaacctcttataattgaatcaatatagtgtctgcatgggattggacagaacaatgcatggaacagagtagggaatttacaaatagatgcaagtgtgctgaaaatttaatatatgagaaaggtggtatttcaattcagtgggtttatttaataaataatgctggagtataactatccataaggaagaaaagaaaattagaccattgcattgtataaaaataaagtggactaaagactttaagaaactttcaaagctgtatgt

SEQ ID NO: 34908 - DNA, 1111 bp, Homo sapiens
atctcacttttggtgatgctaagattgatcagtaggttcagatggtgacagcgtatctttatcttactactttaacctaatggtttcattccttgatgatcattgcctcaatcagttatcttattaggagttgcaaaatggtgattttctaatttcctccctatcacactgaaatttcttctgtaaaaggaactttttcttcatcctccaagactgcttgatcaccctgatgtacagtttgtatagtaaaggcaagataattttttttctttttaatggacaatttttgtaaaaaggagttggcggtctcattatttctaatggtatccaaggagttaggatttaaaaaaaatttgatctttactttataaaattaccattttgaatgcatgggctttaataaatatgtttcagttgttgcatttggccagtgggagaccttaacttctgtgacactccagtctagttttttcctacctcattgttagtcctccttattgcttttgtccactcatcttcctctctctgtctctacagagatgttacacatactgttggcctttacctctaccccatggcttagctgactccttcctttaggccctaactgaagtgctaatggaactgtcttctcttgacccctctctcaggcttgatcagctcccttatttagtactcccagaacctctgtacttctctgaaggacttatcacaattgttaatatttgtttgatgtgttcagtttgtttaatgcaccttgtctaccttgtttaccactgtatctttagtatttggctctgagcacttagtaggtactcagtaaatatttgttgtatgaattaatggtgaatgaatgaatgaatgtgtttataaaaaaccaagagagactgtgttgtcaggaaatttaagggagaagggctttcaaggaggatgtgtattcaacagaaggtgaagattttctttgggggccaaaggaataatcaacagcatgggaggctgactgcatatgtctcggtatagagatcacagttgattcatctcatgtaaaagttgaggaagataaagcccaggaatttcttgctcaaggatagaaagcgaccttataataaac

SEQ ID NO: 34909 - DNA, 1031 bp, Homo sapiens
agagcagatgtttgtgggtagataatgagtttgaggtgtcccttgggtagttgtatatatttatgaaagccatcagaacgtaagtagtatttaaagtggtagatatggatgatgtaatttaggagacctgattccagagtaagaggagagtactagaacaaaactcttagaaacactaacacttaaatgctgccatctcctatccccaagccaagtaggattttgaccataaattagcgagcagcattgttaggaccactgcttgtcctatctcagtatagagatgcccgtccatgtattcctcatacttattagctcccttttactaatcacagctattcctatctcagttggcaatacctgtgaatcaaggggaaaagtcacatttgactttgtgacaaccgccagaagtcctttccaagccaaagcatggattatcgaggatccttcagaagactgttggatctttcgacaactgatactttctgctctgttagctctttctgtcttcactactctaactagcttagattccatggccttccatttctatatctcttgccaatatgctaaacttccttgtttttgtgtcacatttgcctgaaaaaaccccaagcctttgtaagcccaactgtctgtgtagatattgcttgagaaagatcacacattatggaagaggggataatacctctctaaattcttgatcaccaacctcaggtctcaatgttgcctggtaatcctgtgaaatttctactttcaacttattctcctgctttctatagcagtaattttaaacctttattctcttcaaatctcaaatttatctgttcttacttttagcagatggccttgactgctacttccaagacaaaaaagggctgagcgcagtggctcacatctgtaatcccagcactttgggaggctgaggtgggcggatcacctgaggtcagagaccagcctggccaacatggtgaaacccatctccactaaaaatacaaaaattagatgggcgtggtagtgcacacctgtag

SEQ ID NO: 34910 - DNA, 1215 bp, Homo sapiens
agcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttg

SEQ ID NO: 34911 - DNA, 1027 bp, Homo sapiens
caggagtgaactcctgtaatttactaagccttgggcattattttttaaaataaaatttcaatttaattcaatgtagaaacaagaagacattggtaaacaaattgaaattcaaactaaatctgtgaaccaaactgaaaattttgaaaatacttcaggaccaaaccataacccaggagagagttcatcggctttgattcccggtcaaggtgaccctcaactattgcacctccctaatcagggaagaaaagaaggaaaacaaagtttttgagaagactctatcctaggcctcgtttccttcccacattatagcttcgatctccagctttttaaggcttagtagctgcagtctctatataatgttatattgggaatgttatattgaaaatataacttggatgctgaaagaaaggaaaagtcttgcttattaaagtggtgtctattttcaaataaaacccttttctttcttttagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattggtaagtaggcattttaataccattaagttggattttggaagaaaggaaaaagctaagttaatgctctttatgattttacatttaggagccattaagttatgttgaaatatacatatataaaaagaaaaatacttcttttcttttctttaaagtacatcttggacttttttctaagatgtatcaaataaggtcttttcaaatgatgacaaaattcagattttaggatttgttttcataatttcttcctgggtgttcaggattagcaattgtgcaaataaatatgcccctaggattttttggtagctaataattttaaaaatgtttatttgccccttgttttcattcagaaattctagcaatgaaatttgtataccatttcttacttcagatttttatgttggattttata

SEQ ID NO: 34912 - DNA, 1050 bp, Homo sapiens
tttaaggttgtgaaaatcctatgctatacttgctatgaaaaaggatgttataaaaaattcattaaaaccaaaattgctaaagacagatctaacagacttagaactaatgtttgtgtgcctttggcatattaattatgcataaaaatagaccctgctaattccaaactagtcttaaccatttatgaaaggaggccaaaatgtctccttgaaaaataatatttgcagctaagaaagttactgtctcttcttgattctgcagtactgaaattcagactttttatttattcagatcacctttcttacatattatttagaatatgcggcattttgccacattgaagattttaccaagaagaactgggtaaacagcagaagatgaatgcctggcacagcgttgtgctctacgctgcggtatcatctgtttcttcattaattatttattgtgtcccttctgtgccagaaaccatgttatgtgctggggatccatgaaaaagatacagttcttagtatcagacccaatctgacactaaagactaatgaacacattttccttataaaacttgtgaagtttcatgaaagcagagagaaaacacatagttcagaggggccttctgagagatggcacttctgaattgagccctgaagcccaagtagaagtgaaccaggtgataagggccctgcagagacttctgggtgaagggcggtgagtgactcaggccaaggcactggctgagaacttgtgtggtgggtgctaggtaacagtagatggttgcgtgttactggtgcataaagtgcctaccaggaaaagacagcgacaggtgacgcagttgcatcagatcacaacaggtcaaggactgtggactttatcctttgagcaggggtggagtatctgttcccttaggcacttttgacaggcttctctgaagcctgagatggatgaagcatttgaaaggaaaaaggctggagagagggagaccagttaggagcctacatacagtattgtcacagtccaagccaatgatgaaatgtgccttggggtagaaatgggga

SEQ ID NO: 34913 - DNA, 1050 bp, Homo sapiens
gcttcccttgagaagggagactaaagacaggcatctggaagctgtcactgtggcgcgcgggcagacaggggatcccattggagaggaagagccgtagtagtcgctgctgccttcggccgacccaacggccgcctgcttgggaggaagaaaaagaacgcccccgctgaagaattaaggcagccattggttgctctaggggtaaggaccgaggcctcccctgggtgtcactggagcagccacacgtgggggatcagccgacttcattcgatcgctggcgacagacccggcgacccgtaggaatgcgcgctggggctgcggctggagggcgtggcgacggcaacaggcgggtggctcgagtgggtgcgactctgggcgcgtgggactgagaactcctccgccgtggggaagatttttttcccagcagatgttggggtgttactgcgtgtctgaggggccggcggaatggaggggtcccggtgcgtgcagggcagcgaggtgtgtcagatgagctgtggatccctgcggccccacgtgggccggagaggggggcccacgacaacaagcgattgaggacagcgatggacagggcggggaaccagctgggtggaagcacagggagtgtggtgaggagggaagggctgtgatctgccctcggtacgacgccccaagggacagcctggcctcctgaattagggaaaagacaaccggtctctttagacgggcgcctcagagtctgacctgagtcttcaaacgcccagatcccctggggccttgagtctccctgtcccgctggccctgcctcgcctgcgcttcaggactccgacgcccccgcagccttgggctaagggtcagtcgtccccgggcgcgggtccggctgccctggaactgatgctggatttcgctggtaggtgggctaggggcttggtcaccccgtctgaattccactgtcaggacagctgtggaaccgccagagaaaagtctggccatgaaagaaaggtgaggggcgccgacgcagagcttatttattcagtctgtgggcggactcagacg

SEQ ID NO: 34914 - DNA, 1048 bp, Homo sapiens
ttattttactaggttgaaaattgcttaagcacccatgtgaatcaggaacaccatactttttaaaggcatggtaattttaattatcatttacattaaggtggaaattacaaacaattagcataccaggccctacttacagcacagggttaatcaatgggttgaaaaaaaccactgttcctctaaactttggtgtgctttgctttccatttctatggtctgtgcttttaagagctgtaattagacacggcaactccagcagcagtgtgattcaccaaaagcagttcagcaggaaatgacagcttttggaataaaaggaactctagaagaactagggaagtttttcaatgcattagctttttttctttaacagacagggtctcactgtgttccccatgctagtctcagactcctgggctcaagcaattctcctgccttggcctcctgaagcactgggattagtttttgaggcttctctctaatctttgtaagcggaatctcatctatatttttgaggacccataagacaaaaatttctttctaactgaataactaaaagcctactaggcataggttccaattcaaaccaaacaaccataacaatattttcagaaaagtcaatgactaaagtatttcaaaactccctagcagaatgcctggcacaaaggagacatttattaaaagttaattgcaggccaggcacggtggctcacgcctgtaatctcaacactctgggaggctgaggcaggcggatcacctgaggtcaggagttcgagaccatcctggccaacatggtgaaaccccgtctctactaaaaatacaaaaattagccaggtgtggtggtgggcacctgtaatcccagctacttggaaggctgaggcagaagaatccgttgaacctgggaggcggaggttgcagtcagtggagattgaaccactgcactccagcctgggcgacagagtgagagactccatctttaaaaaaaaaaaaaagttaattgaaaacaaaaatgatcatggtgatgatttatacagagatatgccactgtgat

SEQ ID NO: 34915 - DNA, 2355 bp, Homo sapiens
agcgatccacctgccttggcctcccaaagtgctaggattacaggcatgagccaccacgcctggccataaatatgttaaaaggttgatatagaaacagatgaccgtggcatttagagttttggggtgttgagggagtcaggggtaactccagaaaggattgatatctgtgaattgtcctgaagggtaagaaggaatcagcaaaactcccaaattaaaaactttaccaaaaacatttcatcttagtgctaagtctactattttctacaaaatacatatttctaaatttttcatttactattttaaaattcttagcttccctcctcatccctgattaaaaaaaattttttttttgccctttggcttcttacatttttaatgaatgtgtttatgagtactttggactccactgaaaaaaattagaagaggccaagagagtaggatgaagggccttccagacagggggaatagactgaaaaaaaaaaaaaaaaaaaaaaaaaacagacgttggatacaaaaaagtagtttctgttctcatgtaaatgttcagcatacattgcaaatacaaaactcaagttccaaagataattatattagaaatacagatttggacctaatttctaagatgatgttgatggatgggtagctggataaataaatgagttggaggtagatgtggggagagaaaagactcagcggggacggaaagcacagggaggaaaaatggccaccagagataacagagcagcctatgttaattaatgatcaactgtgtgtggctttttttttttcctggcccagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaagaaatccaaaagatccaaactttttttaaacttaaaaaatctctttgtagtatgtcagttgcactttttttctgccataatgtaacgtagcttgccccgtcaaaaattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtccttaacttttgtttttgtgacttttttctggttgtgaagaggtacaggttcctg

SEQ ID NO: 34916 - DNA, 1061 bp, Homo sapiens
ggaatttgaaaggaggacagaggagcctccgctggagctagggggctccgttacagatccttttggcagaagttgacaattgggtatcaaaacagtggaaggtgtttcgggaggtaggatggattcagactctgaaggggtttgaactaaaatgtttatgttttattctgtcagtggggagccactcgacttagagcagcagagcattacagtaatgacgttaaataacaacatttgatgaggcttattatctgccaggcattctcctaagtggcttgcaattcacttaatccccccaaggctggtagtaggagcctcattttacagatgaggaaaactgagactccacaagattaactttctccttaggtaacgcggctaaaacccagtagccagaattaagtctgattctacgctgtgtggtctctgtcctgaaaatgagtttgttgaaatagcagtgttatctgctgctagcttttccaggtcatttgtggcagatgaaatagaaaggattggacaaatagattaagaaataatggacggaatagatgtagattggctaatctgggaccagagaatctccgagagattctgagcccctctactagaaatttcttgataccgatgaagggcagactaatacagtcagcatgtgttagggaagttcagtaaaaatgatctgcagttacaggtagtttatgtggtaatgtgacatcctagtaggttagaatggagcttagcatgtgtgttggtcaagattggaagctgagtgtgtccgtgttttgttttgattgtgtaatacattaaaaatgaatattcatcttcctatgtatgtttcttcgtctttaaaatgggctttatggctgaaatgggggtgtagtaagaaaaataaaaaactagaaaaaaagggctttccacagtttcatcaaattgtgggaacattacatgagttaatatggcatagcgctttgaacaataggtagtcaaatagtaagcactcagtgcttttacttgttaagctgtttacaagtgaagctattaggcatatgctcaactctgga

SEQ ID NO: 34917 - DNA, 1025 bp, Homo sapiens
ggattacaggcgtgagccatggtgcctggccgaattgcctattattataatatgttctttctcatttaaaaaggtattatgtaatctcttagcatgtttaaaactgttaaccttatcatgcatgtcatacatatcttccgtattttacttgcttttcattttgtcttgtataatgtacaggaggtttgaatttttagataatcatataaatatgtctttttatgtttctatttttggattcctgcctgaagagatcttttcccatccaagtttttaaaaaactgttcgcttacattttaccttagtatgcaaaaaaattaaatcttgaatatattcattaaatcttggaatgtgatcgagctattttaacttactttttgccaaattgtggaatgtagatttcccactaatattggaacaaaaaagaagtttggtcaaagaaagtagattttcagatttatgatactagtattggagatcattttgagggttttcaaactttaaagacaaaggatttattgaaggcatatatctgaggcagatcaatgtagtggaattggattagaattccagttctgctgcttgccagcaagcttctaaacctctttatattacagttttctgaatgctagaattggaatagtaatacctgcttacaagattgttgggagaaattaattaagtgaaataaagttaggtaaataacttatatgtagtagctagtagttggtagttgcagtgatggtgatcattgtcatcatcatttgctgcacctaaagaatcccaaatttagaaatagatagtgtagtctcctttaagtggattctctgagtttcaaggaagagtttgagtacacattttagatttgagtcttgtgctaactgaatgaatctcttcactacactagtgattataattgtgtatgctgagaaactgggggtaagtgtaatgacattgaaacgccatgctatagtttgcttttatgatggcaagtgacaagagtattttatatttaatataagtac

SEQ ID NO: 34918 - DNA, 1047 bp, Homo sapiens
tggagtgcagtggcgcgatcttggcgcactgcagctcccacttcccgggtttgtgattttcctgcctcagcttcccgagtagctgggattacaagtgtgcaccatcatgcctggctaatttttttattttcagtatagacggtgtttcatgatgttggtcagtctggtctggaactcctgacctcaagtgatctgcccgcctcagcctcccgaagtgctgggattacaggtatgagccaccgcacctggctaacaaagattgtttttaaaaatgtgaaagttttggctgggcacagtggctcatcatgcctgtaatcccagcactttggaaagccgaggcgggtggatcacgaggtcaggagtgttcgagaccagcctggccaagatggtgaaacctcatctttactaaaaatgaaaaaaaaaaaaaaaaatcagccaggcgcagtggtgggcacctgtaattctggctacttgggaagctgaggcaggagaactctagcctgggcgacagagcaagaatccgtctcaaaattaaaaaaaaagtggggaaagttttttgcatatcttcaaatatagtcaaatgcctttttattttttaattaaaaaatcctttgtaaacaacaatgagataccagtgtaccttttagaatggccagatccaaaacactgacaacaccaaatgccaaggaggatgcggagcaatgggaattcattgctggtgagaatgcaaaataatatagctaatctggaagacagtttggcagtttcttacaaaactaataagcatactcttaccatatgatccagccatcatgctttttggtatttacccaaatgaataaaaaacttatgtctacacaaaaacctgcacatgaatgtttatagcagctttattcataattgtccaaacttggaagcaacccagatgtccttcagtaggtgagtggataaataaactgtggtacatccagacagtgatgtgttattcagtgctaaaaagaaatgagctatcaagctatgaaaagacatggaggaaacttaaaatgc

SEQ ID NO: 34919 - DNA, 1029 bp, Homo sapiens
tcatataatatgtgactgtgtctgcttttttcacttagcataatattttcaagattcatgttgtagcatataacagtatttcattcctttttttttttttttgagatggggtcttgctgcatcacccaggctggagtgcagtggcacgataccggttcaccacagcctccgcctcccaggttcaagcagttctcctgcctaagcctcctgagtagctgggattacaggagcccaccaccacgcctggctcattttttgtatttttagtagagacggtgtttcaccatgttggccaggctggtctcaaactcctgacttcaggtgatctgcccaccttggcctcccaaagtgctgggattacaggcatgaaccactgtgcccggccaatatttcattcctttttatgagtgaacaatatattattatacatacttggttattataaataattcatgtatatggttttgtgaagacgtatgttttcatttctcttgggtgtatacctaagagtggaattgctgggtcatacgtatttctgtgttttaactttttgaggaattgacaaacttttccacagtagcagcgctgttttacatttccacacctcacgcttttttcttttttttttgagacggaatttcgctcttgttgacaggctggagtgcaatagcatgatctcggctcactgcagccttggcctcccgggttcaagcgattctcctgcctcagcctcccgagtagctgggattactggcatgtgccaccacacccggctaattttgtatttttggtggagatggggtttctccatgttggtcaggctggtcttgaactgccgttctcaggttatctacctgcctcggcctctcaaagtgatgggattataggcatgagcaaccgcacctgccctacctcctgctttttaatggcttcattgtaatccattttattgatgtcctgtcattcagtcccctgttgattgacaatttatttctgtatttttgatgattatcaacactaatgcagtga

SEQ ID NO: 34920 - DNA, 1479 bp, Homo sapiens
cagtaagttgagagaagggttgagaagaggaaaagaacttctcattttctatcagataagaatcacattagaaactaagtacaagattagacaacaaattatgtggtcaaataatatagtcattagccacctaaacattttaattccagatattatttaattccatataataactgaattcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaat

SEQ ID NO: 34921 - DNA, 1026 bp, Homo sapiens
cttttcccttggataccatagtttctttttttcctctttttattttctttttcacaatgaaatgagctttatgtttgtttctaattattactacaagatataatcatgtagaaatttaggcaaacagaagtttgtggaagaaaacgtcacctgaaattccacttttcagaggtaaccacattggacatttgcgttaaacaatgagtttaacccaaatgcgtatgtttgtgtatgcatagctaccttgcacctgcctacctgcctgctcccttacctgtctacctacttccaagctacagtcatctctgcttgctattttgcgacctgcccttgtgtcattcaacattgtggcaatgggatctttccccatcaatgagaaatatacacttttatgttctcctgatttatggtgcttaatctcaaggataatctgagaaaacaaataaccaaacttctttgagttacgtttaaataactaacttagaattagttactgattggttgcttagtaaccaaaaagctatagactattaaggattttagacaattgatgaagcaatgaagttgtggcaaagtacattgttattgaatactgatattgagtctatagtaactagatttgtttaatgaccagaatataaaatattaatagctagatgaccatgttactgccttagcaatagcttacaaaatgtttatcatttgtaactactttatactgtttatttgtcccattgcctccaccccactgtcactgtctcagtgtttgctctccagggctatttctgtaacctcctgtttcagcccttctagtccacacctctgttggggggcacttaaaatcttcaggagtatcttatcatacccataatattgaagttaaaacccattaatgtataggaaatgtcataatcatattataaagaatatgatgcttttccttaatccctgcccccagccataaatatgtgcacacctttttttatgtccttggtgaatgccagcccaacttttaaaatctgcctc

SEQ ID NO: 34922 - DNA, 1084 bp, Homo sapiens
attaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgcctgtgctaccatttctttaagcccacataaagctaatgccttcttgggttgaatatgcagttgttatgcttagtttcaggg

SEQ ID NO: 34923 - DNA, 1026 bp, Homo sapiens
ttttttttatttattaatctagttagtggtttatcaatcttgtttattttttgaaagaaccaaattttgattttgctgatcttttgtacagatttcatatctcagtttccttcagttcagctctgattttggttttcttttcttctgctagctttggggttggtttactcatgttttcctcgttcctctaggtgtgatgttagcttgttaatttgagatcttcctaacttcttgatgtaggcatttaacactataaacttttctctgaaaactgctttagccgtgtcccagagattctgtgatgttgaatctttgttttcattggtttcaaagaatttttaaatttctgccttaatttcactctttgcctgaaagtcatttaggagcaagtttgtttactttccatgtaattgtatggttttgagagctcttcttggtattgatttctatttctattgtactgtgttctgctagtgtgattggtatgattttgttgtttttaagtttgttgagaattgcttcatggccaagcatgtggtcgatcttagagtatgtgccatatgcagatgagaagaatgtatattctgttgttgttgggtattctgttgatgtctgttaggtccatttggttaagtgctgaggttaggtctcaaatatctttgttagttttctgcttcaatgatctgtccaatactgtcagtggagtgttgaagtctcccattattattgtgtggttatctaagcttcttcataggtctctaagaacttgttttatgaatctaggatctccaatttgggagtgtatgtatttaggagagttaagtcttcttgttgaatggaaacttttatcattatgcaatgctctttgtcttttttgatcattgctgatttaaagtctgtattgtctgaaataagaattgcaacccctcttatttttttgttttctgtttgcttgagtgatcgttctctattcctttactttcagcctacatatatatatatatatatatatatatatatatatat

SEQ ID NO: 34924 - DNA, 1028 bp, Homo sapiens
agctccatcatttttgttgttcaggtaaaaatcttttgagtcattattgatttctttctctctcttagacccagtctatcaacaaatcttagctctaatttcaaaatttatccaaaatccaatctctgctttctacctatactgctaccattctagaccaagttactgccatctcttgcttggattattagtctctcaactggtctttctgtttccatccttcacaagagtgatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaagccaattgtttgtctgttattatgtttctacttcctgctaggacacgttttgtcttgtttcttgttgtattactagcacttaacacaatgtctgactcatagtagatttactaaatgtttggtggataaaaggatgaatgaatttttcttaaatatttttgtttaccagttaacataacgatctgaaagaggtcatttgattggtgggatcaggtacttgtaccaggatagaggaaaatggtcagaattttattttggggggccatactatttaaagcagaaaaaaaaaatcttggctttcaaataatagtgactagttaaagaaagtaatttactttcttctctgaagtagttataaaatgcattatgcctgttttatcccaggcactg

SEQ ID NO: 34925 - DNA, 1050 bp, Homo sapiens
catttggtgtacattatgaggaaaaatgtacaatttctcaattatacttcattttctccaaatataataattctcagttgattcagaagcatttgttgggtactgggctgtgttcaagacactttgctgtgttttgtattaccaaaatgggtatggtccccaaactcttcagagcttacaatttttaggatgtgtatttggaaaattaatagaagaattagtaagatattttttctattattgttgcatagggaaacatttcatttgccatcctggatttctgaaaaatcaaatggaataaatatagactaagactgcttggcagatatacttcatgtcttagtaaaacaagaaagtgggcaaataaggctaatacaaaataatgtttgcatcagagtgaaaattataccatgaacaagtttcttcaaattctgaaatagtctatttattattattttatctcataagttcaaggcagtttttataggaagcttatttattttctaagctagcattaaatgattattttgagtttgtggtgaccaaagacaacaacgacaacagcaaaaccaaaaagtagtggcagataaacttgtttccaatcacaaactatgcatttttggaattttttctatattgtaatgaaacagcaagactgctaatatgatttattttaaatatcagaattgtgagatgtggaagaaactaaagttttaaaaaagatttattatatgagagtatgttcatcaacaatgtaatcagaactatccatctgttttgtttggagctcagaagactaaaagacaatgagtatgatttaccttcttccacagttctcttagggtaaaagtttgtttagaaatttgtcatgtgtgcttttattccttgcttacttgcaagacagaagagaatccatatttagaaactagtcagagtggtgtgtgctgtattgagcaactgatattttgaagctctaagcatttttaaggaatgaactcaaccaaaacatgtgattataaaatagcaattgttcttagttgaagtattacc

SEQ ID NO: 34926 - DNA, 1041 bp, Homo sapiens
aaatttaaacaaaaaaatcacagccatttaaaaaaatgccatctctttttacagttgggctcaaaggctaggagtgaaagcatttctagttaaatctaccttttattcaagaaaattgggattcttggccgggcgtggtggcccacgcctgtaatcccagcactttgggaggctgaggcgggtggatcacctgaggtcaggagttcgagaccagcctgaccaatatggtgaatcttttgtatccttttaaatctcaagtttgtgtggtcagagtggcacatctctaggtacctaatagagaacaaaccaaatgtgtcttccacacagcagcccttaaatattctttaaatagctgtttgttttttttgtttctgtaggtacctgtgtctccaggtttttaaccatttctcatatgattacatggctttaaatcctcttgccattccaattctgctcctgtgaacttacttggtcctatttatcagcattcatttctaggtgtggaactggcaaaacccttatggtgcagttgctgggtctctgaattaagaatattttgaaaggaaattcgaaaatattattacctgagaagttctcctgctaaaaacatcattgacaagaccttcaggaaaatgaacttttgctttctcctactaataatgtgtacattcacttagctcatggaaatctgaagtccttataatctgattttcactatattagatttgtgtaggggctacagatctgaagggaattatccatgaataaatgagaagttgaagcctgcaaggcttctttcttgcatgcaggcataaggaacagagcagtaaaatatcctaagtaagattatttctatttctatgaaagagtgattgagatagtcaatagtggagcatcttgcaggcacccctgaatgcaaaaatcatgtaaggtaatagcctctgccatctagaatttataatccagctataggcacctggcgtgaatttatgagaagtttaaatatcaataagaaacagtaaatgatcagcactgcatgaa

SEQ ID NO: 34927 - DNA, 1038 bp, Homo sapiens
aaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagca

SEQ ID NO: 34928 - DNA, 1023 bp, Homo sapiens
cagagcctcactctgttgcccagactagagggcagtggcacggtcttggctccctgcaacccccacctcctgggttcaagcgattctcctgcctcagcttcccaagtagctgggactagagggatgcgccaccaggcctggctaatttttgtatttttagtagagatggggtttcaccatgttggccaggctggtctcgaactcctgaaatattatcccccccattccccagtttttttagataactcgtttttagtgtgacttcagaagagactgggcatgacacagattattttttgtagcttttttgtgtaggtgggtgattggtgtaaggtttaggagaacaaaaaaggacaggtaaatcaatattaacagggagctcggtacccctgcttctagaatttgaccaacaaagtgaaatttacaagtagtttgctggtttattatcaaattaacctgtgtttactaatgggtagtgtcatgtagctttgatctcaattctcaaaacggttttgtagactctggttggaatcccactttttctcaagtaatgagctttctaggtctgttgttctgaatcagattttgataccttttggtttagtaggtgtctgctaccaggtgagttaatttctcttccttgggtcctgggtttccttttttgtctgtttctttcctaaccttcgatgtgtatagggttgcaagtcatgtaagcataatactctttacatcctgggatagtatttgcttctttgtacttggttgtgcacagttgagaatacagtgtgggtgtggaacacctgtccaggtgccagttcatgctgacagttttgaaaggtagtctcattagaatccagttattaagcctgtctgttgtatacatgagaaactaatttagtctctgcttttactattttagtgcttgggaaagtttctttttgtaattaagactagtactttaaacgtatgtttagggcctttgaggtattaggaattttggaaactggaaagatacaatctttc

SEQ ID NO: 34929 - DNA, 1061 bp, Homo sapiens
tttgagacggagttttgcttttgttgcccaggctgtagtgcagtggcatatcggctcacggcaacctccgcctcctagattcaagcaattcttctgcctcagccgcctgagcagctgggattacaggtgtgtgccaccaggctcggctaatttttttttttttttttttagtagataatggggtttcaccatgttaggctggtcctgaactcctgacctcaggtgatccacctgacttggcctcccaaagtgctgggattacaggtgtgtgctacactgttctttgacccagaaatttattttaaatcttggtcttacatatggaatctttcttaacgctgaaatcacttggaattttaccattgttcttatggttcacaactgtatcttgggtttatttaatacattgtactggtcactcactgaatcttgtcattgtataaacttgctcttcagatacgggaaatattactgaactgattcttctttccccatctaccatctcgatctttgttctctggaattcttgtttgggtataagccctggacatgtgtttctgttaatttaatctttctcaatttttgtagataccaggtcttgctatgtttcccaggctggtcttgaactcttggcttcccaaagtgctggagttacaggcatgtgccactgcaccttgcctaattgtcaacttttaaaaacatcccaaaatttaagttgtgttagtttcttttttgggtgtgggtgtgtgtgtggggtggagttctctcgtcgcccaggctggagtgcagtggcactatctcggctcgctgcaacctctgcctcctgggttcaagcgattctcctgcctcagcctcccaggtagctgggactacaggtacacaccaccatgcccggcttatttttgtatttttagtagagacaggtttcaccatcttggccaggctggtctccacctcctgacctcaggtggtctgtccgcctcagcctcccaaagtgcagggattacaggcgggagccaccgcgcctggccaattgtgtcagtttctaagaccaccccctc

SEQ ID NO: 34930 - DNA, 2216 bp, Homo sapiens
cattctgaatgcctgccattgtatgcattcactacatatttggtaaattatttgataaatgattgctcagggtgaatttttcacacttgggaattaagctacccttaattttttgagattgtttaaaattaggtactgttctgattattagtatgtaaccactaccgttctggttctaacacttgttttattttagaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggac

SEQ ID NO: 34931 - DNA, 1316 bp, Homo sapiens
gatagtaagatcagtaacacctcagttaatcaggtatcttggaggaagtgaagaaagaccctaattcaagggacagttaattggccttttattccaagaatgggccttagtggcagtatcttaaaagcccacaagatggagatgtttcctaatgaaaggcctttaatttctttatagagctgagttagtgtcacatcccagtccccacccatgacccttccccagttaaaaagaagagaaaatgttgagcaagtctgatttgattcccatggtgacatttttagccattatgtaacaaattctgacagtttacccttaaaattaaaaacctccagtcctgtctttttaaagggtagaaagaaggttaggtataggatagctttttatttatttatttatttatttttgtacaaagggagcctatgtaaagctgccagatctgaactttctggtgttttgctgtaatgttagtaagatttcgccttaaaatattttattttgagtatatacgtttggtcttagagtgtcttggtggatttccgcttaccacccatcactttctgcattttaaaggcttaaatactttattgctggttaactgaggttctactgtaaacgaatcatctaagttaattagtggattgtacttcaatggataattttcactaaattgtttatattgcacattacttttgtcttaaggactcttagcacatcaaaaaaattggctcacaacttaattgtgagatgtagaattttccattttatgtgctaagagttttgttaatgagagaactgttaaaatagaaaaggagcttcagcatagacaccaatgctggttgctgagatcagtggggaactgcatagcattttaacaagtttaatgaacatttggaagagaaatttgaagctaagattctggtttttttgctgttaactttttaatctaaggaaaacttttatgtacagtatttttactttgggtatatgtttatcttttagcaagttgaaagacttaatttgctgcttgctcactattttgtaattatttgggagcagcagtaataagccagctttttggaataggatgttcctgatgtgtggttatgtaggaagaatgatgttttaatatactgcccagtaaactggtgcagtttggaaaaggtgtgttattgatgtggataatatttaaggcaattttttttaagcattttaatactgctttttgtctttacaggaaaatgtttataggaggccttagctgggacactacaaagaaagatctgaaggactacttttccaaatttggtgaagtt

SEQ ID NO: 34932 - DNA, 1013 bp, Homo sapiens
ctctactaaaaatgcaaaaatcaagtcaggcgtggtggtgcagcctgtaatccctcccacggaggctgaggaatgagaatcacttgaacctgggaggcagaggttgcagtgagctgagattgtgccactgcgctccagcttgggcgacagagtgagactgtctcaaaaactaagcaaccaaaaacagaaaaagatggaatggaattaatatgttccatttagtaaagatggaatagaattggtccagtttgtgttcattgtagcatattcacctatttggtcagcaaccatttttttttttttaaagcctaagcataccctgagaacaacaaccttttttgattagaacagaagaaaaagccagagtgttcttgggctgccaaaatattaatacgtttgtctcaaagacgagccacttaggtgcttgcttagagacttctactttacacagaatttgaaaagtttgacagctggctacttactctgcaaaacggaagggagactttttagaacagcaactggtgatctggcaaaaatgaaaagtagaacttgtgaagaaatgagatggacttggtgtattaatagctaattttagaagaccctgtggatattctaaatcagcataatagtgatgtctgagccatagtgttaaattatgattactgtatttgaagtataagaaggcagaaaagtgtgatgctgttagaaaaaaatctcatttcaaatgattgaaggttaaaaacaattggggaaagattagagagggcaggcggtgctttaagggaggtggaataatacttggctccttattctccaaaagtgctggatagctgaagtttttaatattctggataattgatatttgattattagtttaggagggatagcatcttcagtgaacccttgtagctctaaggtaggcatattaaacaactaccatactaaaggtggggagtacgtttggagagcactttgctgggccagctgatgatatgcttaggtgatatttaaga

SEQ ID NO: 34933 - DNA, 3465 bp, Homo sapiens
aaaagaaaaaaaaagtttatttaaaaaactgtcatgttggccgggcgcggtggcttatgcctgtcatcccagcactttgggaggctgacgcaagcgaatcacctgaggtcaggagttcgagaccaacctggccaacatgttgaaaccctgtctctactaaaaatacagaaattagccgggcatgatggtgggcatctgtagtcccatctacttgggaggctgaggcaggagaagagcttgaacccgggaagcagaggttgcagtgagccaagatcgcgccaccgcactccagcctgggcgacaaagcgagactctgtccccctcccaaaaaaactgtcatgtttcatttattagatgtttattttttcaacttcgctttttagtagtcatttagttaggttcattctaaagtgtgaagtaatgagatttaatacagagaagtctctgaaaatgtttggtccattgtatattagtcttgaataaatggaattctttttcacacttaccttgaaaatgtcatctgtagaaagctgggggagaggaatacctattctttaatgatggggaaataataccaaaatttatatttttattgactaaagtgttttttggggaagatttgttattggctaaccttaatgtctcattagttttaaatagttaaaaaaagtgggctgggtgcggtggctcacgcttgtaatatagcactttgggaggctgaggtgggcagattgaacccaggagttccagaccagcctgggcaacatgatgagatcctgtctctacaaaaaaaaaaaaaaaaaaaaaaaattagctgggcctcgtggtgtgcacccatagtctcagctacccaggagcttgagatgggaagattgcttgaacttgggaggcagaggttgaagtgagccaggatcacaccattgcaccacagcctggcaatagagcgagactctgtctcaaaaaagtggttttcatgaattttataccagatcagatctaaaaaggctggttagtatttgaactcgatgaaagcttgtcaagctctctcccaaggtagttttcatacaacttgtaaaataccctaacgtgtgatattatctagttgcattgtaacctcctcccttccccttaggtaactagtgacttagctttagtttgtcattttaggattttagaagaataattatgatggataaaatactggaaaaattcagtaaggatttaatggtgtgcttgagtaacattactttaaaagatgacagtgattggtcatttatgttttatacctgaaatgtatatcaggttgacattctgttgtattttttaaactgtcagaacttgttataaagccatgtatgtaagatcataagttgttaggaagtgtttaaaagttaaaggattggctgggtgtggtggctcatgcctgtaatcctagcactttgggaggctgatcgctatgtccaggagttctgtgactagcctgggtaacagagcaagatctcgtctctaaaaaagtaaaaataatacgaagttatagaacatagaaaaagaatactattccaaaattgggagtgagtataatggctaactttttaccttgaataaggtgtttgacaataaagacttattaggggaggtatcttggaataaaatagttaatattgactgggaatgttaaaaacctagtgacctaaatagtccagagaataagtttattgatggggaaaagccaggattattaaatcggaacattttccaccagccaggattgctccatgtatatttccttttatgttttaaattattctttactaaaattactggcataaatgtagggtagaccaagtcatcaaggtgattttggaagctacatttaaagggtcttagttgaaataccacctaatttttagtttatatatttttttacatggactatttaaaaatttctgggttatttcaagttggcagcattgaaaatattagaatatgtttatataaaactcattgtggccttttccttttaatgttggaaagtttataaagcctatgcagttttaaaaaattaagccattgagtaaataaaaagtttgctttattaaattatgtttagatagtgcttatagtgctttaccccttcaaaatagtaacttctatcaatcatttaggatgtgtgtcagactattctgtgtcctttaagtgtgttaactagttttaaccctctgcaaatatctgaggtatgctctttttacagatgggaaaacaatcttggactttaatattttttcttaatgttacacaattagtaagaggcagggggccaggtggagtggttcatgtttggaattccagcactttgggaggctgaggtgggcagcttgagcccaggagttggaagactagcctgggcgacatagtaaaacctgatctctgcaaaaatattagccgggtgtgttggtgggtgcctgtagtccgagctactggtgaggctgaggtgggaggaccaactgagcccaggaggtcaaggctgcaatgagctgtcatggagccagtgcactccagcctgggagacagagtgagaccctgtcttaaaaaaaggcagcagtagggtttaaaccccggcattttgtctttattgcctctaaacttaacttgctttaaaagatgataaaatgtcccacaaaggagcctaaattcctgaatgatactgcatatcacttggatagttatctatgctgagttgtataactttatgcttgtcatttaattttacaatttggtggaagccaatgtgaaagcaaggagacttctgttgtggagtaggtgttttaaactgaataccatattcagccttggggtgctgaatatttagttcacagctaggattaagatactcaactatgttaataaaatacagtagatgaagtcctgcattttaattgggattgattcacttagaactaaggatcaaagtttaaacttattgcagcgttaggggccatctttgttgctagttgaacaagtcttggtcgtttttaacatggctccttagggtattttctgaagttctgtctacttcattggaaagtgtttgcactacgcaggagtgacagcaatatgaaatgctttgtattcaaggcagcagaggtaatctggacagacagtacatgtgctttaaaagcaagatacagtcatagaaaatatgtagataatttagccgggcatggtggctcgcgcctctaatttgggaggccgaggcaggtggatcacgaggtcaggagttcgagaccagcctgaccaatatggtgaaaccccatctctactaaaagtgcaaaaaaaaattagcctggcatggtggcatgcacctgttatcccagctactcaggaggctgaggcaggagaattgcttgaacccgggaggtggaggttgcagtgagcctagatcatgccattgcactccagcccggg

SEQ ID NO: 34934 - DNA, 1032 bp, Homo sapiens
tttgagatacacatactttgccttaaatctggggttttttcccttaagccatgtgaccctttctacaaactcagtgtatgtttttaatatttcctgggtactctgctatcgtcctaatacataatattagggtaaggctgccctaatacgagaacattttgagtatactattgagtatacatttgagtatacatattgagtatactatttatgccaacgtgaaggatgtgattagttttagccttcaagtcataatacataccatgcttgaaagcatttaaaaaggaatagagtaattttttttcccattccacttggaagctgtgtacctcaagtgtgtgcacatttacaaatgggtgaaacataacttatgttagtccaagcttgatttgacttcagttctgcttcaacgttttagtagatagggcactgaactggatgctgaaagcgtgggatctctttctgttgcttcacttccaacagtgtggtttcaggtaatacgacatgtttgttacttggtttgctgatctatgtgttggaaacaatgctcaccacaggaggattgactacatagcctgctttcatagcttgtgtgtatttatccagtgccctaatagttgatactgccagtgatttactcctgtggagtaaaggtaagcatgttttagtttctggagtattatattgtacgttggagctaggtatttaagaatatttgggggtggggagggaagactccaatttactggtggtgcttggccagtaatcaaggtgacagtttaagtattgggtcttgcactgtaaactcctgcttatctagacttcagactaccacagagcccacacagccaggaagtctgtctccccatttagtcttatgagcaagatagatgaagccatgagaaaatatactcaaaaagcaaccaacagacaatgtcatggaatgaatctcctacagatttttccttacacttttgaaaagtaacatgattttaaaacgttggaaaattcatcaaggtacaaatcattttc

SEQ ID NO: 34935 - DNA, 1043 bp, Homo sapiens
tggttgctgtaccggttgttaattccctagccattcaaactcctccccacgacactctgaagcagcgacggcacagcgggaagaatggtaaaacttttaaattttatttctgtattataaaggtttcagtagtcataatatgtagaggctgtgtattggttagttgcccattgatccccaggaaattctagaccatagtacatacagtaggtttgtacctgggatatataccttttataggcatcatgtgtaatctttgggcaaaattgatgccgttacatggtatttggtctgtggtaatgcatgtagttgcagtttggcaatttaagctaaacaattagtaacgatatttttatatcgagcaagaaaaaatattaccgtaatcttcacatttgatttattttaagatgaaaaatatttttgttggaatttaagtttaatggctaaatatgaagactccttgatataaaatattgtgtttaaaatgtcatgcatgttatactgaaatattctggagatgtctgaagcagttctttaagcagcactgtgtattatggaaaaatgtttgtcttttacctagcatatttgtaaatagacctttaataagaagtgtgtgtgtgtgtgtgtgtgtgtatatatataccattaaaaggtgggctaatgtggctttccactacagctcttaccagattttttattttcagtgtgatttggctggaatattaataacagttggttgacatgtattcacaattgcatgacttctctttggaggctggtaggttgagtattgttctttttatccatcctttcccctcccctaaatgtcagtctttctgcttttaggattatatttgaattttcaggggtttatacaccaccactggagagtagaaggccactaacttgcaggcagttaacttatatctttacaagctacattctattttaagagcctatttagggtaacatttaaagatttgcttatcactgtattctcatccactgaaatcagtccagctttaccttggagaaaaagcaga

SEQ ID NO: 34936 - DNA, 1050 bp, Homo sapiens
gaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggtgagtaaggggcatcccaggatagtcaggcccaactagtccccctccccctctttattcccccgccattaggcctggttcccgctctcagcccgttctccgggcccccatgcagcctccttgcactggtctccctttttctatgttgggttccccggaccttcatttccttcttcctttgcctgcttatcgcccccctcccccatcacacacgtttccacctttagccgtcaccatgctgctcctcggcccgccctcctttcctccctcgccatgggtctcctcccaccgacttagccgccaggattttttcccgcctgtcgtggggtaccttttttctttccatgctgtcccctctttttccctttttctacagtcttgggcataaaaacacagacacaaacagcttctctgtttgtattactaaggtttatttggtgcttctccaccatcctgaaacgatgcgattgtttataagcaca

SEQ ID NO: 34937 - DNA, 1034 bp, Homo sapiens
gctgcgtgctgtagatcatgcctgtaatcccaagcactttgggaggccaaggcaagtacattacttgagtccagcctgggcaacatggcaaaaccccgtctctacaaaaactacgaaaattagctcgatgtgatggtgcacacctgtagtcccagctacttgggctgaggcgggacgattgcttgaaccagggaggtgaagtgtgcagtgagtcatgtttgcgccagtgcactccaccctgggcgacaaagtgagaccctgtctcaaaaaatcacaggatgctaaacttcaccaattaaaaagttgactaagctggccgcacgcagtggctcatccctgtaatcctagtactttgggaggccgaggcaggtgaatggcttgagtccaggagttcaagaccatcctggccaatatgtcaaaaccccagctctactaaaaatagaaaaattagccgggcgtggtgctgtgcttaggtgagaggattgctggagcccaggaggtagaggttgtagtgagatttgtgctccagcctgggcaacagagtgagaacttgtcaaaaaaaaaaaagttgactaaggccaggtgtgttggctgcagttgagctatggtcgctccattgcactcttatctggcctaggcaacagagtgagaccctgtctttaatttttttaaaagttgattcaaaaacatgtaagtgtatgaataatttttagttatagatgtgtgtgtataccatttgaattgattcttgagtagttagaaagggtcattcatagaaaaccccctttccttaaactttcagcgaaatagagttgacatctaatctgtggtttcaactttaagcaaaaacaatctaaatttatatattttttatagtcactagaaaatattgtttataaatatataggctgttcttttaggattggttggggtcttacatttgtcttgaaatagattagatgtggaatttcagcaagatttagttaatagcaaaaaataaaaatacaccttagactttactactttttataaac

SEQ ID NO: 34938 - DNA, 1041 bp, Homo sapiens
gcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgtta

SEQ ID NO: 34939 - DNA, 3126 bp, Homo sapiens
atgaattaaattgcctacacttagggggtaaatgtccctgtttttatttcacgatttaattccagaactgaaggatcatttgagttattgttaattttttttaaaaacacttttatttctagtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggtaggaactatgttttgcattgtgctgcttttgtggtgttttgcaaatttttctgggggttatatggtgctgtcagattaaataaatctgtcttgtaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagaggtgtgtgattatgtttacacatgttaagcttgatgtgtttataaaatgttcaatccttgtccgatttatgcagggcagattcatgtttcctgtaagagtagaattaaatgactgctcaagtcgcttccagtgactgtaccttgatttcattgctgctctgatggaaacccaactatctaatttagctaaaacatgggcacttaaatgtggtcagtgtttggacttgttaactagtggcatctttgggtacaaaataatattaatttctctcaatgcttcaaatatacaacaaatcactgtaggctgatgttgatcataaagcagtgatgtctgtatagaagtcacccgataagaataacatgtttaagttgaagcctgaaaaggcctttggcattctgacactgtaacgttttacaattatgggatgacgttgagtgtgcatctcgatttcagattgaaaatattgaacttcccatggatacaaaaacaaatgaaagaagaggattttgttttatcacatatactgatgaagagccagtaaaaaaattgttagaaagcagataccatcaaattggttctgggaaggtaaagccatttaagcactttaaatgaaaatttaaataattgaaataatttcttgatgtggagaaaaataaaatgatttaattttagaacttcggtaaaaattatactttcatgttttttgtttatagtgtgaaatcaaagttgcacaacccaaagaggtatataggcagcaacagcaacaacaaaaaggtggaagaggtgctgcagctggtggacgaggtggtacgaggggtcgtggccgaggtgagacttaattcttgaaatatgactccgtggtttatttaagctgtatactgctgaatatgagtagtcctgtaccaaagcaaaactttaaacttaaaaccattccagcggaggggggactgttcagcttagtggaggttgtgtgtggtggttttttgttgtgagctcactggtttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggtttttt

SEQ ID NO: 34940 - DNA, 1029 bp, Homo sapiens
ccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacgggtaccgcacgcttcttcccccgctccccctcccccagcgcgccgcacgcgcccttcgttcctcgtgagccgcgcgctgcccccattctttctcagagtcgattccccgcgtgccttctgggccccactagattggagggaagaggaaagtaagagatcgagggggtgactggagagacccgggaagagtgggggaagggcggaggggttggaggaggagggcggcggcgtctgtgtcccgagcgcgcaggcgccgcgtgggacccgggggggaggggccggcctcccagcgctgcacgctgcagctgccgccgcctcttcattgtgtctctgttaccactcggcgcggttttcctgggaagagttttagaggactgagttggggcacaagcaggcgactggtacccagattcacaaaacgtgttatgattgat

SEQ ID NO: 34941 - DNA, 1068 bp, Homo sapiens
tctggagacaggcagtccagggaggacatggcagcactgcagggtcagtagagaactgggattcctttatcgttctgctctaccatcctcagcaggggactttcattctcagtgtcatttcatggtgcaaactgatcactaaatctccaaccagaaggggaatcagggaggctgaagggagcacattgctgagttgagtcggtcgcctttaaggagtcttcctagaagatacaacctatccacttgtctctcattgaccatatctgtacccagggaaacagggaaatgtattctcatggttaatgcgttggacccttgaataaaatcttggttttgtttctaaggaaggaagggtgaatcgatatggggtaaacaattagcagtctctgccatagccacacagttgttctgccttaagcagagcgatttgtcatctcatattcctcagtcttattttttgtgaaccaagtgggtagcctctctgtctccattaatgaacagaaactggaatctcaaatcatctttctcagatgacaaaatgaagataaaatccagagactgtttctcctaatgctttgcttattccattgagtcccattttagggaagacattcctctagaggttacatgtaaatgctgtcatgcatttttaaagtagacagggaggatgctagtccagacacataaaaacaaggtccttgccttattgccatggtgatgagataaactgaaagaaaatggatggaatggttcaaaagagcaaatcagttctgttctggtgccttgggaagagatcaaaatgtataaatattgccattccaggaagaaaggcactcaaacatctagaatatttttgaggcctgtttcacctcaattcatcccctagtctgttatctctagtcttctctcccacctcccaagaatgagcatcacatttctcagtgataccctcttttttgttgtttttaaaggctcattattttaaagagcagttttaggttcaatttagcaaaattgagaggaaggttcagagataccccatgtacctcctgcccacacacatgcata

SEQ ID NO: 34942 - DNA, 1033 bp, Homo sapiens
gtctgggtatcatccatgatttctccatttccctagttatccctcaccaatttttaagccaatcccttcagttctatcactaaattacatcttgaatctgcacacttctcatttttaccaccttttagttcaagatcaacttttttcctaggctactgcaaaagcctcctgaactggtcttctgattcaatgcttgcccctctctatattgtagccagagagagcttattggaaattaaacgactctccagctaaataaataaataaatatttcagtggcttagcattgtatttggaatgaaatccaacctcactgttatgttctatggggccctgcgtgatcagggccttgcacaccagtcctctgtgtccaccccaagttggtgtacttcagtgtaattctgacactaaccacccggggttaacatcagatcccacaagttaaaggctgagtgctccacatggctgtccccacttcagacgcctgctgcaagggctgcagaacagtagtggggtccccaggctacctgtacttctgaatgaccagtgataagtttgggggtttccacaatctccttaggtttgataattcactagaacaacatgcagaactcaggaaagtcctatacttacgattacagttaacccttgaacagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatgattttctttttttttctggatctgcagagttattgattcaaagttgccacatggtgggggtacaaacattcgtcagtcactgtgcatgcaattggtgacattttaatttggaggcaattaccaccacagatatcttctttcattaaaaaataaaataaaattttcaaagcctcttacaggccaaaggtctaag

SEQ ID NO: 34943 - DNA, 1058 bp, Homo sapiens
cggaatatttcactaagtgctcttgtagctcagaattcatttccttattttaggcatctcttacacagtttgacttttcataaggtaaataggatataacacaataggtcaattaggaaacacaattggtggtgtgtatatatactgcttgtcattcaagcacatcaggtattagtactgaggtcctaggaaataagctattaagcataagggagcagttggcagcttcctggttccatgttcatttgttcaccactggcagtgtgaactatgctgcactttattttgacttcagccatcttatttcagtgttgtgctttcaaaataataattgacttaggtcttagatgacgttgaggacctaacttgataattttcatttcttgtgttcaagcaatcctttctttatagcctccaatgacacactcatgtagttataaaacatttctattattggactttttttcaaagataaataacttgtagctgaagcctaaaactctgattttttttctcatgaaactacttgtttataactcaaaatttgaaaacctaagttttcttaacaaaacaccacataacagaatattagactgtgattttaaatttattttagggagaaagtacactgtagatggaagtacccaggtcctagaataaattctttgctctgccatttgctagatgtgagcctttctgcaagtatcagttcctttatctgcaaggggaggataataatatttgcctcacagagttgctaggaagataaaataatgaataaaaagtaccaagcttatagtagcaatcggtgaatattgttctccccttctcttttatgagaattgatatattgtttaattggtttctgtatgctaatgtctgtcatatagaaaacaattaatgattgttaggtaaataaaaaaataaatgaacagctttaaaatgtagttttagaaaccatcaaatttgaactatgcatactttttcaaggcccacatttgtagtggatttttaaaattcattcaacgaatacttattgagcacctactatgtggcag

SEQ ID NO: 34944 - DNA, 1029 bp, Homo sapiens
tgggtgcagcacaccaacatggcacatgtatacatatgtaacaaacctgcacgttgtgcacacgtaccctagaacttaaaatataataaaaaataaaaaataaataaattgaggtgtgacaggaagtttacagaaagggtgtgggaggggaaaaacaaatgcatttcagttaggtatttttctgagcattttttttttgtttctgtaagtttttattttgatatagttttaaacttataaaaaagttgcaagaatagtacaaggaactctcttatacccgaaaagttcctttatctagattaaccatctatttacagttgacccccttcctccctctcactctgtagtacctaggtataaatacatatttttaagccattcagagtaagtcagagacattgggaccctttaccattaaatacttccagatgtatttcctgagagcaagaatgttcttttatataatcatattcagttatttctgagcatttttaaccactttgcagtattttcaagtgactctcaactacaggaaattctttaccaaaaaagaaaaaaatgcatcaatatagactgaatcagtacaattgtcaagttttccccagttcaatactgaaaggcaggttaaggcttacagactaccaaaattttattgatttttgtatcaatttattaaaaaaatctctaatcctctgtaaattggtgaaacattatggactctggaaaacactacctacttggctaatttctttttcccctaatagtctactgcaatgtgatggccccttattaatttattaaccatgagagtcctattaaaggacagagtattatagctggaggggatcttagggattcctctagccccactttatagttaagcaaactgaggatcacaaaggcattgccctcacaatctcagggcagtggctgggaatggagctcagagatcttcactctagactcagaagacccttcaaggagaaccagtctaatgtgcttgaggggagaccatgggggctcctaggg

SEQ ID NO: 34945 - DNA, 1053 bp, Homo sapiens
ttgtgaaggggacatcaaagggtcatcagagtggcaagtttgctgaccttgtcctcccctccctggggatggtctggccagctcacaggttgaggcccactggccaggaatagcccctagagcatgcggcccttgtagggaccttccaaaggacaaatccttccaaagaattgcagcccagccacacctggctcaggcttctaatctgtagaactgtaaataatacatgtttgttgctgtaagttactaactttgtgacagttcattacagtagcaataggtgtcagtgtacgagcaccctccttgggccaggtccctggggtgacatcttagcaaaatgtgactggaggcagggtgggttctggaggctgttgacctattgacttgtcctctaagttccctcccctcacccccaatcccccaacaggccctggtgtgtgttgttcccttccctgtgttcatgtgttttcattgttcaactcccacttatgagtgagaacgtgtggtgtttggttttctgttcctgtgttagtctgctgagggtaataacttccagcttcatccatgtccctgtaaaggacatgatctcattcctttttatggctgcataatattccatggtacatatataccacattttctttatccagtctattattgatgggcatttgggttggttccatgactttgctatttgtaaatagggggctagggttttgaggggggaaatgtctcaagggggcagcgtcagctttcaaagggggagtgttgctcggtgaagagactttattgcttagttgcatgaatttggggcttctgttttgttttggttttaaacactggccgagaaaacatcacttactaagactatatagaatcctggccccacaggaagccccatggttgggaatggggaatgcagggaggcgaccaagatactttcccagaagcaggaccagctacataatttatagggcccagtacaaaatgaaaatatagcacctgttcaatgattattaagaatttcaagatggtgatagcagtgcatttaac

SEQ ID NO: 34946 - DNA, 1050 bp, Homo sapiens
aaccccgtctctacgaaaaacacaaaaattagccaggcgtggtggtgcatgcctgtaatcccagctactcgggaagctgaggcaagagaaccgcttgaacccaggaggcggagattgaagtgagccgagatcgcaccactgcactccagcctgggcaacaagagcgtaactccatctcaaaaaagaaaaaaaaatacaaaaattagctggacgtggtggcgggcgcctacaatcccagctactcaggaggctgaggcaggagaatcgcttgaactccggagcagaggttgcagtgagctgagatcgtgccactgcaccccagcctgggcgaaagaccaaaactccatctcaaaaaataataattataaacaaaaattttgtcgttccgatatgtcttagataacaattttgtttaggatttagaaagtccagctgttcaatagttaatttctgacagataggagagactttcaagccttctattagtgaacaacaaaattatgtgctcagggctcagagaaactaatgttgcaatctgtaaaacattcattcggtaaattctcaatggatacctgtttggtctacaatcagaattatcccagacagagataatggaggcagaaaagaccatacatttctagtgaagagcaaattgaacatatagtttgtatttaggccaaattttggagagccttaagtaccagggcaaggagttttacttcatataatacaataagaaagaagtttctcatgaaggattttgaactgctgagtggtgcagtcaaagtggtacgcgagggagattaatctggatgtggccttgcaagataaattgtttgcagcacagcagaatcagaggtaagaaaacaggctctttcctagttctaggtaggagatggtaacagcctgagttgggatagtgcattgccgtttctgtgatggcagcacaggatagcagggagttttccctgttttactatctaggataactgcctgtcacttttgtttctgtttctaggagggagagcactttcaaatatgaagactaat

SEQ ID NO: 34947 - DNA, 1028 bp, Homo sapiens
tggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgttcagagtagttgactcctgttcctcagccattactaagacttgttaaagataatcaagtgtcccatgattttggtataaagaaacagaattttagaaattattttttacatattctttttcttcaggcaagatgacacaaattatttttggaaaaatggtttcaaggggcatttgttattactgtttttccattttatttatttatttaatagactttgtattttagagcagtcttaggttcagaacaaaattgagcagaaagtacagagtgcccccactattgacatcctacgccacagtggtgtatttgttacaatcgatgaacctacatcaatgtctcattatcacccaaagtccacagtttacactctcagtgttgtacattctgtggattttaacaaatgtgtaatgacatgtatctattagtggcatttttaaaagaaaataattatacctggaaagtgaaatattgccactatttgaaaatttaaatgcaaaaaaaaaaaataaaaatctcaaaggggaaaatttaatgaatgtgttctgtgctaaaatgaatgttattgttcaacataaatatgaatttgatacaacctttcactcaaatgtttaatgtgaaagctgtcttcagagtagataggaaacagatccacttttactagattcactctatcgaggttcatacctactcttggtcacaaagaatgtgaatgtgatggtatttatatttagatctccctaagccacgcatggtggt

SEQ ID NO: 34948 - DNA, 1095 bp, Homo sapiens
taaatgccttttttatatcttagaaagttggaatttttccccccaaataaccctgaagttttcttgtttaatctcatgatagtggtaatctttaaaaatagcaaacctatcaaaagcactaacccatgtgctgagcactttttttggctccctattataaaacgtatgatctcattggaacctcacagcatcccatgaggttgtcactcttttccctattttacgaatgtagaaactggggctcagggaggttaaataatgtgtccaaagtatcatagctaataagtaacagagccagtagttaaattgaggattaactccagagaccatgcttttaaccatgtgatacatcctgcctcctaatctcactttgctctaacctaacacaatttctaaaatgcatttcttcagtttcatcatgcatgctggttgctttgttattgtttcttctaaatgttaatatttcctctatgatataaaaattgaatacctgaacttgttggaagtagaaagaactctggagctaaacttgcaagttccaatcttggctctgccccttgcccccttgctagcatgtacagattgtctaactttctgtgtcttaattttttcctctataaaatctccttcaaatataaacaatttgcaggtacaagactcggagcatatgtttaaggcaatcttaaggaaaatgttagaggataaactctggagctgagtaaggaaactggcaaaaatactcttggagagcattgagtatgcattttaactgcaggactgagactggaacaaaagtgagaatgaggaagaaagaataaaatgtaaatgttaaatgtccaataatgtaagggattgattatacaactaataaaaagagaagaggaaagaaattggaggtagaataagtttgtgaattgccacatctgtaatggctatgagtcaaaggacatcatttaaagctgacagatcagttagtagaagtataaggagttcaaaggtaaacactgagaaagataatactattgactataaccatgttgtgtggatgggcagtaagattatacaagctaatttcataagtgctcatagtaggga

SEQ ID NO: 34949 - DNA, 1022 bp, Homo sapiens
catggtggcacgcacctgtaaccccagctacttgggaggccaaggcaggagaaccacttgaacccaggaggtggaggttgcagtgggccaagattggccactgcactccagcctgggtgacagagcaagactctgtctcaaaaaagaaagagttggttctgttaaacaatatttatttctcataataaccctatgaaagcagatacagacttctggctttttaggattggtatttcacttgttgaacacctacccttgtgtcagatgtatagcaggttaacaaagtcaatacagtgatacacttgacataatctttgttctgagtttttttcccaattatagtaaaattggaggtcttaactgttctacattagataaatatatgcatttgttttaaagagctaagcaatgagaatcttacaactagagctgaagttcaagaaataaatgtccaatgattaaattttttccactgctgttcacatcatgatttgttgtgattaatgtatgtggatgaggacataatagaaaaagaaaatgatgagacttgtatatattgtgtttctgcacaatgagttcctttgaatgtttttcgttttaggaataaaattgaagggtgtttttcttagagaacatcatttgtcatatttatttgatcaagaagttgaagatttatataataaggtatgggacttacacatttattttgataaaagaacacagaaaaggtcaggtatgagcagaaaattgacatttatttcagcctaatgtggatactgtactctgaattaaaaatttcttttccttactcttccagcttttaaagataagtattatttcaaaatagtatttttttaattaatagattcaattcaggaaaggcattggagggggtggagcttttaactttgacagtctcactctgttgcccaggctggagtgcagcggcgcaatctctgctcactgcaatctctgcctcctgggttcaaatagttattgtggcccagcttcccaagtggctg

SEQ ID NO: 34950 - DNA, 1918 bp, Homo sapiens
ttttccctagtggctgcaccattttacattcccaccagcagtggatgaggctgccagtttctccacatttttgtgcatgtgaagtggctgtctcatcgtggtgtttgccttttcttaaggactcaaaagtttgcagatacaggcattcacttgccattttcttaaggtagagttgaaagtactgctgccagttcatcatctgaaatgagggctgttttctttcctgtttaattggattgcaactatttgcctttcctaaagatgaaatagtgtgcttcctacattattctgacaacattcctttaattgttaatttcagatgaatttctgaaaactgcttttatcagaacagatttacttaaatgaaggcaatagccgcaaggggtcactgctctagatatttacttctgcataggaaataagtaatcctttatagatggaatttttttttcttagttgtatttttgtatctttacatttgtttataacttatctatactttttttgttgttgtgattattttactgttgacatggaagttctcaatctgatcatttggttatatcattgcttcttctagtaacttcatatccagtgattaaaccttttcactgctgttcacataatgaaccgttgtgattattgaatacttaaatgaggatatgtaagctgtattaaagatagtgttatttgcaaaggcattgactattgcacaaaaaattttaaaagaaaatatctcttttcaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttcccacctcagcttcctaagtagctgggaccacatgcatgtaccactacacctggctaatttttttttgtatatttggtagagacagggttttaccatgttgcccaggctgctaagctttttatatacagtatatagaaagagttggttttcttaaacaatatttatttctcataataactctatgaaagcaggtatagacttcttgctttctagggttggtatcttgcttgttgaggacctacccttttgtgttgccgaatttttcattgtttgagttctgtcttttgtttcagaaagccatggagttttgaaattattgttatatcattatttgttacataattatttctacttctagaatctcatgctaacttggaagtgtcttctcagcatcaagcctgatatggaggggcagctacaccctaatacgctccaaaactagttatgctttgttttatacgtaatgcttctgttattagacaagtggtttccaaatatcagaagcagtgctaggacttaaaggaaaagggggagtgttttttcttctaatagaacttttgagcagtgatgaaaggaaaacaagaagactcaaaagattataaatctcaggcacgaattagtgttctgccaattaggaacattctgattgcttgacaaggtctatattttgctgatgaggagtagaagcctgtgggaggtgggggtggaagcagcagaaggaaaagagtagcaagtatttagtaaaatgtattcatc

SEQ ID NO: 34951 - DNA, 1025 bp, Homo sapiens
tgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagactttttttt

SEQ ID NO: 34952 - DNA, 1912 bp, Homo sapiens
ggttgtgggtgcctgtagtcccaactactcgggaggctgaggcaacagaatggcgtgaacctgggaggcggagcttgcagtgagccgagatcatgccactgcactccagcctgggcaacagagcaagactccatctcaaaaaaataaataaataaaagaatggcaggaagtaaaaacatccatttgaggaaaaacgaagcaatcagaactttaaagactagatattacaactctgaaacacttaacaaaaagtaaattcaccatgaaagtactaatttgtcatttgaatacaaaatgtttatcactataaactaaggggaaatgactaaatttatatgtatgtgtgtcctctgtagatatgtcctgttctctgacacctgtgggaagtaattgtccactgtttagcagaaattctgatttgcctcattttttcatttctctcttaccaaaaataactctttttgttcctgttgttttctcctgacatttactttttagggtctagctttatccagatctgaaaatccagacaatccatttacttctgtctgtatcaggaaacagaggcctgggtctagagacagggtcttggtgagggaaggactcaaaaccatgggatacagcatgaccgggcagcaccacagctgtggaaggtgagaaagtttggcagcatatgagtcaaggcatatggatctacatagagaggaaaagtatcctgtccttgggtaggagagctgggttgggcattagttggtagttttgtgtttactgatctcatcttgttaaaaccatttcatgatggttgtagattctggggacccagagtgtgaagggcctggagaagtggtgatatggtttggctgtgtccccacccaaatctcatcttgagtttaactctcacagttcccacgtgtcatgcgaggaacccagtgggaggtgattgaattttggggacaggtctttcctgcactgttcttgtgatagtgaatgagtcccccaagatctgatggttttaaaaatgggagtttctctgcacaagtcctccctttgcctgctgccatccacataagatatgacttgccttccaccataattgtgaagcttcctgagcaacgtggaactgtgagttctccattaaacttctttctttgtaaattgcccagtctcgggtatgtctttatcagcagcttgaaaatgaactaatacagtaaattggtaccagtagagtcaggtgttgctgaaaagatacctgaaaatgtggaagcaactttggaatggggtaacaggcagaggttggaacagtttggagggctcagaagaagacaagaaaatgtgggaaattttggaacttcctagagatttgttgaatggctttgacaaaaatgccaatagtgatatgaacaataaagtccaggctgagatggtctcagatggagatgaggaacttgttgggaactggagcaaaggtgactcttcttatgttttagcaaagagactggtggcattttgcccctgccctagagatttgtggaattttgaacttgagagagatgatttagggtatctagcggaagaaatttctaagcagcaaagcattcaagaggtgacttgggtgctgttaaaggcatttagttttataagggaaacagagcataaaagtttggaaaatttgcagcctgacaatgcaatagaaaagaaaaaccctttttctgaggagaaattcaagccagctgcagaaatttgcataagtaatgaggcgtcggatgttaatacccaagacaacagggaaaatgtctccaggtcatgtcagaggttttcacggcagcccctcccatcacaggcccagaggcctaggaggaaaaagcagtttcatgggctgggcccagggtccccatgctgtgtgcagcctagg

SEQ ID NO: 34953 - DNA, 1068 bp, Homo sapiens
agctagaaaacaagaagtaatcctgaatttcttcctatcccctaatctaactcatttgcataaagcttttcttgattgcgcgtctcagagtttggactcatgtactcttgaaggctggagacattttaagaaaatggctacctgttggctgggcacagcggctcacacctgtaatcccagcacttttggaaggccgaggcgggcagatcacgaggtcaggagatcgagaccatcctggctaacacggtgaaaccccgtctctaataaaaatacaaaaaattagcggggtgtggtggcgggcgcctgtagtcccagctactcaggaggctgaggcaggagaatagcgtgaacccgggaggcggagcttgcagtgagctgagatggtgccactgtactccagcctggtgacagagtgagactcatctcaaaaaaaagaaaagaaaatgcctatctgtttactgctagaaatttatatctttttctctgagtgaaaattgggaattcctgtagaagattcttcttttctgggaaaaaagaattttgttttcagtttttcaaaaaagctgtcttgttttgaactaatcacctgatgttttaaaagcatatcttcaatctgaatgaaagtttagagttcacgggagcagataactaacttggttttattttattttattttattttatttatttattttttgagatggagtctcgctctgtcccccaggctggagtgcagcggcacggtctcaactcactgcaagctccacatcccgggttcatgccattctcctgcctcagcctcctgagtagctgggactacaggcgcccgccaccacgcccggctaattttttgtgttttttagtacagatagggtttcaccgtgttagccaggatggtctcgatctcctgacctcgtgatccgcctgcctcggcctcccaaagtgctgggattacaggcgtgagccacagcgcccggccttattttattttttgagatggagtctcacgctgttgcccaggctggagggcagtggtgcaatctcggctcactgcaacatcctctcccag

SEQ ID NO: 34954 - DNA, 1034 bp, Homo sapiens
tcagagtgcgtcagctctcagatgaatcgtcttactaagaggtcccagttcataagaggcttttgttgtctcaacctttgttgtttggtcctgtggcaacaaaggtctttcttttgaccgtccttgagagtggctctgcatcttgggagggctgcctctcttgagtaagtctctttcatccttggttaagttataaaacacttactggttttgattctataataagtcacttggtagatacctctggtttaaatggggaaaaaaaaaaagccaggaatagttgttatttgctccagctaaaatctaatgataagggacttgaaaggtttttttgtttgttttttgtttgtttgtttgtttgtttgttttggagctctgtggtcagaagtcaggttaattggaaactgatattcaggatacaatcttttaaagttatttctgttctctctattggatcttgcttaccctaggagaacatctcagttgactgataccctcttcttgaacccctgcaaaccatatgctcggtctttctgcccacttcctttcttgttggcataatttttgctaaggataatgtggaacttcattgggaaaattaagatctctccatactgacttctgaagactacttcttctatttacttctgtccctccttccttttgccaccctcaatcttctgaactttcaattcagttcttttaatccctgatatgttccccttcaagctcctgtctcctccatttgttgatcggtggatggaaaattactaaaaggaaacatcagaggtaagaagaattcaggtttctatggccaaactttagtcaggcttctgaaccttctccaaggcccatctctgtacttccttgtaaaatcctatagtaaattcctgtaagtctatgttgccttgacatccattttgaatcctcctctggtctcacctaaccgacacacccaaacctcactctcctcctggtctgggctctcataaagagtggcttttttgataggcctgtcagggcaggggtagagt

SEQ ID NO: 34955 - DNA, 1044 bp, Homo sapiens
actgcaacctctgcctcccgggttcaagtgattctcatgcttcagcctcctgagtagctgggactacaggtgtgtgccatcacgctcagctaattttttatatttttggtagagacgagtttcactatattgaccaggtttgtctcaaacttctggcctcaagagatcctcctgccttggcctcccaaagttctgggattacaggcatgagccatcacgcccagcctgttttgccttcttaattatcttgagttttctaaatatgcaaccatatcaaaagacatgtttttattttttcttttctgatatttatacttactagttaactttttttcttcttgcatttgctaaaatatctaaaataatattaaataataatgatggtgcaggtatctatctgtttcttgactaaaatgctttcagtagtgtctctatataagataatatttgctattggtttctggtagtttttgtcagtttaaattttttcatgcctacttagaatttttattaggaatggctgctgaattttatcaattatcatttgaacagctgctgatgtttttcttctgtagtttatcagtgtaatggattaggttactgggatttggatattgaaccactcttgcagttgtggaataaaccttgctgttcattgtattttactcttgatataatgaagacctatataagctaatattttatttataatttgtatttctaaatcataagtgaaattagtctataattataattgtaattaacaaatattactctatccttttttctttcttatgttttgatattaaaattgtattggcttcaaaatgtgaatttaaaagatttttatatggcttggagtagctaaacctgcattcctaatcagcatctaggtggtattaatactacagtcctcggacacactttgagtagcaagggtttaaataatttaacattgggccgggtgcagtggctcatgcctttagtcccagctacttggaaggctgagacaggaagaacagttgaggtcagagtttgagactg

SEQ ID NO: 34956 - DNA, 1031 bp, Homo sapiens
gggaaagttgtggtagaatatttatctttttctaagatcctctcattgaatgttctctttattaaatttgaaattatattctcaatataagcatttcctatctataagataatattaagaagctggtatatttactccaaacatttactgaacccctacatttacttcgtgctaggaattgcagcaggtactgggaaaataaaaatgactaaaacaccctgaccatctttaaggagttggagatggagatgacagataaacaggtcattgcagtacaacgtgtcaggcaggagtgctatgggaccacaaaggagaggcacttcatcagttaaggaggggacatgagtggaaataggtaatacaggaggagaaaaggggtttctgagaaaagatatctgggacacattgagtttaaggtacatgagcaacttgcaggcagagaagtccagcagactgttcagtatgcagtctggagcttaggagagttatcaggcttgcaagtggagatttgagagctgtcaacatgtaggtgtttgtttacagtcctcagagatgatgccattgtggaatagatcagtgttcgtatgtatattcatgtttcagtagctgataggggaggcagagtggtaacagaaagaacatgggtttttgagtcagagagatgtaagttcagatcccagcatcttctgttattggtagtgccgtgcaccatattaggtgggataaatcttctctttaaacctcctatttacttaattaggggatattattctttttattagctctgttactttagttgttaattaacctctctgagcttgttttgttttttgtaaaatggagctaataagtaccaccgagagttgaaagggtttaaggaaggaacccacagaaagcagcacacacagagtctgatacccaggagcactgaacacactccgatgccactccttccctttaggattctaaagtacatacagactttccccctttttgtgttttgctaattgtaggcttgacatttaattggg

SEQ ID NO: 34957 - DNA, 1075 bp, Homo sapiens
tagccctaaaagatattaaaatgtaaagaaactgaaacagtttagttctagagaagtagataagtgggaaggaacaaagtggggaatagaaacagacctaaatatgtttaagaatttaatgtaatagactgggcaaggtggctcatgcctgtaatcccagcaatttgggaggccgaggtgggaagattgcctgagttcagtagtttgagaccagcctgggcaacatggcaaaaccccgtctctactaaaaatacaaaaaattagcctggcgtggtggcacatgcctgtagtcccagctactcgggagactgaggcacgagaatcatttgaacccgggaggcagaggaggcagtgagccgagatggcaccactgcactccaacctgggcgacagaacaagactccatctcaaaaaaaaaatagtaataataataaacatggtttttcagtttttagtaatagaaatgcaagcatatgtagcttaagcgaaaagggacatttagtggccatgctctcaaacagtaggcagcaatagaattggccttagggcagttagaaccagagaatcctaacaccgtccatactcaccatctcttctttgtggggcagcaccagacttgcttccttatggcttcaagatgaaagcaaaaagagctctctgctgtcaactctagttagaaaaatccccaggaagggttctcattagtcccttgtgggtccatttctcacccctatgagcaggatatagggtttaggtttgggttttggttcttcagaagacagagaagtggggtaagcagagaaaacagctaatacagatgacacttcaagtcacagtggaaaagatggataactcagtgaatggaattgagacaaatggctaccacgccatttagaaaaatattaagcttagcgtggacagcatggcaagaccccgtctctacaaaaaattaaaaaattagctaggcttggtggcgcatacttgtggtcccagctccttaggaggctgtggtgggaggatcacttgagcctgggagtatgaggctagagtgagctgagatcacatgctactgcac

SEQ ID NO: 34958 - DNA, 1050 bp, Homo sapiens
tggtgaaaccccgactctactaaaaaatacaaaaattagcagggcatggtgacgcacgcctgtagtcccagctactctggaggctgaggcaggagaatcgcttgaacccagtggggcgaaggttgcagcaagccgagattgcgccactgcactccagccttgcaagagagagaaaaaaaaaattagagcatattagcactcacatatagtcccagctacttgagagggtgagatgggaggatcacttaagcccagaaggttgaggatacagtaagctgtgtttgtgccgctacaccccagcctggactacagagtgagaccctgtctcaaaaaaaaaaaaaaaaaaaaaaaaattgatgtttttacatttgaaccagataggaacattttcaagagatattttttaacttaattgccacagtagacattgttattgttattataaaatgcaatgagctgtgtttacaaactgtttttgtcgacaaataaagaaaaatagtgtggtggtatttagaattaaaactgatgaataataagacagaaagttttggctggacacggtggctcatgcatgtaatcctagcactttgagaggctgtggcaagaggatcgcttgagcccaggagttcaagaccagcctcagcaacatagaggaaccccatctctataaaaattagcctggcgtggtagcgcatgcctgtcatcccagctactcaggaggctgaggtaggaggatagcatgagccctggaggttgaggctgcagtgggctgtgatcatgctactgcactccaagcctgggtgatagagtgagaccctgtctcaaaaaaaaaaaaaaaaaaaagacaaagttttagatcttgagacataaaacagatgataccttagtaaaagttaagaacaccaagactcacactttttgtgacaaatacagaagtgtgtggtttcttttttggatatgatgtttactgaattcaaacatatttcttcaaggatattgatctctattttgattttaagggaaaaagagaccaaaacagaagaagaagaa

SEQ ID NO: 34959 - DNA, 1028 bp, Homo sapiens
ataactttgattagagacaaagtgggatttatgaactaaaaaagaaataatgtccctttactttcttaaagtatggtgcatggattagattaccaagacagatgctcagagaaactagacaagttcttttgttttttccaattcctcaaactttccaatttacattcagctcacgtaactactcttcagctctgtgccaagtgctttgtatggtctaattagtgtcaaaatacctttgcatgtagcaagaacctgtgctttcagaaagtccatgttaatactatagccaacctatagctaagctttgtacagtctcttttcagttatctaaaattctgctcacccaaactaccttttaaaattcccatatcatttgcttacaaagggctatgtaaaaaaaaaaaaaacaattcccaaatcacatatccttaaatttaagatctaggaagaaaaatatggtattatagcagctttgcttctaatctaggaattcccctacttcaaaactcagctgactacatgactacaatcaattcatcatcatttctgaactcagagtaattatcaaattgttttgtcctacggcagaactctattcaagtagctaaaataaaagatgttagagtctaataccagatctcgttttaaaaagaaaaacattttggtcatatttgcaaaggccttactaatagaaaaaaaaattcttaccaggtcctcattgctggatacctgttgtgaacaacctcttctccaaagcactgcgattaaacagaaacagcaattaaccatttctttttcttagctgaatagctaaagatttttgtttttatggagacaggatgaattaagggacacgatattaaagaaaggttttgtattatattcagaatggttaaaaacttttatatttgggacagagtaagactcaacatgggtgtgctttccagggcttagggggaaaagaacatattttcccgcccatacctgctctttctgacatttattttcccttcattccatggttagag

SEQ ID NO: 34960 - DNA, 1076 bp, Homo sapiens
ttttaatcatcttcataagataaaaaccaaccagtagctccaaagaagcatcactgttttgaacagacttgtttcctgtgggtacttatagaatgaattatgtcttcaattaactttatagcaaatacttattttataactttatctcttataacatcccccattataagctgataaaatcattctaaggcccgtttaagttaaagtatttatcatatggtggttgggggtggcaaaaggcaatactttgggatccagaaatacatacctcttattaattgacttaatccaaggataaattctgaaattcccagaagcatggaagaactgtatgtctttgcggcaattattttcttctttcacatttattgaatatctattaagttcaaagcacaatgctaagctcaagggtttttacagtaccgtcttagtaactgcctttattgatgaggacaatgacaacctcaaaaaccaaaatataattatcaaccatcaattatgatacattggctaatggaaatatttagaaagtcagcaacaattcaacgaagacaagaaattcagtaaggactgggcgcggtggctcgtgcctgtaatcctagcactttgaaagtgcccctaggaggggcaactgcttgaggccaggagtttgagaccaccctggacaacacggcgaaatcccacctctacaaaagtacaaaaattagccaggcatggtggtgtgtgcccatagtcccagctactcaggaggctgaagtgggagcatcgcttgagcctgggaggcagagggagccaagatcatgccactgcactccagcctgggtgatagagtgagaacctatctgaaaaaagaaaaaaatagtgagtaggatttatctggccatgggcggaggttatgttatcaaaggtaaaaaagagagaatgatgggagtagagaagggaggagaggggtgaggaagcagttagcagaacaaacatcacacacaaaggccctgaggtagaagcatttggtacatttgagggtgggaggggaggccacagtggctagaagttggagggaaaggggaagaggctga

SEQ ID NO: 34961 - DNA, 1117 bp, Homo sapiens
acaaaacattgtttttcgagttcgttttttccccctagtgcagccgcttgtaaccgattgtttttccccctctctcgttgtttattggttctcacagatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtgagtggaccttgcatacctggagggataggtaccgcccctgtcgcgcgcgcgtgcacacatgggcacacacacacacacacacaccccaaactaacaaacagtcgcctgggaggtgcgaatccaaggagcctggggagaagttgagagcagtgaaggagggtggggactacaaaggcgctggggtcttgcaggcgggcaaactcttgatgaacaaaaggaatcaagtccccgcctttgaaattaggttaatctatatagcagcatgtgctgggggactcaccattattagagaataaaggcattactgaaatatcagcccagagaatagatcaggccagttagacagcttctacatatcctatctgtagcgatatccaagtttttgtttgtcaattcaggctccactagttatataatttcctaatgtagatcagtattacagggctactgtattaattcgcaagtaaaaataaataaatccacaggatctaaccacttgccatagatgaacctgttttttagcttagcttaaggcaatcgctttggaatagtaattttacaaatgaattgacaagattattactgaattataggcttgaatttggtttaaaataagtttattaacagatttaggatttgcactattcatgacaacaatttataattaaaacatcactttccttataattgagttgtatagtatatttccaaggaaacaaatttcagaaattttttcctaaaaaataaagggattaaacaagctgggtaaattcaatctaatggtttcttatatttccaatagtctcttttgtccttctttttcagtttgttatgtttgtttctt

SEQ ID NO: 34962 - DNA, 1075 bp, Homo sapiens
tcttcgtctctgcttccccctcccctttctcattttatttagcacaattaattgaggcggccactggccccagcgcggaaccgcaccactcaccagctcccgcccctcctggccccgcccacaggagaaagaagtagggagcgggaggggactaggcgggcgcggccctacgcctggcccgcctcagccaatcagagggtgcggcgcccccgagtgggcgagccccaggggcgacgcaaggatcgaggcggcgagctattggacacggtggttacgcccccggcctgcgcccggctcgccggcccccgcagcctcggagtgacgtccctcaaagttctcattttggtcccccacttccccctccctttcgtcccccagctaaagaggggtagggagtgatgcaaatgttttattacctttgagagcttcatctgaactgtcaggcccggagggagagaggaaaggagagaaagagcggaggagccgcggagagggtcagtttggccagaggacaggacttagaagaccgaagcctgggaagccgcgaagaaaatgccagagaggagagtcaaaggctgagagtgagagggagagagggagcgggggtggggcgggggtcgccgggcccgtttgcagaagtggactgacgagcggcgccgaaacccagccgtcagacttttcacacttagtcttttgtttttctgtgtttttcctccccctttttcttttcaatattgcaactccagtgccccgtgggccagagggcaaggcgggtggaggtgaggacctgggagccgcggggatccgtggcactgccctttctggcgcagcagcccggggcagcgtgggcggaggaagcccgcacagaggctagatctcccgcgggctggatgcgctttctccccgggcacagtgagcgtcgaatgcgaatcagccgcgcgaccgaaagagcagagcatcccagtaagatcagaggagcgccacgggctgcacaaggcgtcctttgaacctccccaaagaaagcaagccacccccaccctccaacttcaaagtggagattcggcaactaactttg

SEQ ID NO: 34963 - DNA, 1089 bp, Homo sapiens
tcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccaccaaaagaaagaaaaagaaaagttgttaagtcagttattcagggaaggaaaaacagagatctaataactccctaactttatgtagttcttttctagttgtaaatactttcagaagcacctgcataagattgcagaagtattggctgttaaggttccagttccagttctagtttgactcatccttaaaaatcaggctttctgcagtctgagcttctcaattgtgctggattcccagggctaatgagtgtatgtggatggcagtaaggagaagcaagccccttctgggagacgtgaccctcaaatttgactggacctgtggaaaaagacatgtctgcatggttttggctcttttttcctgagctttattctccagccaaaaagtaagcaacagtgtgtgtatatatatatatgtgtgtgtctcttgcacccatactata

SEQ ID NO: 34964 - DNA, 1015 bp, Homo sapiens
cggagatgaacgaatgggacacgcagaacgtcatagtgacaggacactcagatggagtggttcgggtaagtgaactgagagaaaaactcattaggatatttgtcatcctagtttaccagaaacttgtagctaattacaggttaagaacacctgaacaagttgtaatgtttagtgaactctcgctccagctcagacaggccttggcctctgcgttatcagacatgaggaacactggtgtcttggcctcttttcttcctattaagtagatctggtagtgctactggccatttgacagcttgacacagtgaggtcagtcaaacatgattcccatgtcacactgggattgctcaacatgcgaactgcagaagtactgggttttcagcctgtcaaatggcttcgtagggaaaacatagtgagcagggataagtctcttccctacagagaatcacagtgctggaaaacacttcgaggatccccagctaggatcccagatgactgcacctgaagcctagatgtagtttatccttttcttaggttgctatgtgctgggactctacagaaaatagaggcaatggagtattcacttttgtagtctgttgaagtatttgagtttttctgtctcaggagatttttctttgtgcttgtttttctttaattgtgctctttgtaaaagcagagagcagctgattaccaccctctttagtcagagtcacatgttgaaagacagtgaagccatcagtccactccaataccacaccctgtacctcacacggtacacatctgtgcacacacaaaaactcacaaacacacacaccctggagtctgcttcctcgacagtggtatttcacactgctcaatctgtgaagcagcataaaatagctccctagccaggcacctggggattctgtttactgtatgccctcttggagatatataatgtgtattagcatatgcaagactctgagaggtttttgtaggaaacaaaaaagtttacttagttgaactatgtttttgt

SEQ ID NO: 34965 - DNA, 1028 bp, Homo sapiens
aaaaagagtaaaaattatgaatataaaattagtagggctttgtttccagggttttgaaagggactcaatggaagtgaaggccactaaagtttaaactaccttaacttcatagtaaatccacctctgccctgatctatattaaaaaatattgcctcccagagttagagatcaatcagttctttcctttaaacttccatgaatttattgccctccttgcatgcatgtttaatatagtcagtactttttgtgatagaataggtttgtgccaacctaaagttgcttttgaagcctcttgatatttaaaagagactttacctggtgcaagggcaaatgatttgatcttttgccttattgattaaaataattattatttctcagtaacatttcctttttttgtcctgtcccttaagctgaagaatacagtggtgattcaaaagttaatttcttgttttaaagtctttgatttgttagaaataaatcaggtgattttttttttttactcattaaagttttatttcttaaactttgataatgttacatgctgtataacaaatagcttacctagtctaagttttgaattttatttattgattttaaattggatgtttgtgtatagaatatggaacatattcagactttaaagcgttaatagtttatcaactataattattgtaataaaaatagtaataattattaatatcgagaaaaattaagtacatatggaaaattctgtattctcatataaaaatgatttgtactcttcacacagtaaccttccttggggagtaattttcataattaaaacaaatgaattatactataattctgtattttaaacaaatattatagatagtgtaagatgtaagcctgggatatgctgaaaattcaaaatctggttgttcctctgaatcctaagggaggaaaataatgtatattttgccatttaaaaaaaaattatatttaaatattaactaggctttaattctataattcccttatttttaaagaataataatctcaaacacatt

SEQ ID NO: 34966 - DNA, 1051 bp, Homo sapiens
tttacctgtatttcattgtaaaccaccatatctcttttggaagtgaggtgtgataatagtcaagtatttattatattattgtagtttatattgttataaactgttataacagtttttatataacaatattatatatagttttatatattatatatactatatattatataatataaactataacaatataataaatataatgtttagaatactatgttttaaataatggattcaaaagaagatgatgtttcacctttgctttaaattttttttaattctgtagtcagaaaatacgtgaaagaccataagcatagcatgtataccatctctcatggcatttaaaacaaatttattagtagaattttttaatctttttaatatattaggtaatgtaaatgtggttgagctcatatttttgttttagttggttctgtttctaattctaaattttcttgattaggcttcccctgaaaggtctacaagaactcagcaaaaagaatttcaaacttacattttggatagcgtgatggaccatttgcttgcagctgatgtgttattaggtaattctgtgtttttattttatagaaatacctataatcactttcctctctaagccccaagtaaaactactttttaacatcagcttttttctttccttttttgtctagcttctcatactcaacattatatttgtgagatttgtctatcttgttgcatgtagcaggagtacattatagtatttcatcatgtgaatatatgaatttgtcattttactcttgacagatatatgaaagttttcagcttgagataattattttaacagctgctatgaacattcttgttcatatggaccacataggtgtacaatacttacacataatctgttgagtatatacctatgagtggaattgttaggtcataggtatatgtatgttatctttttagtatggcttccaggacatagagtcaaaacacattgaaatgtgttttttctgtatgtctgtatctaattacaatacaaatataaaacttaatacatttacagtgaagc

SEQ ID NO: 34967 - DNA, 1048 bp, Homo sapiens
tgtattacataatgcttaagagtgaggctcagaaaggtgaagtaacttccctaccttttatcttactcctaacttagcatgatgcacgatggggcaacattaatggtaatacagccactttggtaccaccaacactcatggtaataataatgaataatcaaaaccactgattctagttagcagacctgcgattaatctaatgattagacaatgatcctatcagtttctaaggggattttttgttttagctagtttctaaatttctttgcatgtgtgtatacatgtgtgtttgctcatatgtgtggtttacagagttctggaccatcaatatatccagtttcataagaatactgagtaatggatttttaaaataatttatagcagtgtcaataactgtaacatagtgtttcctctcatgtccccataacagccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtaggaaagggggaggaaaatgtcagaactggaattagaatgtcagaactggaattagtctgtttcaatggttagcagattttttttgacagtcttttaagtttctgaccaagttacagtttcataactttatacatcacctcttgcattattgtccggtgtccccagctccccacagtttccttctgctttctcctaaaatcacagtgaactctacttccttttctcattcaccatattcttgtaagtcccttgttagtaatttcccttttcaagtagttgattcatttattttacgcgatgccagctgtgtagttgtaaaatgttcttttccattaagataactctagtctgaccaaatttatttattttttattttaggaagtaggtatttgctggatttaacttttgccaataaattatagggttgaaagcaaa

SEQ ID NO: 34968 - DNA, 1051 bp, Homo sapiens
gagggaattctggatgttaagttcagccagtggatagctgcagccacaacgggcttggatttaccatcccactgcccagcagctttccaacagattacagatcatgttgtgagtaaagattgttttacttactcatttagtcttgtctctaaattcataggtaatttaaggttaactagtttttcatgattttcaggacaatgaaatatattaactacattatagcaagttacaaaaattagctgggggtggtagctcatgtctgtagtcccagctactcaggaggctgaggtgggaggactgctttgaccctaggaggtggagattgcagtgagccaatatcatggcactgcactccagcctgggcaacaaagcaaaactgtgtctcaaaaaaataaaaatatatcataacaaggatatttttaagttatgtttttgtagcattctaaattttggctgtattttggatttcacttttttcttagggaactacaagaacactagagctcttctgaggtctttcatttaataagtagaacttacagcaccttaagaaggattttcaaactcccttgtatcttattgtctcaactgtgtttcaaaacctatatcctaatagacaggtttgctaaagtcaaacaaattgtaaagtaaaacttttaactgaagattaattcaacagttgaatacttaattgcctatagtagtatgaatgttctggatagaaatgttaacacatactgaattacttccttctttgttaatgcagcatgtttatcagttgctgattttgcacttactgttatattcctcttctcttaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcaggg

SEQ ID NO: 34969 - DNA, 1072 bp, Homo sapiens
gctaatttttgtatttttagtagagacggggtttggggtttcaccatgttggtcagactagtctcaaactcctgaccttgtgatccacttgcttcggcctcccaaagtgctgggattacaggtgtgagccaccgtgcccagccagcctgtattgccttgtcccaaattctacctttaatgctttccctagaatttgcattatagacagaagatatttttaaaataaaacactgctaattaaaaaacttttcaagatgatgtatacagttcttgttcacatggggaatttatcttaattatttttcactatcttttaatcaggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccaggtttgtaactgtaaaactttgccttcacttcacctggcacctaaaatactctgcttttttattatcattcatgttgtttgaaactctggaagaattatattgtccaaggaaacttaaagagacagtagttttatgaaaactaatatatgtcaaatgaaagtatgtattgtttctttattttgctttatcctttttctcctatcttatcaaatcttactaaacacttgagttaggcaacattatttcaatatagctttaatacattgaatttattttcagaacaaaggtttgctggtttgaatgttgtttttctctgtggaaatgggaaagaaatgaaatggggtcctattcccccttcctgaaaggattgccaaatccatggtagattcagggctctccctgtttccttctctctcccctccacctcacaccccaccatcttttatctctgttacttactcaggagacgtgaaagccactacataataagtgtaccattgctattcctgaaaactaaaaatacaaaaattagccaggcatggtggcatgtgcctgtaatc

SEQ ID NO: 34970 - DNA, 1069 bp, Homo sapiens
tttaaataaactaggagagcctgtgtgcctttttataagtaaagcggaacattttcctagaatccctgttaaaaagagaacggtattttttttaaaccacggcagtgccaattctttgctactaaatcagtgacgtaaagcatctgtttcccaagctgctcttgtcccagagagctaaaactgcattgctctctgtgacagagctcagcattaggcaaattatgctgagaccaactcattggaacaaagagttcccataggctgaagccacaagcatctgtttcttagtgccaagatgcaaaatgtgcaaaattcatgaattgtagatgagtagtatgaaatagaaagtagagatcattgatgagaagaaatgtgtacattcaggacatggctgggctttctaattcatagaaactttttctgtaaattgctttcaagtttttaaaagttgcaatgaatattttcagtgataatgaggatagatgcagaagatgaaagtagttccaaataagctaaaggaaaactcccacaatgccaaatatatttattcttggatagcttagactctgagacaaccctgactcagctgacccagttagttgttgattgtgttactcatgcactaaggaaaggttaaaacacatataggtaatttcaaaagataaaatctcactgagggaattaatttaatttgatctctcatcacgtattattggaactgtcatcttctagagctttgaatcactgtgattgtacttgttctttacatcttgtggtacaggtgtcattttttaatcaaacaatccatatagtaaatcagtaaaagtaaaaatcatataaaggctatgaataatggatagttacatggtctgcacacacccacccacacacatgcggacacacacacatatcaactcgagttgataatatattcctttttttctatcccaaccttaaggtgttttctaacaaggctttttggttatcagtggatgaaagtaactgaagaggaagagaatgtgattggaattcaataccaaatttactctttctttttttataggcatgc

SEQ ID NO: 34971 - DNA, 1056 bp, Homo sapiens
attgatatgtgttatcaatagaacatcattatgattattcttatttccagacacgtactccatcattctccacatatcatactcctcaaaaaatgatatagttcccaaagagaggtgtcagtgtcttgaaccgtcaagttcaagaggccatcagactcaatatttactcattccttcatgaaataagtacttaacaaaaagctgctgcatgccaagtcactgtgctaggcattgaggattcagctctacacagggctgtcttggtccttgctatcttttagctaaaatgtagacacataaataaacaattacatatagtgtgacacattctacagtgggggaatccagggttctcaggcagattgtaggagagccacttcatctagatcacttattttcagtgcttcaactgtgttttcaatgaagatgtcactttgaaaataatacttctaatttatgccccaagtgttattgcttttaacttaccatagttttactacataaaataaatgaactgccctcatcaatagaccatgtaactacattggatagagcttgtaataggttttgtgtccttttctgtggaatatctgctttgaagtatcaactgagatatttcctgcttcttaacaagatttcttagtcctcagtatttacatttaaaaatccaaacagctttgacaacaattgtaaaaaaaaaaatcattaaacttctgcttttccctatcttgaagtaaaatgcatatgtatagttaatttatcgaaaacacaggacagtgtagtgttctaggaatgagctatataaatttgtgtattcagattcaacctcttttcccttgatttctacttatcctagttagaatacatcatttttagtcactgtcaaaaatagggcttagagcaccctgtttaacagatgtgttaaatgttaacatgaatggaataagcatctgccgtgagcatgcttttctgtttcattcagtgcttgtgttgtagtcttgttccttgttcctgctgaatatggaagatgttccttattaaacttttactggcatt

SEQ ID NO: 34972 - DNA, 1065 bp, Homo sapiens
ccttataaatagtttgaaaacgcttactaacattaaaattaagcgaaaacattcttctgtggtttgttcttattttgcatatcttttctttattgctttctaaacctcttattctacatccaactgagaaataaattattccttaattttttgtgtcattttgcaagtctctaaaacatagcactgtaggggcttatagtatttcctttgctttgcttgtttaaataactaaaaatgcatataaaaattaaatgtttcatgatcaaggtaaaggaagaaaagataacatttattgaatgtaactagtgtgcttggcatgttacagaaatgatgttatttaagttttataaaaagttcatgaggaaagattttataaatgaaagaaactcaagattcaagggtgtttagagcctttctcctgaagttacctgatttattatacgggtgtgtttataaaggtttgataagtgcctattctttctgctctttcactgctgaagaatattttagacatgttacctcttcgtctgaattatgttttaaatgtaaacatttaaatgtagacaaagccatggttaccagagagcaggcctgaagtgtgagatgtccaggtccttggcgttttccacaaagaactggacaaaatgcacacgcaatgaagcacaagtaacgaaggaatgaagcagcaaaaacagggatttattaaagcgagaaagcactccacagggtgggagtgggcccaagcaagtggctcaagggcctggttacaaagttttctgggttttaagtgttccttttgaggtccctatcagctaccccttatctggatgaaggatttggtccatggctaattaaaggctgcggtgaattggtgccctatgcagatgaagggatggcctgagcttggcccacagcccatccagggcactttccccttccatctaggacgtggtggaaaggggagggttagggagatagcctttgatcctttgctactctggcctggggagatggggcatttccttttggtttagcttttggaagttccagacccaggtgttttct

SEQ ID NO: 34973 - DNA, 1035 bp, Homo sapiens
cctttaattccaactctttgggaagccaaggtgggaggatcacttgaggcctggagtttgagaccagcctgggcaacatagtgagaccccatctctataaaaaaataaaacaattagctgggagtctgaggtgggatgatggtttgagcccaggagatggaggctgcaatgagccctgatcatgtaactgcactccagcctgggcaacagaatgagaaaaacaacaacaaaggaaagctggaaagcttcttagaagagggacagttgagctcagatttaaaggatgattcataatcatctggatgtagaagagccagacggggagagcccccaggagagggctcagggtgcgtgcaggcagagcaaggaggcctgcagtagacgggtgtggttaaagtagaatagtagggcatgaagaacgtcaggcctatgcaggggctagataataaagagccttaaaatttgtacttttccttaaagttatgagaatcaatcatacatatattccttcagttctgctatgtaccagatacttagctatatgttaaaggatttggagagcgtagccttctttcaaggaatttatagtttgatgcaagatattgataatttaatagcatgaaattatctctaagcaagttggtaacttttcaatttagaacaaatgattaatgtaatttttatcaggagatacgtaagatgtcctgcaaaagctttctttaggatgagaactaggatacgtaaattgtaagcttaaacattttttcatgttgtaatatgtaagtttttgtgagaaacagtaaaatacacacccagaactcagaatatctgaacagaaaatctagtgctgtcacttaccagttacataactctatgtaagttttttttttttaacatttattattcaccaaccacttactatgaactaaggatacaaacttaaataagatttggttctctttattgagaaaattattgctaatgggaataaataaccatttactggtaaatgtacattacggtagaataacagta

SEQ ID NO: 34974 - DNA, 1034 bp, Homo sapiens
gaggagatatacagatggtatttaaagttgtagagtgaataagagcttttttagggagagaacagccctagaaactctaccttttagagtttgcttgcatgggccacattttgcttgctttgtaagacaaaccacagcacagaaagaacacctgcacaaactgcagcacagaagtttgctttgtttatattagtttatattaaaacgtgctttcttatttatttatttttaaaaatttttggcagtaatggtactgtaatagatgagaaagtattacatctctaccatgtctaccatttgttgaatgaatgactaacagagcccttccaagctgtgtgacctttgaattttacctctctgagtctcagttttcttcttcttcttttttttagatggagtcttgctctgtttcgcctaggcaggagaatcccttgaacccaggaggtggaggttgcagtgagctaagatcgcgccattgcactccagcctgggcaacaagagcgaaactccgtctcaaataaatgaatgaatgaatgaatgaatgaatgcatgacagaaatttatttctcacagttctagttcaagatcaacgcaccagcagattcagtgtctggtgagggcccacttcctggttcacagacaggaccttcttgctgtgtcctcacatgtggaagaggcaaaggagcttttataaggacactaatcagtttatgagagttccaccctcatgacctaaacaccttccaaaggccccacctcctagtaccatcatattgggagagatgggattttaacatgaatttgaggtgggggaacacaaatattcagaccatagcaggcaggcgggcaggcaggcgggcggatggatggacggagagagacagacagacagacagatagggagatagagaaatagagatacacatcacataaatatacatgtgtatagcgtagtgtcttaaatatctgaaaccgattctttaatgttcatatatttcagatattgtttttgtccagcttttctcagtttgtca

SEQ ID NO: 34975 - DNA, 1021 bp, Homo sapiens
acacgtctgtctctgagttatatttgtatacttcatgagagaagatcataaattatcttttaaatttgtagcttaaaacactttaaattgtatagaaattaaagtccttttagtctaatattcctaacttgctcattcaagaaaaatttacatgacaggcattttactaggtggtgaatataagtaaacaaaacagacatattctgtctacttggagttcataatctggtagacaactagatggtaaatgtataagtagatattttccaatgatgttaagcgcagaccatggaagaaatgcagatgaggtgatagagggtcatgggaaggcagaggtacttctacattgccagaaaaggcttgtcaagagaggtgaccttgaagctgaaaattgaaggagttatccctgccaggaatttacaggaagaagggaagaccctgcagtgtgaacagttggtgtatgaggaattgaaagcatgcctggagatgtctgggggagagtggaatgaagtttgaaaggtagaaagggatcagatatctagaattttaaagggccatggtaaggagtatggcttttattaaacacactgaaagccaccgaagggttttaaagttacatactatagtttctgttacctgtcctctagcccccaaagcactttgtctgcaaaggagagaaagcaggaaaataataagaccattatagtagttcaggtgaaagataatcgcagctcggatctaaagtgttgggagagaaaaggatagatgagatctagtctgtaggtggaaccaatgggacttaacatgaagagtgtgggggaggaggaaagcaaggaaaatactcaggttttggcttgagcagttggttggatgacagtattcttaaatgagactggaggtcagtgaaaagggaagtcaagaatttatttatttatttatttttaattgagatagagtctcactctgtcgcccaggctggagtgcagtggcatgatcttggctcactgcaacctccacctcc

SEQ ID NO: 34976 - DNA, 1025 bp, Homo sapiens
tcatatttaagaaaccattgggctaggcatggtggctcatgcctctaatcccagcactttgggaggccgaggcaggtggatcacctgaggtcaggagtttgagaccagtctggccaacgtggtgaaaccctgtctctactaaaaaaaaaaaaaaatacagaaaaaaattagccagacatggtggcacacacctgtaatcccagctacttgggaggctgaggcaggagaatcgctttaacctggaagccagggattgcaatgagccaagatcgcaccactgcactccagcctgggcgacagagtgagactccatcacaaaaacaaaccaacaaaaaacattgaggagttgcccattttttttggtaagaactttatagtttcagctcttaaatttaggtctatgacccattttatgttaatttttaaggtagattcaattttcccagcactggttttgttgacgagactgccttctcctccattgaatagtcttggctctcttgttgaaaatcagttggccatatatgtgagagttttttcctgggctctgttccattctgttggtccatattaccatccttatgctagtaccatactgttttgattacattatattatatatttgatttattatattaaatgttttatttttaattggatattttattaccattaatgtgtgcctttaaaaatgtttctaatatacaatcatcccttgtatctgtgggggactgatttcaggaccttcctcaagcaccaaaatctgtaggtgctcaagtccgtgataggaaatggcatagtttttgcacataacctgtgcgtatcctcctgtatactgtaaatcgtctttagattacttataataccgaatacaatgtcaatgttatataaatagttgttattctgtattgtttaggaataatgacaagaaaaaatatgtacatgtttagtacagatggaatttgttttttctgaatatttttgatctgcagttggctgaatccacagtgtggaacccacagatg

SEQ ID NO: 34977 - DNA, 1032 bp, Homo sapiens
tcttttcatttagccatttgagagttacattgaacatattatggccctttagtcctaaatgtttttgtgtagatttctaagaataaggatcatctcttatattagcagtctaaaaacttaagtagacttaacattcttacattactttaatcttccgttttctaattttgttatctgaataagtgccttctatggcagttttcttctcctccagtgtaggaattagtcaatgatcatatcttgcgtttatatttgatgtctttttagtacccttaatctagaataattcttcaacctttatcttttattatatgacattttaaaagtacacagtcatcctttctctcccttttcagaagttattttttgttcgttttcttattttttgttccttattttttatttgtttgatgtttctgttgataagattttaggttatacattcctggatggaatattacataaggaatatatctttctgagcatatcatatctataggtactgactgttctgccgttcatttgtgatggaaattttgaccatttcattgtctgatttttccactatatagttactatgtgtattagttcattctcacgctgcaatgaagaaatacctgagactgggtgatttataaaggaaagaagtttaattgactcacagttccacatggctgggaggcctcaggaaacttacaatcatggtggaaggggaagcaaacacacctttcttcacttggaggcaggagagagaagtgccgagcaaaagagaaaaagtcccttataaaaccattagatctctagagaactcactcactatcatgagaacaacatggaggtaaccacccctatgattcagttacctcccaccaggtccctcccatgacatgtggggattatgggaactacaattcaaaatgagatttgggtagggacacagccaaaccatattactacatgttccttgcaactaataaagggtctactgggagggagacactttaagacagttaaaatatacagctcctcata

SEQ ID NO: 34978 - DNA, 1020 bp, Homo sapiens
ttcaaagatctcacagcatgtgtcccagctgaatagaagataggccaaacacttcgatttttagctatcatttaatgctttaagcaatatacaaagagtaaattaaataactctgttgcatatgggattccttggctgggtgtggtggctcccgcttataatcccagcactttaggagactgaggcagggggatcactggcatggtggtgcacacctgtagtctcaattactcagaaggctgaggcaggaggatcccttgagtcaaagaggctgaggttgcagggagctttgatggtgccactgcactccaggctgagcagaagagcgagaccctgtctcaaaaaacagcagcaaaaacaacaaaacagactttgcctcggtaaaagcaataagattaaaaaaaaaaaatgtcttcctgtactgttggccatatttacatgcttagacctatagaaatccaacaaaagagcccagctatagactgaattgatctttgatcctttactctgcctgtcctgacacacaactactcacacttacaatttaataaattaaagtttaaagaacaagtgttatttgttataaaaagactaaattaatgtgatgattaaaacaactttttgtggggagaggaggccgtagtgtgacatgtttattgcctctgtttagtttgttttcttttccttctgtaaactggaaaagaaatataagaagcaagctttttgtcctgagaagactctttaatgtatatttggctatctgttgtattttatattctcagtgtaaaatatcaataaatgtttatatttataaaatctagttgttgttattgtgcaacttgacattcaacataaaagttacttaaaaccttatactgatagctaaaatctacaggtgtaggtgctcaagtagaatactagaatccggatacagatatatattgtgtaactttatgtatattatacatatatgctatatatgtgtatatttttatatacaataaatgtatagttatatat

SEQ ID NO: 34979 - DNA, 1033 bp, Homo sapiens
aaaatataacaattataataacaaatattgcagtgaaagttatgtgaatgtggtttctatcaaaatatcttactgtatataatatttttggattgtgggtaatgaaccgtggagggtgaaatcatggataaagggggaatattgtaatactttaaagttatatccatgttattgcattcatctgtgttacccagaattaaaaaggataaaacttctgatccttttaatgctgggtagtatttcattgtttggatagtccacagtttgtatatcctttcatcagttgatggacatttatttgactatcatgaataaaatggtacagtgcaataagatattttgagaaaggaaacttttttcatttgactttttgagaaaaaagatttgaatataggagacatactattaggtacccagctgagctgccaactgtgattttgggtaaattactttttctctgtgcacctcaatttattcagatccggcatcgccacgtactagctttgtgacctttacttctggacatcaatttctacatcttaaaaaaggagtggatgatagtggtagctcatggtattattataaagaattaatgtatgtgttcctggcacatcattattattatcatcatcaatttctgaaatgagtagattagattatatgactgcagaggtcccagctcactaaaatatctgtggtcctaagattttccggtatggactaatatcttttttcttaataaagacctttgggcatctacttgagtcctaaatggaggctaattttggtattgttgatagaagttattttgaattaagtatatgtgtgttatctattgccacatatattagtttgtgagggctgctgtaacaaagtactaagaagtgggtggcttaaatgacaggaatttatggtctcacagtctgtatgctggaagtctgacgccagtgttgcagggttggctcctgaggcctgtgagggaaggatttgttccagtcctgttttcttggcttttaggtggccatcttttccc

SEQ ID NO: 34980 - DNA, 1032 bp, Homo sapiens
tattacatatggatgttttggaaattggcaataaccatgtgacccataactctattaaccattctatttgattgataagaaagttttattaaggaatccttctattatgtaagaaaggttatgatttttattgaggtgtttaaaaagtccaatagtaaaaaacaaaaacaaaaaaacctgactcaacaagaagtgggtaccataataagcttgtatttaggtaggtatgtattcattctgctggatattaatgagatagtctctaaaatccactagtaatgtaagagtgatgacatattctagaactgcactgtctagtaggtagccactagccacatgtggttattcagcacttgaaattatagtctaaattgaaatgtgttttatgtgtaaaatgcataccagattttgaagatatttttaaaagcatgtaaaatatattactaataatcttatatagcttgtgttaaggtgatagcattatgaatatattgggttaaatatatatatctttttttattcttttgaatgtggacattaaacttaaaactacgtatatgattggcatttgtgactgtcatttttctattggacagtgctggtctagaagataagaaaaccacatggcaaccatttatttataaccaatcttaaggtcttgaatctctgtttgctccatgttcctttcctatctatagtgtgaagtatcattttcaccattagatttcatatggctacttaggaaaatttatttcactttacttatctatagtttggggattaattatatacctaatatagtttatttgaacaatattatagtgcacattcatatttaaatgtgctgactttattcaaaagtaggaattattttctttatgcttttgcctttggtatataacacattttagacaaaaaaggaacctctcaatcaatactcagagtgaagttgcacagccacatctctctcatgcacttgtcagtggaaagcaaaaagccacaggatttctcatttccatgtgacattttgtt

SEQ ID NO: 34981 - DNA, 1030 bp, Homo sapiens
tattttaattaacttaagaatttaaaaataaatttaaaacacgaattccccattatgactatgtcaaattaacctatagtaatgaaaacagcagtggtctcttgtattaatcggttctcacggtcctataaagaactgcccaaggctggataatttataaaggaaagaggtttaattgactcacagttccacatggctgaggaggcctcagtaaatttcaatcgtggcagaaggggaagcaaacacatccttcacatgatgataggaaggggaagtgctgagcaaagagggaaaagccccttataaaaccatcagatctcctgagaactcactcaccatcatgagaacagcagcatgggggtaaccgcccccatgattcaattacctcccactgggtccctcccatgacgtgtggggattatgggaaatacagtttgagatgagatttgggtgaagacacagacaaaccatatcatccatatagtttatcttagtctgtaccagggcttcccttaggagtgagagagcagagagggaaacctaatgacaaagataaaatttgtgttgaaagcctgctgcttgcatctgctttgattcacttggtaaatcctgttaggttgagaagttcataaaactagcaggcttctgaactatttatgaatttgtacttaaacacacacaaaaaaactgaaaacaagcactgtataaattagttccaatggaaagacattgattattctgaacggacacagcacaatacacctctatgtgacttctcacacatgcagattctcattttcagggatacggacacatgtgtacacacactcatatacagccgcacattcctgtgtattctctttgccggcccaccaaactgaactttcctgaattagggacataaaattctactaaattaaaagtctggagaatatatgcctctgcccatctttatcccagtaagattgaactattagtggcttcattgcttgtgatatttataacattaggtataatttcaaattagcat

SEQ ID NO: 34982 - DNA, 1049 bp, Homo sapiens
cttaataataaaaaaaaattctaaaaaaaaaaaaattaagaagtggtctgaagagaaggaactattaaagaaaactgtggggcacttagagaagtagaaggaaaataaggggtagatgacatcctggaaaacaaggtcatgttaacatcacatcactaccccaaaccctgaccaaatcctacaaattgaatgtaggcacttcccctcctcacagaactgggtagaatgggtgacttggatgtctgtactcaacagagcatccaagtttgagtccttcacctcccttaagttcccccagcatacctgaaagtgcacacgtagcttttgttcccccttggggacagggagaccctgaccccaccttcctcttttaagcagctgggataagggcaaaagcaatggtgggaggaatctggggctatgtaaggagagagtggcttcatgtcagtaagcaaagcatattttctttccagtttgagtgacccagaggctgttcatggtacaaccaaaactaattttcaaagttttcagatgatccaagccctctctcagctttgtgggctcttttatcctttctcctcccttccagaggagagtgaacaacaactaaaacaccatttagattatttatttcaatcttatctcttgctgctcagactctagacattcatgaacaggtagagcagtgggagaccctcacacttcctaaatgcccttgcctaccactactaggtatttactactaggtaaatacttccctggggagtcttctcataaattctaactcagttcttaggatcccttattctttctctttcaaaaagccatgtctgtcagcatcctatttttgttgaaaaaagttttcaagtaagctgccacggttttatggatgccggcagaagacatgaagactcctgggtcagagtaaaaagacttaattactcataggacaacaggcagcatgaacttcgtgttcataccgttcatgcccctacaagtctcatggatgtgatgtgtggaagcccgggtgaaagctgcacgtgcagtgg

SEQ ID NO: 34983 - DNA, 1093 bp, Homo sapiens
tggagtgcagtggcatgataatagctcactgcagcctcaaactcctggcctcaagtgatcctcctgcctcagtcttccaaagcactagaataacaggcccatttctctcatttacttaaaaacattatgtagtaaacatttatacatgacaaagttatcatatcacatatagtatacagtgatttgcaatttttataccttgataaagtcagctgggtcacattagccaagcattaatcccacgtgaactctttaaaagtcaaacattcgaccaatacggtgattcaggcctataatcccagctttgggaggccaagacaggagaattgtttaagcccaggagttcaagaccagcctgggcaacatagcaatacctcattgctacaaaaaactaaaaaattagccaggagaggtggcacgtgcctgtggtcccagctactcagaaggctaaggtggggattgttgagcccaggagtttgaggctgcggtgagccatgtgcactccagcttaggtgacagagtgacacattggtctcaaaaaaaaaaggtcatacatcaaatctctcattataagcaacctggtctgaaacagcacctatgtttctaagatacaaagggaggcataccgtcaggggcaatgagaatgtacaattgcgtggcataaaaacataggttcctggctcgttaccttaactattagttcaacctttgttgataaattaactgctgttgcatcccaccacgtctctccagctcggctgttagaccttattaaaagaatgacggagactcttgtgtctccaagttccactactctatcttgcatatagtgggtgcatgagatatatgagtattctgctaggtggattactatacccatgaatttcatatcatatagaaaaatattagtgtctaacagagtgagtgatagttacatttattttaaagactatacatcgctgtccttatgtccttatcttaagaaaaatactaatttatttaaagatccactcggggaggtggtttgtagaaataagtcatacacataatgcatcagaaaattagttgaaagacatcccacttcagatttatt

SEQ ID NO: 34984 - DNA, 1051 bp, Homo sapiens
ttttcaaacgtgagttatttttatgttttaagaaatttgtcctatcccagggtcatagttgctcaatgttgcttctgaaaatcaaaaaagtgtctcagttaagtttttagcctacctggaattgatttgtgtatgtgtgatatagatttaaaattttatttttttactatgtagaaaatcagttttccctgcgccgtttattgactaatgcatcctttcctcagaggctttacttacatggaaatttgccattgtagccaaatgtttatttggggacttcctgttctgttccattggtcagtttgcctaagcaagggccaagtagcacattatttaattgttataacttgattatatgtcttgatacctgacaagggtagtctcttacctttgtatttttcttaaggaatgttcttggccttctggttttgttttttgttgttgttgttctgagacagggtcttgctctgtcgcccaggctggagtgcagtggtatgatcatggctcattgtagcctcagcctccctgggctcaggtgatccaccacccccacgacccccacctgcctcccctccctccactcttccaccccacctctctgtgttgtccaggctcgtcttgaactcctgggctcaagcaattctctcgcttcagcctcccaaagtgctgggattacaggtatgagccaccatgcctggcctgctttttaaattcagtatgagaatcagtttgtaaaattccttggggataaaaagcaaatagctgtaggaaatttctttttctgtcccccccccctttttttttttgagacagtgtttcactctgtcacccaggctagagtgcagtggtacaaacatggctcactgtagtctcaaactcctgggctcaagcgatcctcccacctcagcctcccaagtagctgagaccacaggtgcacaccattaggcccagctaatttttaaattttttgtagagacagggcctcgccatgttgcacagctggtcttgaactcctggcctcaagcgatcctcctggcttcagcctcacaaa

SEQ ID NO: 34985 - DNA, 1945 bp, Homo sapiens
tgcatacttaaatacagtagaagcgtttgatccagtgctgaataggtaatttacatgttgtctccgtgctttatattatcttctggtataatagtagattacttcagagtgttaaaatgttgctagtcgtagttaatactaagctttgggatatcttatctcccactggaagcttgctgtcctacaaaaccagtctcacatagggaatttttgtctttggttagtattttgagtaaagtaaattatgctttgtaacattttttcttctccgtcttttcaggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaactccatccaaatgattttacagttttattttttcatcttttgcaaaaagtatttgttacataatcaaaaggtgaaccagaggaaatattgaacaaggttttagatctgatgttattctggtgcccaattgagagaccttgagaaagaatgatgcagattacatgactctaatgtgggcagtctgaaaatatctttaactgtcttctttgatcatttgattttggatccaagatttatcatctctctattttgctatttgccaccatcctggtttttctgactgtacagaatcaatctgcatttatttattatcagaaatgaatgcatttttacaaaaacctttttgtagactgtagtttattgattagttcaagcccatcacgaactaattaaacatattgttggtaaaaacagagattgaaattactgtttttatcatatttaaatccctctggtgtatttattgaaatttaattaaaaatatttctacatattgatttgaagccaggatattgatggacctacagatttaacagctcttcaaagttttaactagcattataaaatggcctattcattatatgtatatttttttataaatatttatcaagaacatgaaaatattttattttgtatttgcagtgcagtttggcacctctcttccaggccttcctaagtttttgttagttgtgtcttcgaatttattgtagttcaccgctggtcagtaatctggttcataaggaagctggggcagtgaaaaacacttcgttgatccatccagccctaaagttcattgactaatagctcatgcatcttattaaatgggattctggacttctacaatagtgtggaaagccacatcacaaaaaaagccaca

SEQ ID NO: 34986 - DNA, 1048 bp, Homo sapiens
gatgcttttgaattctttgtttttttttttttcagagggagacagtgtctttctgttgcccaggctgaagtgcggtggcacaatcgtagctcactgcagccttgaactcctgggctcacatgatcctcctgcctcaagcctctcaagtagctaggactagaggcccaggctatcacacccagccagtttttttctgttttttgtagagatgggttcttgctgtgttgcccaggctggtcatgaacaactggccttaggtgatcctcctgccttgccctcccagagtgctgggattacaggcatgggccatcatgcctagctgaattgttaaggtcacattcataatttttgtttaaatcttcatctttcatgtttaaaacatgtacagccttatttttctaagagtaacaaatttatttaaagaaggggattacatttaaataaggtatatgtttttaaatggaaggacacagattgaatgtgctttgctacaataaattttaaaaggtctcagatttgtttttctcaacctcatttcaagggaaattatgttgaatacttcaagtaagccagtaggtatttatttatttatttttgagatagagttttgctctgtcacccaggctggagtgcagtggtatgatctcagctcactgcaacctctgccacacatgttcaagcaattctcctgcctcagccttctgagtaactgggattacaggtgtgtgctaccgtgcccagctaatttttgtatttttagtaaagacagggtttcatcgtgtttgccaggctgatcttgaactcctgacctcaagtgatcttcctgccttggcctcccaaagtgctgggattacaggcatgagccaccacacctggcctaggtatttcatataaataaaggtcatgtcaatgtttatattgcttttttttttttttttactttaacaatcttttattaccaaaccccatgcaggtttaacgctttaacccacctaacagcaaaaaaaggcattgctaacaagatcaaggatgaaggtacagacccaat

SEQ ID NO: 34987 - DNA, 1074 bp, Homo sapiens
aaggtggaaagatcactaaggcatgtgaccaaatcaggattccaaagacggagtagaccacatatactctagacaaaaacctaaaaaatgttaaaattagagttataggttaaaacctgccttaggtattttaaaaactcaatcccacgagtacaacataacatggtgggaaatcaggtttttgattgtttcatatggagaaaagtacctgaaccattatgaaacacagctcttaaaaaaaaggaaaggaaaaaagtgaatataatacagttgcctacattaaaagaagtgaagccttagattaagggagttatagttgtattgttcttgacactgatctctccgtatctatagatgtattgttgaagtagggtatataacaccagttggggtatgggaataaaagattagactctctgtacatttttaaaaatttattttgggtggatgttttataatgaacataacttgttagtacagtaacatgtttataatttgaaaataagatctatagaaaatgcacaaaaatggattgtaataaatgtgagaatgataatctggaatgcatgtaagaaaaaactagcaggttagtaatacaactgaaaaccatgttatctacaaaaaatagttgaagcgttgtgatctggagacaagaaaacttacaggagttactagatattttaagagtgtatgttgatttagtaggaaggaataaatatttgtttatgattcagtatagtagcaatgaagcatactgtaattcctcctagtgattggaattgtattgtcagaaagatcacatatattttgcaccaaatgggagattaaattttattgcctattttttttcaactttattgttctgttaatagcgtgaggatttcaaagactgagcttaataatttgtataaaactagatactagaataattctgtctctgtgtcagagtgaaaatataatgcgagaagagagaagagggctatcttagtaaatattgaaaatattgctgaagagtttcttttaataaaactgcaggtgggccgggcatggtggctcatgcctgtaatcccagca

SEQ ID NO: 34988 - DNA, 1008 bp, Homo sapiens
gaaaaatataaatttaaaataaaaataaaactgtaagaatgaaggaatagtaaattattttttactttataaggggaaaggattataggcttattttattattttgagacaaggtcttgctctgtcacccaggctggagtacagtgatgcagtcatgggtcatggcaacctccacctcctggacccaaaccctactccaccccctgagtagctgagactacaggtgcacaccatcacacccagttaatttttgcactttttgtagagagggggtttggccatgttgcccaggctggtcttgaactcctggactcaagcgatctgtctgcctcagcctcccaaactgctgggattacaggcatgagccaccatgcctggcctctagtaatttaaaaaatatttccctttacatacagcttttaagaagcacaatgttattttatttgtatattatatatacactcttcactattcattttaaatacaaagcagatcttgagatatgtagaaacctaagccatctttaaagttgaggatgttcttatttataaaggttttcctttacattctgatttcactatttttgtaattataactaaactgtgatttgttataactcatgatcacaaattgagcatgtatctgtacctcattaaaattgtatttagacattaaaaagaaaaagaaaaagaggccacagatagctgctctgtgccttccaccatctgaagacacaaagaagagttggcatcagtgaacttagagcaagtccttaccagacatggatttgccagtgccttgatcttgaactttctagtctcaagaactatgagaaataaattatgttgtttatcagccacccagtgatagtttgttatagcagcctgaatagactaaacagtaagcttttttttttttttttaaagacagagtctcactctgtcacccaggctggagtgcaatggcacgatcttggctcactgcaacctctgcctcccgggttcaagc

SEQ ID NO: 34989 - DNA, 1868 bp, Homo sapiens
tgtcgagactggctctcactatgttgctcaggctggtcttgaactcctggtaggctcaagcagtcctcccagctcattggtaactggttgtttttagcttttcagttttcaaaaaaaaattactaggttgtataactcacagcctaagtcatcaagatatttcttaaaaggtggaactgttacatgagagggcacgtaaattaaaaagattttggatatcttagctaaatggagcctaggaaggcttatatgaacagcagtgtgagagtgtttatttcctgacagccctaccaattttattttttgtctttggcaatatttaatttcattgattaataaggatttttaaatattctcattgatcattttccctttcattaaatctaccttttttctatacgtaaggacagttttcagcagacagtgttgctgtactactaactgaaggccatgttattgttggtctttactcagttattgttcaagaacacatctgtctaaaagaggactctgacatcgagctgttgcaggcatctaattcacacttaagtttaactatgactttgacttcagcaccagtgacctctctaatcagtctttccagtaacctactagatctctccattgggtctcctatcagtgttgaatttcagcacgccctgacttccagttaggaaattattctttccaactcagtgatctcggctcattgcaacctccatctcccaggctcaagtagctgggaccacaggcatgtgccactatgcctggctaatttttgtattttttgtagagatggggttttgctttgttgtccaggctggtctcaaactcctgggctcaagtgatctgcctgccttggcctcccaaagtgctgggattacaggcttgagccactgtgcctggccaagaaaaacatttttttaaagtcacggcagtaatttgttggaagtcatgtatactttgagtaggaactattgaagctattatacagtttttcaaaccagcagattctcgtttaatgattggtatattttggactgtttgattcaaaattttaaatgtaaataaaaaggaaataatgagtatagcctacttttttcctgacttaaaagtaaaaatggaaattttaagaagagtattacctttgaaataaagtgattcaaaaattgaagtaaatgtcttatgcacagtgttactttagttaaaattatttaagcatacattaatttggattatagtagaaaaataatctctagtgttcataatctgttcatccattataaaaatattttaagtacttctgtttgtttattgtgttatatgtgtttactgaacatgggagtaatagcagtgaagagagacggtgcctatactttaggggcttatgtagtgttacagggaagactagtagtgaataggcacttataagtattaagtattttgaatttgaccaaaaattgaatagggtatactttgtgataagtataatgaaaaaaatatcagacttttgtgggagcacagaggaagtacactaggaataggaagatgttttgggatggccttcctgagcagatgaacctgggctgatcttagaagatgagcaagagttagcaggagagaggggtggtaaagggcatttcagaaagagcagaaagcctgaaaggaggcagagaggtgtgaaatagcctaaagtatgtggaaaattaaacacattcaggttttgctctatggaacatggggtggggtttgccattttgttatttcacaagtatgcaagaattgattttggtaaatgcacacacgtcttccatcaactttcaggggtagctctaaaattaatcacatactgctataaaatataatct

SEQ ID NO: 34990 - DNA, 1050 bp, Homo sapiens
gcctgtccccactcggggggcttgctggccgccctggaggtgccttcccgggagcggcggtgtagaccttgtggagagtgcctcctgatgtggaaccaggaaccgcagcctctttctagacgctcagccgcccggtggagttgttaccgccacgatgacagctctttacgccttccactccgtgctgggttcagttggcttgctgttttcttcagagagagcgatttggctacatagcttgaattttctacgtgtctcgtgctttactggacttgcactgtttttccctcttggcagtgtttaatcgggtgacttttcatagaaaacgttcagtattttcatctgtgttaatggcataactttcttcttgactctgccctaagctaatgttaccagtttagagggatactttgggaaaaggtccttagaacctgggttgacataagtattttatctgctggttgcacgttttttcctttgcattgtttttctcctatacaagatggtaattgttggactcttggtgttctttattctctctctagaaggaaatcctcttcgcgcatctttctcgtgttctggccctgcggtactcttgggtacgcagaggactgctgctaacagtgctggcgcctggaacgctgcttggagatggcggtggcattaagctgctgcttttcctcagacttcctcctggcacccttcttaatttgtcaaactgacccagttcaaacttcaaacttttagtcactttatttatttcgtcactttttaaaaaaattgctttcaagataccaaaattgcgtaagcctaaatataaaaagaggtgtctcaggggccgggtgcagtggctcacgcctgtaatcccagcactttgggagattgaggcggggggatcacttgaggtcaggattttcgagaccagtctggccaacatggtgaaaccccatctctactaaaaataacaaaaattagctgagcgtggtggcacatgcctgtagtctcagctactcgagaggctaagacaggagaatggcttgaacccgggag

SEQ ID NO: 34991 - DNA, 1075 bp, Homo sapiens
ccctatgccgggacagccaaaagaaaaaaaaagagagcattgatgagatgttcttaccgtgctgctactgcttcagctcattactttgattttggtgttcatgagtcatgagtctagaacacccatttttaataaatattgaaactgtattggtttatacatagtattatttacacaattgagtaattactaggggtcattatactttgaaaagtatagcttttgctctttatgttggcattcacaatcttgatcatttttcttttgatgtgtcggcctgcaacactgggggaaagagagagctgcagaaatacccattttgtgaattatacaaaattataaacatgcgtctcgctagcctttatttaagcaatgaatttaaattaatcattctactcaaaaatgccttataggtactaagtctctgcattaagcaccattaacaaatgcattactctatgtatcttgtatagcgggtgctttgattccttcttgatatatatttaagtcccagtaatttggtggtatactgtagtttacatcctgcttgtcagatacaaattcttccatgctgtaactgtagatttacctttctattcttgagacaattctgatattgctaccaaacaaatttacagtgcattttttgtaactcagtaaaggtagtgatttactgtgtttaagaccaattatttcagtgaatgtgtatatgcgtgagtgtttttgtgagtgtgttaaatgtaggtctgtgtcaccatttatgtgtcttggtacagatacttttttatatagttttttcaaccttagaaaccacaaaattaagaaagaagtgttaccctgtgatgaaaaaataggctcaactacaaaataccatcaactggaacaaactgagttttggaataattgatttggcatctcctggaatattatataatttgctagttaaattttcaccaaaataaaaaacccttcccttattttgcagctctttctctgctctcccctgtgttgcaggtttgtaatgtttgagcacaattcctgggtgaaattcgtatttgcctctgtgcgtgttatt

SEQ ID NO: 34992 - DNA, 1056 bp, Homo sapiens
tgggaaggaactctcgacctctcagggttgtggtagtgaggatcaattcttcaaggacaaggacttggactttcattgttgtgcccttaaaagcttatcacagtgcctgatactttgtggattctcaataggtattccttagccagtaggtcttcagcatttgacaggaaaatcctgaggcccgttgtgtggaatgactgctagctagagtaacagtgaggagaaaaacctattgtaaaatgattgtttaaggctctttttttcctccccacaaagggatttgcttcctaaggagaagaacttggaaactctgttgaccttggcttttctagaaatagataaagccttttcgagtcatgcccgcctgtctgctgatggtatgtaaaactatcacattccttggatcctagggagtacatggggtgggggaggagtaaaaaggaaacactttaagtcctttgggggaggggattttaatggacaattgtttgtaaggatttatgtagaaatgagtttatatgaagaatcacattaaatgctgttgggaactccaattaatgttaatacctcacttttaaatgaaatatattggagaatttttcagaaagagaagccccgaaacagttctgatgttgtactttagtttttaaaagattttaaaaatgtttaatctgtttgcttattttatggacaaaatgtccatactatgagttttgttttgggtttttggttttttttttagatggatctggtgaccaagtgctgaaatacactacagggtaatcacatctagcgaggacagtcattgtccaacaagaaaaaaattgcaaataggtcctaaatagaaaaagacaatggttaatatgcactaatttgtataactagaaggaaaatatttttctgtcacttcttaaaaagctcaatcttgcagcttttctctggtaactagtgatattttcagcataaggtcatgctagctgaatttaaaattttgtgtactgtatgtccttaaattttgaaagtgaaatgtttctggttttgactaaatttatcaaa

SEQ ID NO: 34993 - DNA, 1056 bp, Homo sapiens
gaaacagaactattttaagtattctattagcctgttattttttcctgaagagactttgttgctattgttaatatttatccctaccttttctttaaagcaatagagttaatgaagggaagtatatttatttatacctgtattctgtgttcttgctactagaagtgtaacttggggaccagcagcttctgtatcaccagggtgttggttagaaatgcagagtgactccaccccatagccactgggtcagaacatgcattttaacaagtgattgcaggttcaagtttaagagatacatgttctgtgtatgtgcacactgttaaatttttatagaatttaaatgctgtgaatgcggtaggaaaatcgattcatttttgatccactgttcttagaagcaggctactggatgcctacccaatatataacataaatatatgtattttctgtcaaatcctttatgagcttcatttttggtaatatttgatgacatatcagttatattcaaaatttctgatggtctctctctctctgtctctctccctctcctcctctgcccctctctccctctgtcccctgtgacttgcatcatttttcttgaagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcag

SEQ ID NO: 34994 - DNA, 1061 bp, Homo sapiens
atggttgcagatgtgtgttatttctgaggcctctattctgttccattgtctataagtctgttttggtactagtaccatgctgttttggttactgtagccttgtaggatagtttgaaatcaggtaacatgatgcttccagctttgttctttctgcttaggattgccttgactatgtgggctctcttttggttccatatgaattttaaagcagttttttctaaatctgtgaagaattttaattatagtttgatgggaatagcactgaatctataaattactttgggcagtatgaccattttcatgatactgattcttcctatccatgaggatggaatgttcttccatttgtttgtgtcctctcttatttccttgaaaagtggtttgtagttctccttgaagaggtcctttatgtcccttgttagctgtattcctaggtattttattctctttgtaacaactgtgaatgggagttcattcattatttggctctctgcttttccattgctgttgtataggaacgcttgtgatttttgcacattgattttataccctgagactttgcctaagttgcttatcggctcaaggcatttttgggctgagatgatggcgttttctaaatatagtatcatgtcgtctgcaaacagagacaattcgacttcctctcttcttatttgagtaccctttatttctttctcttgattgattgccctgaccagaacttccaatactatgttaaataggagtggtgaaagatggcatccttgtcttgtgccagttttcaaagggaatgcttccagcttttgcctattcagtacgatactggctgtgggtttgtcataaataactcctattattttgagatatgttccatcaatacctagtttattgagagtctttaacatgaagggatgttgaattttatcaaaggctttttctgcatctattgagataatcatatggttttatcattggttctgtttatgtgatagattatgtttattgatttgcatatggtgaaccagccttgcatcccaggatgaagctgacttgatcgtggtaaa

SEQ ID NO: 34995 - DNA, 1051 bp, Homo sapiens
ggtgtctacccaagagaaataaaagtccatgctcatagagaaacctgtagatgaatgatcacagcattattcacaattatgaaaaactgcaaacaccacaaatgggaatactacccaataataaaaagtaaaataaaaaataataaaaaataaatttactaatatatacaacaacataaatcaatctcaaatgtactctgctagtaaaaaaaaaaagccaggctcaaatggctacattcatatgattcaatttacctgacattctggaaaaaacagaggtactgagacagagaacagcacagtgctcaccagggctggatgctggggaagggccacaacggacttttaggggactatttactgttctatatcttgattactacagtgcttacattactgtatttgcttgtgaaagcacgcccaaaaggacaaattttactgttatgtaaatgatacctcaataagccagactttttaaaaaacagtctggtttaacactaagttttaagatctgttgagacaggaaaataaaaatcttgaaagatgaacatgccctaaatattttaagcaagttaagttagtcaaatgaatttaaccaaaatgtgggattttttttttaaagtctgtcacaacatccatactataggggtcaaaaggcctgttttctgcccctgcatctgccaattaagtgatacatgcagtaagatgatttcactgtatttgcttctaagtttactatctgtaaaatgagaaacatcattcctaatctcaaggcagctgtagccatcaaaagagatgatatatgggagtgagaaagaaggcagagaagatggtgagccagtaagaagatggtgagcagggtaaagaagacggttgggggaaggtggtgaagaccgtgggggaaggtggggaagaagacagatcgtggggaagaagatggtgggcagggtggggaagaagagggtggggctgcgtgggtgggtggggaggaagagggtggggctgggtgggtgggtggggaagaagaaggcggggctgggggtgggtggga

SEQ ID NO: 34996 - DNA, 1062 bp, Homo sapiens
aaattaagtacatctcccaagccaatgaggccatcatgaataaatacattagccatttactattctgaaactagtaaggccaccagagaactgagagacttgcagaaacacacatttcagtcgtgtggagggagcacctcaccctttgcactgcctgttccttcctatccctggccaagtgtgccctcctcgctcaggcctcgaatagcctggagagttgggcagcaggagttccatgcctcacctgacagctggggacacaaagctgccatggtgggtaggcatgcagtgtccttcatgtgctgctacacattctctaagtgacagaaagtaaccattagaaatatgctaagcctgaaattaaaaaataaaaaaaggctggaataaggtcctagtgctaaaacaaggattcaaactcaaatctgtctgacttcggagtacaaagatgcaatactgctaacacagatgcaagttaatgctgtcctgccaaaactgaagctcaccctgaataattttggtaactctgggctcaagtaataaaatttgggcagaaatgacaagctatatttagtgattctcactttctttaatcttctgatgttgcctcttttgagggaccagaaagttacacaagcccaagtacaccaggttccacagcctagtacaaagcctgatgtcctctgaaccccccaacaatgtcttcacttctaatcctatcataatttgcagaactgtgaagtacctgaatggaaatttcagaatggagacccacacagggtgggggtgggctgaggagaggcatgccctcccaatggccttactacctcttccagccatggattctgaatcctgtaagacaaaagtacatcagagtcatccctgactgggtcagctcaccaaggctatatatacacagaatttcacattcagtaaaagtcaaaattcccaaatgcagtcttagaatcctggcaggcacacagacaaatggggcttggcaggtctgggattgttgacagcttggtcctcactcttcccctccagccacaaggcttagacagcaag

SEQ ID NO: 34997 - DNA, 1050 bp, Homo sapiens
ataaaatacaagtgactacctggggtgtatctggataaaacggtgattttttaaaaaatttctttttttatatgcttcagcccatgttatttgagggaacttttgagtcttgtttaaacaaccagaagttctctctctaaagggcatcgtgtggttctgtacatcacagcccatcacttaacacacgctgagcacagatgtcatctctttctttcaaagaaaaatatgacaaagtgccatgggatttcacaagggctaagaattcccaagtagcaggaacccccagaagctggatctgttgccagcatgtttggctttcaggaaatggaaaacatgcatttccgcgccccctcaatgctctcagcagtttctgcatttacttgcctcccctttctgcacagctcctgttgagttacacattcatcacatttatgacaactcaaatttaacttaatttccttgcaatgcttcctctctcttagacctgaactcctggaacacctccaggaaatgagagaagaaaagaaaaggattcgaaagaaacttcgggattttgaagacaactttttcagacagaatggaaggtagtgcctgtcttcccccaccctcccttcccccccgccgcaccacacacacccatccctcttgtttttctgtcagatctgtggaatgccttcaaaggggggactcttctgcatcctccctgtaacctggtccttgggtttgtgcccagggacacttagaggttgactgtgagatgatgggatttgtgtggacctcccagaagaaatgctctttgggtaatgcccaagactaatgcagattcagctgacatttatgaaatgaacctgtcccatcaaattcttatctacaatgagcagcaggaagctgcgtttcccgctggtggtggcaccaacgcttttttcttaagaagctagaggttagccaagcggccgtagtggcacacctgtagctctagctacttgggaggctaaggcaggaggattgcttgaacccaggagtttgaggctgcagggagctgtggtctgc

SEQ ID NO: 34998 - DNA, 1049 bp, Homo sapiens
cacaccctgtgacaatttgttatccaagttcctcttactcttccttatgtgatacgggttccagacctttcagtggtctcctagctctgctgtgtgcacacacaccagtttatcaatgttgctgttaaaactgatacccggaactggacattaacctgcatatggtttaaccaggacagtggaccaaagactagtccttacattgatctggatgactgagaccctttcatgcctccagtttcttgcctatgcaactgacaaggtattgggaattcattttggcctttctgaggatagggtgtctcagcctcagcactgctgacctttggggctgggtaactgttgtgcagcactgccctgtgctttgtgggatgcttaccagagtccctggcctccacctactagaggccagtagtgtggcaccaccaccccttcaccagtcgtgacagccaaaaatgtttccagacattgcccgatgtccccaagggaacagatcaccctgattgagaaccactgctcatggccctggcatatggccctgactcatgctttgctgtatacttgtgcattgccactgatgtatccagcttctctttttcctaattatagggccttgaatttttccaatttgttacgtctcatacttctatttcagctgtaggaaatacactaaatctagcttttttactccaacatatcagatatccctacccgctttgtattatctgtacattttgaaatatgccttttctttgtccaagtgactcagatactgagtaaggcagggtcaggcagaggggctgctgtagactgcccttcaggttcatgtcacccttcagtcattactcagcagaaatttgggaagccagctttcctttcgtagggtctgcttacctggttgtttattgaaatccaaatactacatctatcaaaaaaggaaaaatggttcattttcatgactcatttttaaggaaccagtctcatcagttgatcactgatttttcccaattgcttatatattatctatgtattaattccttctagaatct

SEQ ID NO: 34999 - DNA, 1036 bp, Homo sapiens
tttacgtgctgtagttaggaatgattatttcagtatatggggccctcttgtctactgagggaaaccaattgagaatttctccattttcttgtctgaggtaaggtaccacaagctataaagtcttcttttatgtattccttttcttgccttttgcagatcttgatacatcatatgcctaattttatggtattaggcaatgactgtgctcactgtattaagtagaacttgttttatgaaaatgctgtaaacacggtacttgaaatttgggccagtatactatattgtgtctttaaaaattagagctattttcttacaataagccttgatgttaatgaaagacaaattttgtctggctggtaatgtcacccaagaatgaaaccacagtaattggagaaatttgggtaattgtgtgtatgaaaattagcatgtttctcttagcagcatgcaatagaaccgttactagataaaaatgtgttcttgaacacatccaaaatgtagacacttaataagggtttcaccaaatgaattgaagataacctaatgatgctcttttttataaaagacatttttcccattcttatcctttagcttaattttttttcacaagtatattttggctgtggtttatctcctggcccacatcatggtcaaaatttcagataattttgcaatgactactttgcttttgtaaacagtgctgtcttttggttcactttgttcctgttggccaggcctattagaaagtatttggactgtactaattcttggcaattccagtttagaatttggtgtgtgtgcaggtaagattgtatctaagtggtttctccaaaactcacccctggttttaaatgcttttgggaacgaaccagctgtatatgaactacagccagctcagttctgaaggcctagattttccaacccaaagaaacctagagatcatctaatcagttctcctagccaacataagaatcccctctaaaacttctctggcagaatagagacattgtccctacagagagattccatcctcaagctt

SEQ ID NO: 35000 - DNA, 1030 bp, Homo sapiens
aatatttttacattctttatgctttctaagcctactgcttaagagagcttagaagcatacctttgataacaaacaagacattcataattttaaaaaaaaagactagttccatgtttcttatcctgcttcaaaaaaaaggaaaagagaagagagaaagaaggagaggagacaaggcttttcaatcaagactgagaattaatattagttatcacaagatattaagtgcaggcttttatttgccctgaaaaagtgaatttctgaaaagtatttatagaatggatgactgttattttgacttcactgttttcatggaagctttaggactttgttttaatattataaccagaaaaattaacaagctctatttacttcaaattcgcttccaaatcaatccaatagccaaagcctaatgaagctttggagttcacatggattttgaaaatttatttccactttcctttattgtcaggccaaacaaaaaatgtttatggttctctgtagttcttcggttaatattgtagtttcttcctgtgcaaactgcattatacagcatactttctgatattgtcattcctggctctgataaactattaggccacttaactatatcctgtgcagggcaatggaaggaataaaacaaaaattcaccaactatttgaagccagagaaagagcagtatcaaataaagtctggggatagaaaaaggtaggtccagctggacagggacaagtcttggcaaagattagactgatagcttcataattaatggctccttgacctgaatgtgaaatgttacctgagggcccgggagagatgagctctcttcatatttgccccctggcatcctacgtttcttttataacacacgtgatacttggcacttgtatgttcagtatctctctcctgcaccaaatcccttatcttgcttactactaaattccagtgccaaggacatatatgtgttcaatgaacgcttgccaaatgtatgaatgaatgaatgaatgaatgaatgaatgaacgaatgggaaag

SEQ ID NO: 35001 - DNA, 1080 bp, Homo sapiens
aatacatgctgtggagagaaataaggcagggtaaagaggatggaaagtggtaagaggtaaaggatcgatatcgtagaggacattcaagtcaggcctcactgaaaatgatgcttgcacagaggcctgaaggaggtgagggaatgagccatcaggatatctggagacagaaaatccaggcagagggagcagcatgctgagcctttgaggacaggcaagaggtggccatggttagaacagagttgagaggagcattgtaggagatgaggtcaaagatgtagcagaggtcctgatcacctaaagcttcatagccatttttaggactttagcagttaccttaagtaggataaggagccacagaggattgagaggggaaggaagccattttgtgatataccttatgaaaggatcactctggcagctgtgttaagtatagtgcatggggtgatgagaaatggataaggactaaagtaaaataattgacagaatctagtaaagaattcaagtaggcagttagatatattaatctggaggtcaagggagagatgaaataaataattttggaagtctttggtgcacagttggtttttaaagccttgagagtggataagctgacaccaaaggactgagtacaaagggtaaaaagaaagggtccaaggactaagccctgagacctaccagcatttagggggtaagcagatgagaagggagcaccacaagggactaagaaggagctgctgccgatctccagtgcaacatggaggcaagagcctcattagatttaggtccagagaaaattagaataaagaaattgcaatagggagtgagtgataacttcacatatatctagctaacccacagctaccttgatgggagctctattggtgggaagaggcaggaagagcctgattaagtgggttcaagaaaacctaagaggaaatgagttggatactaccagtatggaaggtctttgaacaggttttgccctacaagggggaagaaaaacgaggtagcagttggagagaatacaagatgaagacagtttttagaaggcagtgatgttacagaatatttgtgtaagac

SEQ ID NO: 35002 - DNA, 1028 bp, Homo sapiens
gctccccccaccccacaacagtctccggactgtgatgttccccttcctgtgtccatgtgttctcattgttcaatacacatttctacactactaaaatggaagatacaattcctttttagatttttctccatacactgtatgaatttataaattttaaatatatatatatttaaacatctactgtgaataataggaaatttctgtataaacttgcactgttctccctttttgaatacaaattacttttggtaaaatacaaaagctgtccattggtagaaacagcccttgccaatttgcctctaggaattatttctctttcaatgtgatttatttggcaccaagcagtcccaggagtggcactctgctcagattttgatcagagatgcatactggaatttctgggcactctttggatttcctaggtatgatatgatgtagttagagtatcattcaatgaccatttgatcttttaaaataaaattaagcttttttctcaattcaaggggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtggtaagtgaatacgtctataaagttttacttgttaggaaatattacatctcttttctttgctttgtaaaaaaattaaaagtaatttcagtctttcagttttgagtgctggaagagaccttagagctactaagtgtatatatatttgtatttctttttaataaatacaaaaattaaggccgagaaatattatattctacaaaggaacaagagacaccacacattctgatttccattgtttttttctcttttttttcaagcatttttaaattttgtttttgaaataaaattgcccataaagcattttttcttctttttccccattctatttgttcttgtct

SEQ ID NO: 35003 - DNA, 1052 bp, Homo sapiens
tcaatgagccgccataaaggtcttctccagtatctccaggagagtcatgaacatgtcataaattataagaagatcaagaatcattaatatagcctacagtcaagagttcgtcatagtatatgcttctatacaattgattcatttaagatttttcacaagtctttactcaaaaaataaggaaaaattaagctaggctgtaatattctattcaaaactataagctttatgaagtggttaaaaagtgtttagaaacatagaaatctatttatattattatctattattttgcctctagtaacttagagatgcaacaaattaaaaaatattcttgaagaagccaatgatgactatgtttcaagatgagtagaagggtcagtaaagtcatactaaagtcgtcatggcccatttttgaaatagcagtaccgaagatagacaaagactacaaataacttcattcataggtacaaatgatttgttatttgtctaaattcataaggaaatataatcagacctatattactatttgctacaattttgtagcaaattaatcttcattatgtaataataaaatcttcattatgtaaaaatattcagctaaattcatttagtaaaaaaatctactatctgccaagtttacagaaatgtgaaattttggtaatgggtatatggaagtctgttatgatagtgtctctacttctgtatatgtttgaaaaaaatcataagaaatattttttaaaagcaaagcatcatttaagtgaaaatgattttcaatcttctaaaaacacagtgaactggaaaattgatccaaatgtttctttgttatataaagactatattaaaatcctactgcaaagtaaaagaaaagcaggctatatttggggaataataaatagttcagcattgccaggacattaagtaagtatgtaggggtgaggagaaaatcctgaaaaaaatatggaaataaatctagataatgaaagtgagaggtccagagatctaagttcagtgaaatccaagttatgtcaaatgtgattgaaatctgacagaatatt

SEQ ID NO: 35004 - DNA, 1062 bp, Homo sapiens
gatttattcaaaaaagttgaatttacctttcttttttttttttagaaaaagaacttggattctcttattcctagtacagatagcaactattaatattttgtatttggaggaatgttttgtcatagacactgagtagtttatacactagggataaacatacatctgtcaatggaaaatgttaagagcaatgttacattcagccttctttaatttttctaaataaacgtagttcaagattgaatttctaataaatattttaaagttttcagattataataaacattttcaggtcacacaatatcttagctgatagagatacactgaaggaaattatgacaagtccatttttacacataaaaatggcagatgaactttgttttgaccaagtacacatgagtacactttaaaaattgtaaatgaatcttttgatctatgtccttttcttgcaaagagatttgtctgtatttctaaatttaaaatccctttcaaattttaaaccatcattttaagataagctctgaaataaatttgacttctgatatcaagtatagacttagaatattgttgctaaacaaataacggactccagaaccaaagtatagtacattataacccttgtgcaaattatcccaaagccagatatggaaattgattttagtttttgcatgagaaaagacatgttaatgggaaatagtggggccaggggtggtaaaaataagataggagaagcctcggaagttgctctttaaaattaaggtgcctaagtaacaaagtgaaaataatgaggtgggggggtggtttaagacatatgttttataatacctttaaagaccaagctcaggaaaacatggtatcttctcatcaaatctaagaataaaactcagggaagctgggtgcggtggcacacacctgtaatcccagtgctttggtaggcagaggcaggaggatcgctggaaaccaggagttggagaccagcctgagcaacatagtgagactctgtctctacaaaattttttttaaaaattatctgtgcatggtggcatatgcctgtagtcctaccta

SEQ ID NO: 35005 - DNA, 1087 bp, Homo sapiens
ttctgtaggttgtctgttcactctgatgatagtttcttttgctgtgcagaagctctttagtttaattagatcccatttgtcaatttttgcttttgttgcaattgcttttggtgttttcatcatgaaatcttcgcccatgcctatgtcctgaatggtattgccaagattttcttctagggattttatagttttgggttttacatttaaatatttaatccatcttgagttaattttagtataaggtataaggaaggggtccagtttcagttttctgcatatggctagccagttctcccagcaccatttattaaatagggagtcctttccccattgcttgcttttgtcaggtttattgaagatcagacggttttaggtgtgcaatgttatttctgagttctctattctgttccattggtctatttgtctgtttttgtaccagtaccatgctgttttggtcactgcagccttgtagtataaactcaggtagtgtgatacttccagctttgttctttttgcttgagatcgtcttggctatttggggtcttctttggttccatatgaatttaaaaaaaaattctaattctgtgaagaatgtcagtgttagtttaatgagaatagtattgaatctataaattattttgggcagtgtggccattttcacgatactgattcttcctatccatgaacatgagatgtttttccatttgtttgtgtcctttctgatttctttgagcagtggtttgtacttctccttgaagaggtccttcatttctcttgttagctatattcctggacttattcttgataacccaaataattattacttccccttatttttattttaaatatattttcacttatttatttacagggtcaattcaaataaaaacacttcacttggtgttaaagcaaattatttaccagccagtatattgacattaagagatttttatgcttgcgcttggtatttcatgtctcaggaatatgacgagtttattttatgttttatagacatagaatcagccagtcagttaccatatcacactaaataattttgacatgtctctaaggaagccctgctaaagcc

SEQ ID NO: 35006 - DNA, 1030 bp, Homo sapiens
tacatatttttcctttgtctattgactgtctattccatgagattgtaagctccgtaaaggcaggaacttcaattttatttgctcctctatacactctattgccttaaagagtacttgttgaatgaataaatagatgtgtgctttatttttaaaaataaggtttggcttttatttttataaatctggaatagctaacaggctattttataaataattgctgttagatctataacccataccaggtggattacatatttaaacataaaaataaaatagcaaaagtattggaagacaatatgggtatatatgttataatggagctggaaaggagtttctaagtgtagagttaaaaaaagaggtttcacagtataacatttttagaattctgaatgtcaaaaataaaacaaaagcccaggaacaaaataaataacatgatgataagagtatttgcattatatagagagaacatttaatattctttatatagagagaacacaagtaaaacaatgaaaaaaacacaaagaagggaaaaatgaaaaaatgctgtgaacaggaaattcacaatagtagaagtaagtgtaatctcactaataatcagagaaatttaatctgcaactataaggagctgcatcttccaatgtttatgagcatagaaggaaataaacactagctgcaggtaaaagtgcaagtactgcagtgaaatttgtcattatttatcaaacagctaaaaatgtgtattttctttttctttttcttttttttttttgagacggagtcttgctctgtcgcccaggctggagtgcagcggcacaatctcggctcactgcaagctccgcctcccgggttcacgccattctcctgcctcagcctcccgagtagctgggactacaggcgcccgccaccacgcccggctaatttttgtgtagtttttaatagaggcgggatttcaccgtggtctccatctcctgacctcgtgatccgcccgcctcggcatcccaaagtgctgggattacaggcatgagccaccgtg

SEQ ID NO: 35007 - DNA, 1061 bp, Homo sapiens
atggaattggtgttttggccctcttgtcaaaaatctgaacctaatttttcaaaaaactaatttaggattctcactcttctccctcccaccttcattttctgagaacattaactttcaattcaatagagatatgagcatgatttagatctacaaaatataatagcacagtccagaggtttctattttttttcaagcagcaatcaggaaagactgctcttatcctcctacctcccaaatctgccaacatattcacatctgcatccttatactctgccttctctcccattacagtggatgagctgaacccgcacctctctagagtcacgtacatgtattcttgtatgtgtactctgagtctcatcccctctcgctcaagggctatgttggaggctacctccatcctttatatcatcactttccccattttttctagatgagtcccatcagcaaagaaatatgcaataaataactctcaacatttttgtaatccctctctagaaaccatattcctcttctccgttggagcaaatctctgataaaggattgtatgtacttgctgtctttatatcctttcctctcattcttcaatccacacaccacttaatgtgttcttgttaagaacaacagcctctatcatggcaaatccaaaggtcagtctactgttctcatcttactctatctctcagcactatttgacccaactgatcactcctttttgaagcactttcttcactttgcttaatgtaacattacagtctcctggttttcctctggccttcctggatatcttttcttagtctcttttgtataagctttcttcttttcgagacttctcaaatttagagaacccaaatctcagtcctctgacgtcctctcaacctatactcattcctgggtgctttcattcagttctgtgattttaaacgctatctttactcataagcctccaaaaattatacttctagctctagcctcttcattatattccaggtagttatatccagttggcaagaccagctacttaatttgttctccccatcctccaccccccaggacaacgt

SEQ ID NO: 35008 - DNA, 1027 bp, Homo sapiens
atgggttttgagtagctgattttttgtttagtatggttgtatccatgtttctaagtgtgttttgttctacatgcttttagtataaatgttgtacagcctaataaagtgaattggagagagtccctcttctttttttcttactctttttcctttttcttgaggcaggttctctctgtctcacccaggctggagggcagtggcatgatcacagctcactgcagcctcaatctcccatgttcgtgcctcccaattcagcctcctgagtagctggaactataggcatgtgccaccacacctggttaatttttgttttttttgtagagacgtggttttgccatgttgtccaggctggtctcaaaactcctaagctcaagcgatccacctgcctcagcctctcaatgtgctgagattacaggcatgagctgccgtgcctggcccaagtcccttttttctaatctctgaaacaatttaagattgggactatcaattgctttaatatttggtagaacgtactgataaaactttctgggtctggtagtgtttattggcttatttgtttttgatgtttttgttttttatttgtttttggtaaatggcttttaataatcaatttcttttatggatataggtctattcacgtttctgttctgaatttgttttgataagtgttctaggaaattgtctattttaagcaattaaatttatcagcatattttaatgttaactcttatttttaaaatattctagctgtagttacaaacttcttttcatttgtagtattctcttttgagaccttctcttttttgctcctgattgggcatgctagaaatttgtctattttaattatactttcagagaaccagcttttatttttgttgattctctactgtatgtttgtttcctatttcattgatctctgattgttatttcctttcttttctgcatctattgtccatatagagatctttgtttttttctgtcagcttttcctccatagacatatattttaaatatggtacttatgtgt

SEQ ID NO: 35009 - DNA, 1024 bp, Homo sapiens
aaaaaccaactctgggtaaaatttgacaaaagaaaaggaaaggaaaggaatttctacaaaccagacttcccagaggacacttaccaagacagctgtaaggttctgggcagcaggcagtgtgagagctgaacagtgtcttcaacagactgccactgggagagtcggctttagctattctcagtttttgagtcttctcatttctggtcaaaattatagtgaatgggtatctgattgatatttggaagctcttggaagacatgtccagctgttcatcagagatacacctttattgaaacactgtatccaataggagaagagtggtttcttaaaaatacatcttcctccaaagaagggaaaatgagtgttggatgtggaaaaatattaattgtctacttcagcaccataaagagaaaaaagattgaaaagtcctttaagcatctgaggtcaaggatggaaaatgggataagcacataagtaattagggcaagcaacaagtgaccgcaattataatgttcatgtagggtagatatgacaagaagggtgggttgaaaggtattggatggcaggaataagaatttaaatttgatgatgggcagcagtaattaaaagtttccaggaaaggagtaacttgaattagagttggctatggtttggatgtggtttgtttgtctccacaaaatctcatgtggatacttggtcctcagcgttggaggtgggacctaatggggggtgtttgggtcatgggggtggattcctcgtgaatagattaatgccctcccttggaagtgagtgagttctccctgtattagtttctgcaagagctggttattaaaaagagcctggcacctcccccttgccatatgatctctacacaggttggctcccttttgccttccttcacgaggcactcaccatatgcagatgcccaaacttaactttccagaatgagccaaataaatcttttttctttataaattacccagcttcaggtattcctttatagcaacacaaaacagactaagag

SEQ ID NO: 35010 - DNA, 1028 bp, Homo sapiens
acttatgttttctataaaactgaatttctgatattttcttcagttgatctcctcaggatgaaagttatacttctgtgggctggaagtgcctagaaatgaacatccttccagggatggggggtaagccttacccatggctgaaaactgtgggggtgtaaatttccagctgctttactcctcgattggaattattctggggtgtgtattttacactgttgcccgagctctcccctaaatttaagcttcagaaccactgtgggagcttaagagtgacatttcttgttggctcccttcctccctctcttatcacccccattccaccgcagaaccacccgcataaactacttgctctcaatcctcgcagcaagttctgcttctggttaagttggtgcgggtccaactgagacatctcaaatactaccccctccacgaagccctccccatcctccaggtacagttaatcctcatctcctttcttgtcttgtggcactttctttctccttctgttagaacattctgccttggataagttggggttttttttcctctcacgttgcattgtaaatttttctagggtgagaacaatatctcatatttacttatacattggcatttctctttttttatttttatttattttttattttattattattatactttaagttttagggtacatgtgcacaatgtgcaggttagttacatatgtatacatgtgccatgctggtgtgctgcacccattaactcgacatttagcattaggagatatacctcccccctccccccaccccacaacagtccccagagtgtgatgttccccttcctgtgtccatgtgttctcattgttcaattcccacctatgagtgagaacacgcagtgtttggttttttgtccttgcgatagtttactgagaatgatgatttccaatttcatccatgtccctacaaaggatgtgaactcatcattttttatggctgcatagtattccgtggtgtatgtgtgccacattttcttaatccagtctatca

SEQ ID NO: 35011 - DNA, 1005 bp, Homo sapiens
atgaaggatcagttttatttctaatactctgggaaaaggagggagggatgtagctcacaagggtctaatgtttatttattttgggaaaagcaatcacccagaattaatctatattatactgtttttctaactaattagaatttaataaatagtccagtttcaaaaatcacattagtggtcaaaaactacataacatgtcttcacctcattcctccaaaaattaaaaatagaactaccacatgatccacttctgggtaaatatatccaaaagagttgaaagaagggtctcaaagagagatttgcacacctgtgttcatagctgcattacaatagccaagagatggtaataatccaagtgtccatggatggatgaatgggtaaacaaatgtagtatatacaaccaagagagtattattcagcctcaaaaaggaaatcctgtcacatactacaacatggacgaaccttgccgacgttatgctcagtgaactaagctagtcacaaaaagacaaatactgtatgactccacttatatgaagtatctaaagtagtcagattcacagaaacggtagaatggtggttagcaggggctgggggagtggaaaaaggagatatgtttaatggatatggagtttaagtttgcaagatgaaaatgttctggagatctgtcatacaacgatgtggatataaataagactactgaactctacgcttaaaaattattaagatggcaaatttcatcttgtttttttttaacttaaaaaaactacatataagatagttttgcctgttttcaggtttcttttcagtgttttaggtattcagtatttaaatcacaaaatttgtgatttgaacatttttttcttccttcatgagattttaagtggattgatacttgctttccattctgtcccgatgtctgacctttgtaatgtaaagaagaacattttgtttaattgagagaagtctgctgtgttcttgttgatagaggaccatcctagagttggg

SEQ ID NO: 35012 - DNA, 1047 bp, Homo sapiens
tgatattagtatttaatttccttacaaatatttcatacccccttagttaaagtgtatctcctttgatagaagaagctggttgtattcctttatgtgaccccaaaatccctaacagcgttataggcatttctgttgaaaaatgaataatagtttgagaatgaatgtggaggcaaaattaatgccactctgtcctttaaaaaaaattcaggcaatgatttaagctcttctgtctattttgtttaaatacctattttgctggatatggagaacagggcaggaacatgaagtaaaaaaaaaggaagaaagtggggtgggagaaaaggggattaatggaatagaaacgtccaaaacacttttggaaattattgtctatgattcccttgttattaagaaagaacagtgtatatcctctggggcatatagggcagaaaaaaagattatgaacaattgccaagtactctaaactgaaaacaaaatcattgtagagtaagtaattactgtatcccctcctgattctcggtcatagcgaagaaagaatttgaaagcttttttcagagtcaattttaccttgctactgattatatatttttgtacttgctatgttggaaaacaatggttgtttggcctctacttttatccctaattgtttagaacataagtgttgcaaagttgaaactttagaaggtgtgttctgagcaaacaggaggaaaagtatttcttaatcagatgatgacctttgtttccaagtaggtgatgtggccaagagttgaatgcagttttaataactaggatattcaagtccctgaggcgggtgctttgtatcagagataatgcaaatagttctttttatcttctcttcttggccattgtacccagaggcttaccaatcttccacatttagtcaacaaacctttctaactacttgctagactctgcaaattatggcaggtcttctgtggaaagggataaacaggaaaagtcagtatgactgtggactgtaattgtggaaagtaaacacacacacactaccaccacagcctgtctcac

SEQ ID NO: 35013 - DNA, 1050 bp, Homo sapiens
gccaggcgtggtggcacgcacctgtagtcccagctactcaggaggctgaggcaggagagttgcttgaacctgggaggtagaggttgcagtgaggcgagatcgcaccactgcaatccagcctgagcaacagagcaagactctgtctcaaaaaaaaaaaaaaaaaaaagtgaaggagaagcagaaactttttcagacaaacaaaaattgagggaatttgttgacagtagacctgctttgcaagaaatgttaaaaattcttagggagaaggaaaatggtgtaagtcagaaacttggatctacataaagaaaggaagagcatcagaaggaatgagttagggtaaaaaaaaatatttttcttatctaatggataacagtttattcaaaataataatagtaacaatatatttaattatgtatatatatgtgtttatgtatgctcacgtataaatgacatgaatgacacaaatgatacaagcagcaaagaaataggattattgttattgaaggagatgtagaaaagttttgaactgtggcagcagtctggtcttctaaatttgatatgtgtaaattaaagttttctttatattctcattatgttagggtttcaactagtttccttttccttgcagtaatttgatattaaaaatagtagaagtgttccaggagcggtggctcatgcctgtaatctcagcaactcagaaggctggtgggaggattgcttgaggccaggattgcttgagaccagattgggcaacacagtgagactctgtctcttaaaagtaaagaataaaacaaagctgggtgtggtggtgtgttcttatagtcccagctacttgggaggctaaggcaggaggttctcttgagccaaggagttcaaggctgcaatgagccatgatcatgccactgcatgctagcctgggtgacagagtgagaccccaacttgaaaaatatttaaaattcatgtatttagcaaagaaagggtcccagagccatttttaaaaagtcccagtctttcagaacagttcattattttaataattctaaaaagtaa

SEQ ID NO: 35014 - DNA, 1030 bp, Homo sapiens
gccaccacacctggctaatttttgtatttttagtagagacggggtttcaccatgttggtcaggctggtcttgaactcctgacctcatgatctgctgcctcggcctccaaaaatgctgggattacaggggtgagccaccatgcctggccaattagttttttttcttggcaataataataataggcaatatttattgagttcttactaggttcctggtaatgttatagatgctttgtatctatttcttcattttatcctcaaaaccctatgaggcaagtactattattatctcttcacgtgaggaaacttgcagcacagaaagtttaacttgcataaggtcacatgactagtaagaggttagagtcaggattctgaatccagaaggcctggctcctcagctccaagctcttaatcaccacttaataactgtttcccttataaacagcattgcaggaactattcttgaacatacatttttcacacttacttaattatttttgttggatgtacttttagaattaaacttgctggttaaagggtatgcgtatcatcaaatttgtgctctagaaaggtcacaccagttcatgctgtgagcagcaatacgtgaatgtgtctcctttcccatactttctctagtactcatattattatttttaatatttgccaatataataaatgaaattgtttcttttgacatttttgcttatttaattactgtaaggttaacatgtttaaaagcatattttcccatgtagttcttttgtacattgcttttcactctcttccttgagttttcttaagctggtgctcgtcttttttatgactgatttgtaggagttccttttcttaatacaactattaatgtattgttgtgtattggaaatatttctctgagcttatgatttatttttgaaacttgaaaatatttctctgagcttatgatttatttttgaagctttttaattgtcgccataagaagtttaaagattttgttaattctttatatcaatttgtgttgcttgggtttgatg

SEQ ID NO: 35015 - DNA, 1053 bp, Homo sapiens
tggcaataaacatacctctgcattttgcagaatctaatcagaatgataagattcgtagtttcactaataacctctaagaatagagggtaatttattaatttttattagtcactttatcagtctgccctttgagaaatttacgtgaggcctctgagaaccatatcatggtcatgaggttgtaagagatttgtaagaaacataatccctccttttgcataggaaaatgaaattctgttgcctatataagcttctcatcactccaaagaagtgattccagtcttggggaatgaaatgcggaggtaaaacccagtctgattctgtacagctggcatttcataattatttttctcattcttctgtaaatacatatttagaaagaaatataattcatgttttgtttattcttatgtagtttatattttgtgcccatgcagccttataggtttctattaaaattttatttctccacaagccctgagaatttacgaagctatagtttctcacaaattaattaagattcccacctctccactacacaacagatttgtttattgattgattaattcaggaaacatttcttaaatatttacatacatgagacatggtgttagctgctctgtaataatgataacaataatagctaactttgtaagagtatgctgatcaaattgtatgttatgaggtcctgggcacttggatttaaattgtagctcagctatttggtacctgggtgaatgtggacaggctaatcaatctctctatttcagtctagtcatctccaaatggggaactactagattcctattgctaccataacagattaccatgaacttagtgacttaatgcattgcaaatttattatctcactgtactgtgggtgagaagtgtgtgggctcaactggttcctctactctaaatctcacaaggccaaaatcaaggtgacagtctaggctcctgtatgactgttctgggtgttctagggggaatctactcccagactcattcatagtgttggcagaattcacttccatgcagttgtaaggctgaagtctc

SEQ ID NO: 35016 - DNA, 1017 bp, Homo sapiens
acactttttaagtattattttactgtcatttcagtggagccttgggaagactagataaacacatataatcggtctgtctctttaaatggaaattctcccttgccttttttttttacccccacaacccatatttgattttaaatgagacagaattttataatagcagctgtgcaaacaacatgtgagagttaagtgcctgtgaattttatcaaatgcttatgagcatttgataatttagacagtaactgtttttcttaagaaaaccaccgtaataatagggccattttaatcagcacagtggctaattgtaaataaatctaatttaataagctaatttgtacctaagccttagggctttctctttcttcattatatgaggaactcactagataccttggagtcaagcctgtcttttatctacactatcttgatgccatctgtattgtgttgagattagctgagtggtttcgacttgcaaattttacagtaccacatgaataaacgttggccagatactagttatgaattgtcatttcttggatagtatgaactccataacaagcatatgatatatttccttccctagggtaatttctttttactgggaagcttcttttcttttgaaattactcaacttacacaaatatctgtttctgcgagaaacagaatcattatattaaactacaaaatttaacctttccattttcagtgtgtatcttttgggttttctataagcaatgccaaacatatacactattctttttttctaagtaaagacttaaacccaaagcaaaattaaaggtttgatgtctacgtatttgcccaaggtaccaatcaatcagcagcacaaagcctccactggaataaattggaaatctggtggcaggaaacccaggtttccacagatgacttcatacattttggcagtgttccaattggactgctctcatccagatccatgtgacaggaagaaccttatttgtatctataaccacccatgacctctgagattgtagg

SEQ ID NO: 35017 - DNA, 1095 bp, Homo sapiens
tgtgagccaccatgcccagcccacttacataattttctataaacttgatgcagtttttttttttttccaaattgctccaacaactccactgttaacttaaaaaaaaagtaatttatccattctttatttctgtggtgattcctctttggggccctttttattttctgctcccacttgtattggttgtagatgtcatcttgaattttccctcaccagtgttttttcctggacctgctatttcctggagtcttttttctacccattatgttaaacattccatgggttccatcagattggaaagtattttcttttgatcttggaaattttcttgtgttatccttcctatattatagtttctttaaatgacttatcactgtcttttaattctgttttctgtgaaatttcctcatttattttcctgccaaacctatttttttaattttagcttttctatttttaatatccaaaataatctcacttttgattcctcttgcaaaacaccatactcttttagaacattctcgtcttacttttctgaggatactaacaatggtttgttgttacgttgtacttaagttttcttcttttctctgtattatctgtttatgggttttctttttgtctttattcaaacataaagtgattcttagctgttttgatctgaggataacattttgtaaatgggatcaggggcttgtctcttggcatacttcactttggaaggattagatagaaaaatgagaaatttagctgtgtcatttggggatgcccaaatgtcagtatgtgaagatctttttctcttcagctactgagttcatcaagagcagggcttgggggaggtgggaagtagtatgcttacttcccatcagtaaggaaataatgactccttatttcttagcagacttttcactaatctcacattttcaaatgtgtttctcgtgctagtccttaactatctcagatattcaagaatcctttgatattacccggagactaagcctcagcactcctgtctgagcacatgcctgcctggatgcaggcggtgttgaaggacttgccgagcctgacaggcttgtaaacaatctgtttccagtc

SEQ ID NO: 35018 - DNA, 1050 bp, Homo sapiens
ggtcttcaacaaagctgacaaaaacaagcaatggggaagagactccttattcaataaatgatgctgggatagctggctagccatattcagaagactgaagctggaccccttctttacaccgtatacaaaattcagctcaagatggattacagacttaaatgtaaaacccaaaactataaaaacctggaagacaacctaggcaataccatctggatgtaggaaagggcaaaggtttcatgacaaagaccaaaaacaatcacaacaaaagcaaaaattgacaactgggatctaattaaacttaagagcttctgcacagcaaaagaaactatcaacagagtaaacagacaacctatagaataggagaaaatatttgcaaactatgcatctgacaaaggtttaatatccagcctctataaggaagctaaacaaatttaggaaagaaaaacaaccccattaaaaagtgggcaaaggacatgaacagacacttctcaaaagaagacatacatgcagccaataagcatatgaaaaaagctcaacatcactgatcattagagaaatacaaattggaaccacaatgagatattatctcaccagtcaggatggctattactaagaagtcaaaaattaacagatgctgatgaggttgtaaagaaaagggaatccttatacactgttgatgggagtgtaaatttgttcaaccattgtggaaagtagtgtggcaattcctcaaagacctaaagacagaactatcattcaacccagcaaatctcattactaggtatatacccagagcaatagaaatcattttaccataaagacacatgcatgtgaattttcatttgcagcactattcacaatagcaaagacatggaatcaacctaaatgccatcaatgacagattggataaagaaaatataatacatatacaccatggaatattatgcagccataaaaaagaacaagaacatgtctttcatgggaacatggatggagctagaggctattatccttagcaaactaacatcgaaacagaaaaccaaatgctgcttg

SEQ ID NO: 35019 - DNA, 1048 bp, Homo sapiens
gattgtttaaatggtacacctgtatagggcatttaccatgaatggagcttgcaggactagaagttgctctgggtgagtcagtgagtgagtggtgagtgaatatgaaggcctaggagattactgcaccactgtaggctttataaatcttgtacacttaagctaaactaaatttatttaaaaatttgttttgtcttcagtaatagaccttagcttactgtaacttttttactttataactttttaacttttaaaaacattttgattcttttaaaataacacttagcttaaaatacaaataccttgcatagctctacaaattgttttcatcatataattttaatatttttctatttttaaaattttcttttttctttttttactttgtaaaattgtgtttttttttttttaaactaaggcataagcacagatgtgagtctaggcctacagagtcagaatcatcaatattactaccttccacctccatatcttgttccaatggaaagtcttcaggaacagtaacacttgtggaactgccatctcctacaatagcaatgccttcttatggaatacttcccgtagtacctgcctgagtctgtgttacagttaacatacacatgtgtatatgtatgtatgtatatgtgtatgagtctgtgttataattaacatacacgtatatatgtatgtatatgtatatgtgtatctaagtctgttatagttaacatacacatatatatgtatatgtatatctgagtctgtgttgcagttaacatacacgtatatatgtatatgtgtatctgagtctgtgttacagttaactttatatatatataaacttcatacatataaatagaatgagtacactctaaaatgcactttatacatatatgtataaatagaatgggtacactctaaaataataaaatgtatagtatagtaagttttcacttaatgttgttgataatttcttggaaactgcaactttaagtaaaatgatgtatcaggaaataaattttatcacaggcagattaatacaaacaaaagttaagta

SEQ ID NO: 35020 - DNA, 1112 bp, Homo sapiens
tgtaattcaatcataggttgctattttggttatgctttattattgtttcacgtaaatgcaatttaacaatttggcatgaaggtaaactattattgtaaaggaatttttaagacagaaaggcctatatcaagccctttaagcagattttggatattttcatttaaaggtatatacattataacttataaagcatacagtctttaaactctttttctcgctgacaatgttaacggcttctttctcttagtttggcatgaagatactataggttatgccgttttaacctacagtgtagagtctcaagtcaccaccaggtgtcagaatgtgcttacttattgtcatactacttccctggccaaagtgtgctgttaggcaatttgtgacttctggcatattctgtttctaatggcatattctgtttttaatattcatactattttgaaagaaatatttcagttgtacagaaaagtatctttcagtgatgtagacattagcttatataattttttcttcatttctaaaccactattaagttgctgttttgtgataattagcacatagcttaaaatcaaatataataggagctctgaaatgtatgagagtaactctgcttcatgaagtcatccaaatatcccccttttctgaatatttttgttacagtcataactttctacaattttagagtaggaaaatttaaaggttatatggtctggtaagcctcatgtgggtactggctatattctagcctcataagaggctttaaaaaactgtatggattcttcttctcagaatgtgatatattcatgcccaggattataaactttccctagttgaacatcacgaattatcataagagttgtgggtgggagataatcctgagggaaaagagttgttcagataaatgggacagagacaggaaaatattattgaggagcattaaattcagtcacttctatttgtaccttatatgactgctagtttggtccagtggaatcaggaggcttgaggaccacaagacagttcttggagctgggtatttttttctgaaattgctggaagtatatttatttgggggaaggttcaaaaaaaccttgttggaaaagaaagactaa

SEQ ID NO: 35021 - DNA, 1040 bp, Homo sapiens
tgttaggatgatttgctttcttttttcttttcagacagtctcactctgtcacccaggctggagtgcagtgatatgaactcagctcactgcaacctccgcctcccaggttcaagtgattctcctgcctcagcctcccgagtggctgggattacaggcacccaccaccacacctggctaatttttgtatttttagtagagatggggtttcgccatgttggccaggctggcctcaaactcctgacctcaggtgatccacctgccttggcctcccaaagtgctgagattacaggcatgagccaccgtgcccagctgatttattttcctttgatgtatactacccagtaataggatctctgggttaaatggtagttctatttttagttctttgagaaatctctaaactgcttttcacaggggataaactaatttacattcttaccaacagcatataaatgtacccttttctctgcaaccctgacaacatctgttgttttttgactttttaattatagccattctgactggtgtgagtgagatctcattgtggttttgatttgtgtttctctaatggtgagtgatgttgagcatcttttcatgtttgttggctgcttatatgtcttaggaagtgtctgttcttgtcctctgctcatttttaatggggttatttattttattcttgttgactggtgtaagttccttatagattctagatattagtcctttcttggatgcatagtttgcaaatatttcctcccattctgtaggctgtctgtttactctgttgatagtttcttttgctgtgcagaagctctttagtttaattaggtcccaaattgttatattttggctttgttgcatttgcttttgaagactcagtcataaattttttgcctagcctgatgttcgcaaggatatttcctagggtttcttacaggatttttatagtttgaagtcttacacttaagtctttaattcattttgagttaatttttgtatatggtgaaaggtaggggtccagtttcattattctgcatatggtt

SEQ ID NO: 35022 - DNA, 1588 bp, Homo sapiens
tatttggaattgaggactttgggaggcgattaggtcatgaatgtgatgccctcatgaatgggactattacccctataaaagagaccccagagaattatttgacccctctgccatgtaaagaaacagcaaaaagatagccatttgtggaaccagaaagccagccctcattagacactgaatctgtaggtgtcttggatcttggacttcacagcctctagaactgtgagaaataaatttctttcatttataagcacatccagtttatggtattttttgttgtagcagtctgaacagattaagacagtctgttaagctacttccttgcatattacccatatgtagttgtatctgtcctcctcattgtttctcttgttctctatttagtagaatcaaattttcttaggtagtacaacagacaaatattgcataagttcaagtttcaagaccatgatggttatctttgtagttctttttttttggagatagaagtcttgctctgttgcccaggctggagagcagtagtattatctcagctcactctaacctccgcctcctgagttcgaacaattctcctgcttcagcctcctgtgtagctgggattacaggcacccaccaccacacccagctgatttttgtatttttagtagagacagggtttcaccatgttggccaggctagtcttgaactcctgacctcaggtgatccacccgccttggcctcccaaagtgctaggattacaggtgtgagccaccatacctggctttagttctagtttgatgtttggtatcagattcatcccacgcagactacagttaggttttctaaataccaagattaatttcttgatttttgtaaaaaaaaagctgttttttatttggagttttagaaagaacatgagttttgtccaggcacagtggctcacacctgtaatcccagcactttgggatgccaatgcaggtggatcacttaaggccaggagttcaagaccaatgtggccaacatgacaaaaccccatctctactacaaatacaaaaaaaattagctgggagtggtggcacacacctgtgatcccagcttctcaggaagctgatgcatgcggatctcttgaacccaggggcagggttgcagagatcataccactgcactccagcatgggtgacagagcttgtgagactctgcctcaaaaaaagaaaaaaaaagagaagaggaaagaaaggacatgagttttgtttggagacttccatacctggcaagtcctggttttcgtcactgactacactctgatcctagtcattagtaagcagtgtggtgctgtcttgatagattttaggtaatatctgaccatctgttcaacttccctgtactatttgtctttctcagtagcagactataaagtttagacagaaaagatcgtatcttatttgtatttcttgcctcttgctctgggctagacagtagtagttgttaaattaatgttgctcaaaacagaatcccattctctagatttagaagtttcacctaagtgtattttatttttagataagtcattggaagaccaaggacatgactgtaaaacattttatcttgg

SEQ ID NO: 35023 - DNA, 1018 bp, Homo sapiens
gaggagttgaaatgcatgtgtagattcttatactctggatattatgatttctggtgaatttaggtctcaaatctatgactggtcaatttgtgaattggttctcttggtaatatcagtgcctaacagtccaccccacctgatttgtccccagttcatgctggtgctgataatttcaagaatgccccaggcctcgtagcctttctctctaacttggggacctctgcttctgtagtcttaccgcctggtaccatcaactaccttccatgtatcccatagcgcaagcaggaacgtacagtcgcgttacagaaaggtcatataccaaattaaaatatgccattcatgggatttattgaatcaacttaaatcacagcaagaagaaagaggaaaaggatgaggttaggtttatcttctttgacagggcttaagtgggaagaaaggaccacactccctgaattctgtgttatttaacgttcaaatgtcctgttgctcttgccttctgtgccacatcagcctttcctgatcatggtaattatcagttcatggaaagatgtatggcaaacaccattctgatgaggtcacagatggaaatgaggaacatgttgttggaaactggaggaaacatgattttttgttataaagtggtgaagaatttgactgaattgtgtttgtgttctagtattttgtggaaggaagaacttgtgagcaatgaaattggatatttaactgaagcaatttctaagtaaagtgctgaaatggtggcttggtttctcctcactgcttgtaactgtttaactgcttatagtttactcagaagaatagatgaaaagtcagtgtggatatggtgacaacttttagtctcttttctgatggttaatttttcacggttatttgatgagattatagtttaagcagtttcctcccccttggtttctcctgactggcatatggttctttgtacatatgtgagaagggataaatgacctaaagatggagttgttaatcagaaaggaagcagaac

SEQ ID NO: 35024 - DNA, 1050 bp, Homo sapiens
gaggttggatttcagaaccaaattcataataggagcttgctgtcttaaagtagaaagcagaagaggaaaatagcatttgtttgtattctagcatattgaggtttcactgttcctagcttatactaatgtttttcctctcatttctgggaatgcctgtcattctgagaatccctatatatagcataccaagaacagagtatgatgttactttaaaatgtgtttacagaggatatatgcaagtgtgctgttaatataaattgtttgtccttttctgcatccactttgttactgttttgctgccaaaatgtgtgaaatgtgtgtcttctcttcctcctacatattgtgccaagtgtttaaaattttgtctactcctagtaacacataattaaccacatcccttgtctacttttatgaatcagtataaagaaaaacaatacattaggataaggtttgcatatatgtatatgtgtttttattgaaaactgggcacttgtagccttgtgtagacctctacctgcctgatttactaattatctgtaatgctgccatggagatgatgctgtttactctctcctgctttgttctaagtggtgtttgagaagtgaggcctgtgaatttccctttgtggtagaacagtgaactcagcagtatcttgcataagtgagccgactaccttattcccactctgtttttgtgtacatggtgaaatcagaagtcaaacatcccctttagtgtttgttattttacatatgtatctgagcattttgttttctgttagcaatgcttcctgatgttgtgcgtggccctttttggttgattctctccaaattcgggtcagctgctgccacctggcaaataacagaggatatgctgaatctcctgtccatccttgtaacgatatccttcttaatgaaattcttcaactggctgagcaattacaaatgtcatctgtccagacacatgggcttaaggatgtctacaaaattttagacatttttgcaaatgggaaaaaaaatagtcttgtaaatactgaaacagatttccatgaac

SEQ ID NO: 35025 - DNA, 1032 bp, Homo sapiens
catggcttgtgatttgggtggattatacttcctgggaccttggccctcccgtgtctccagaagagacgtgtgtcccgagacacatgagtatcctccaaggcactggcctggatgagcagcatcgccttgagaattggggtagtgtggaaaggaagaatgaacaacggccctgggaagccttcccttcctgcagatattgttgggggagtgctggtctccattttgcgtttagaaaaccagacttagatgctggaggggcaccggttgtcttctttgaactcattccccgtaatgagctagaaaagagtacctaaccataggtattctctctagagactcatgtgtcccgtgggtacagtcaattcacagtatctgttctggcttttttcactttaattctgttctgcacattctgaacatatgcaggaaaaaaaatcattcctgaacttagcacaagctacactcgacacaacctaaattagtaaaaagcctttgatttattttgaagcaatttaactgtagacaaagcttgcatatatggaacagtattctcagagcctgagagttgttacagttgttctatttggaaattagaaggaattttttaataaggcacatttttcagtttcttacccattggtgtctattaagaatactatgtaatgttgaaatttccatcaaattaccaagcaaattactattaatgattagagatttagcctaacactctctctttgggccttaaatacccatttgtagttgtgttcgtgtcacttctgtctcagatgcctctgccaggacataatctctctaactcttgctagctggcttctccctcccacatgggcatacatgctgtgtatacacagagtacagcctgtgtacacagtagcagctgtcaacagggcctactccagatgggtggccccaggtaatcctctgctgtaaagtggctagaacaggctgtccctgcattaaaataggtgagaataaggaatttcgcctctgataataatatttattttcatgact

SEQ ID NO: 35026 - DNA, 1044 bp, Homo sapiens
attattatcctcagtttatagattaaactggggccctgagaggttgagttacttgcccaagcacacagagctaaagctaggtggtggaactgatattctaatccaaggagtctgccccagagtccatgttcttaaacacaatgtcagactgccctcagaggcctgcaaattagagtgggaagtctactgtcagtactcttagagcaaggtcttcaaacccagctgcacacacaaccccaggtaagtaatgttaacaagtgtagcaggactcctggtcacttggagagtccacgcccgtcaagggggacagttcttctcagcgccacctagtggttgccatgtggaaatgcaaaccttaacaataaatagaggcaagggagaattctggatttttatgaaagatctcttcaattcaaaagaaaaagaaggaaaagaaagggaaggaaaaagggaaagagttccatcattgtggaaaacattgtggagattcctcaaagacctaaaaacagaactaccattcaacccagcaattccattatggtgtatattccaaaggattataaatcgttctgtcgtaaagacacatgcatgtgtatgttcattgcagcactattcacgatagcaaagacatggaatcaacctaaatgcccagcaatgataaactggataaagaaaatgtgatacgcatacaccatggaatactatgcagccataaaaaaagaatgagatcatgtcttttgcagaaacatggatagagctggaggccattatccttagcaaactaatgcagcaacagaaaatcaaatacttcacttttaagtgggagctaaatgatgagaacccatggacacatacaggagaacaacagacactagggcctatcagagggtggagagtgggaggagggagaggatcagaaaaaaactaactaatgggtactaggcttaataactgggtgatgaaataatctgttcagcaaacccctgttacatgagtttacccatgtaacaaacctacacatttacctctgaacttaaaaaaaag

SEQ ID NO: 35027 - DNA, 1049 bp, Homo sapiens
tgtgcccaaatgtatacatcttattttgtaggtgaatggggaacgattaaaattttttatgcacagagaagtggcatatttgtttgttttacaaaggtaacattagcagcaagtggcgggtaagtgtttagcattgactgaatgagaccagttagtataatattgtgctttcatgagatatgataaattcagttaagcccagtactgacagaagacgtggatttgataactggcaattaaaatatgttttctaaattttgtatgttgacatttagtcaattcccaaaatatagactagagaaataaaaataaatgcatttttttcttaatcacttttattgatgttttgacttaatttcgtagttgtttgtcttaggtcatctttggatttattgtttgaggaatgtatgatttgaaaaccaactgctagagctaccaggaataggaaagtagggggatggcggagggtgggcagggcagagaaatcaactaataaacaggagtcagaaagtctgggaaaagtaacttaagtaaacttttattttgtggcctaacagacattactttaaaaagcatttctcagctgttgactttgaaaactactcacattgcccagcttggagcttttagataaccaagatggataagaaaattatggtttccttagttgcatggccaggctgacctccctgcacagcaaagagcagatggaaagggtgttgaagcgtagaccagcacgaatccatcatcactgacagaaacgtcagcgtgcatgcttgctcagttttgcctaggtgaggagcaccaggccttacattttttttattatttttgagtaggtaataagttcatatagtttaaaattccaaaaatacaaaaggatactaagcgaaaaatgttccatccattctgtcccccaagcaccatcttccttctctgatagcaattttttatttatccttgcagcaatattttatatgtctacaagcaaagatactcatttttctcttcttaatacaaatggtagcatacaaaatatgccagtatct

SEQ ID NO: 35028 - DNA, 1054 bp, Homo sapiens
gatcccactcagtgcccaacaccagcaattgccattttatgagtctgttgccttccactttccactcaattttcctgcagtctttttctagaaacccaacttttacagccttcccgctaagatacaggccccatttccaggttcttgtttcctccaccaccctccataacccgttactctgtcttagtcctttcaggctgctgtaacagaataccacagactgcatagcttacaaacaacagaaatttatttctggaggctggaaagtccaaggtcaaggttccggcagtcagtgtctcgagaaggttccctttctggttcattgacagctgtcttcttgccacaacctcacatgggaaggaggtttttggagtactccggggtctcttttacaaaagcaataatctcattcattaggtccctgacctcatgacctaatcacttcccaaaggccccacctccaaataatcatcacattgggtttgaggtttcaacatgagttgtggagaaacacaaatattcagtctgtagcagagagcaagttctgatgattctggcttcaagacgtgtattgcacccttgtctttctttctctactgcccttcttattgcttgtccagactattgttttaaccatttgtccatctcctttactccactacccccaatacagccagccctctctatccatgaatttcacatccatggattcctccaaccatggatcaaaaatattcctcaagaaaacaataaaaaatagcaatacaataataaaaaatacaagtttttaaaataccatataacaactctttacatagcatttacattgtatttggtattataagtaatctagaaaaaatgtaaaatacatggaaggatgtgtgtaggttatatgcaaatactacgttttgtttaaggggcttgagcatccgtggattttggtgtctgaagtgggggtcctggatgatggtatgtctataccatgcactgggaatgggtctttgatcctgccattcctatcatggtaccatgtcaataagcttacaaagaatgc

SEQ ID NO: 35029 - DNA, 1062 bp, Homo sapiens
ttttatttctctatctcttgatttgaataaaagctcaaaaagcagaaaaaataggaatcactgataatctaggatttgaaaaatctgtttcaaataaaggttaaaatcccccataaagccctccagtccttttccccagaagtaatgaccatcaatgtttgtgtgcatcagcttctaggttttaccttatatttcttgtaatgtgtgtgtgtgtgtgtgggtgtgtgtgtatgagggagatacagccacccacccacacacacccacacacacacacacacaccctttctctctcattctttttatttttgtctgcattttaaaaatttgtaatttttgtgggttcagagtaggtgtatacagttatggggtacgtgagatgtattgattcaggaaaacaatgcaaaataattacatcaaggtaaatggagtattccttacctcgagcattcatcctctatttgtgttacaagcaatccaattatactcttttggttatgttgaaatgtataataaatttttgttgactgtggtctccctgttctgctatcaaatactagatcttatacattttatctaactatgtttttatacccattaactctaccccctcccgccctccctctcactacccttcccagcttctggtaaccatcattctattctctttctccatgagttcgattgttttactttttagctcccacaaatatgtgtgaacctgtgaagtttgtctttctgtacctggcttgttacacttaatataatgtcctccagttccacctgtgtttttgcaaatgacagaaacagtctttttttataactaaataccattcagtcataaaaaatcttttttatagattgtagttttcattggatttctgtaatgatcaatggtgttgagcaccttttcatatacctgcttgcaggtagtttacaaatgggtactttgaaaatgtggtagatatacacaatggagtactatacagtcattaaaaaatacttttaatgactgaatagtactccattgtgtatatctaccacattgtgcatatctaccac

SEQ ID NO: 35030 - DNA, 1092 bp, Homo sapiens
acaggagtaaaggtgcaggaaaggaagcacaggaaaatgaatttcaattgctttgtattatctgtgttcatatatagttgttttaattgtgtttgagaacagatcaaaggagaagaaagaattgatgtggtgatgataaacaacagcaaccacatttttagttggacttggcacgatgtcagaagcatacacgcagtcctatgtgtgcacactcacctactcacctactcattccctttgtgcctgcccccgttccttcctgccttggctctgcctcatacataatcatcttatgcataaggaaatacaactatgaaatgttatgtcaattatagagattttatgtattgctaattagcttaggaactgaagatgcttgcctccttttttccctaaattggtttttaatcaatctgaacagcatcccaaggaaacattttgaaagagaattacaaaatggtcatcaggaagatttttcctactcactaaatgtgaaaatcactatgcaacaagtgcatgatgtcaaatactagaagtttattaataatgataataacaatataggtcaaagagctctgtgcgtgtggagacatatttaaaacaaatgattaaacttaatgcacattcaggacttacggggctaatatctgtgaaaagatttattaaatctccacctggcaaaatcatttccatgtgcagttcattttccggtgtgccattgaagctctaagtcttcatactgcagagatcccgacggcactcattttgaaatgtattaaaaatatatgtaagagcaagaaaagcatatggagttcattcagcccagttttttgttcaacaaacttggatttaaatcttgcttctcacacttaccttgggcatgttccttggcccccttttctccccagtaagagaattgtcatagaatctaccttataaggctattccaagaattaaatgagactacagacttgtcactctttaaatttctggaccagaagtgagctatcataagcattcagtagctctaatatatgcattcagtaaatctttgttgagtgtttacctggtgacaggatgggcactctgcta

SEQ ID NO: 35031 - DNA, 1041 bp, Homo sapiens
tctctagacttatgaaaatattgattattttattatgtgtccccattgacacaaatatgtctagcattctcaatgaaattgcttacacagtagactaaaccttcctggattttatattagacatgaatgtaacaacaaaaaataacaagaattagaacctaaagttactgtcttggtacttgttcaatgagctttcatcatattttggagggaataggtggataatattttccaataaaacgtttaacctgatccatcgtttttcaaacacacagtaagtgtagaataaattaacacatactaattgcttatggatgctttgttttcgcatctgattataggtattcatacttaagacatctcaagaggaaatgttgataatgtcatttctttgtaataaaaagacagaccatcaaaattgtggaagtattgtgttataagatatttttaaacataaaaagccattgtaaaaaatatccatcctgtctatttctgtaagaacatctgagctattccgagcttacattttaggagttaagttctagaggccaatgatcctttgtttggggtattgaatattatctagtatatccagtacaggtttaagagtagttgctattttataaatgttcaacatggaccagaaaagcatcagtctataaatggattccttgggcccagagctctgacagaagaaaagtttgagtgtttgggggtagtggggtggtgactgcattactatattactgcagcatttctggtttatgtacagtagcactcaataaatatatgtttactttaattgagtaggcataaatagcattcaccagaaatcctttgctggcagccagctgcatttgactgctgagagccatagcatatcctctctgaagttggagggaacacaatctcttttcagtgttcaccttttctcaaaaagccagaagatcaattatgatttctttatgttcacaggtaaaatggtttaacagaaagtaaatttcatattatcataaagaacccatgggcaaaaaggcaaat

SEQ ID NO: 35032 - DNA, 1144 bp, Homo sapiens
ggtgtcaggtcttcggaatcttaattttctcttactaattatcaccattactgctatctaaaaacctagaatgccttaaaattatatacaagtgaaattagctatatatgcagtatttttgagtggaaagaagtaagtagagtcttctactcatactttaattaaaagtcataccaatatttgaaataatcatgaaagtactgaataactggagagagcctaacatcctctctgaatggtatatgatactaaattgctgttaatgaaggttgaaaaaattggtctgttttgtttgaatttcttacatttggagagcaaaatattttttaagatgtgactaaattcatctgggttgtctcttttccacatttattcccttctctaatactagcacatagggaaacaaacagaacaaaggcagcaaacacaggtaagccacctcctactgaaaacaatctactgtctccctttctccattacgtgtacttctggctttcctatccgtgcagaacaatagcctctctgtgattttataatctctgcaggaaaaccaacaaaggtatctgagggtcgctgcattgccagagaacagcagaggcagaaccaccaatggaaagcagaagcagcaacaggtggccgattttgcacaaaatgcaggagagaaatgtctcctagtgcataagggaaaataaacagcatgattgagtaggtcagctcttagcttgtcctctcttcctgtattctctctttttttcctctccttttctaacatttcaacctctaggaaggagttggtgacagagtggtgccatgaaattagaagaaaaagactgacattcaatttcttagtgcctgtggggtcaatacacgccctgacatatgggtttacgtttcccacccaattagccagtctaaatgggaatattcattgttctaagcaaatccaaattgacatcagcatctcccaaatttatttgacctcagaacaccttttttcccaaaacaccattaacatcctgcttctagaatgcactttgggaaatgatgctttttatacaatcaaaaaagtttcaattacatattcaacttatcacattaacacggaagtatgtgacatgtttttggaaggtttccttcaaataaa

SEQ ID NO: 35033 - DNA, 1047 bp, Homo sapiens
taccaagcatgtacataaatagaattccagagataaaaacttcatcaagttgagggcttaactggtttgctgttttgagaagggccaggtaacagtggtctttctttttgttaccaggtatggatgttccctctgggtcctgccaggtctagaacaaagtagcaatatttcaagtgtcttttttgttgatataatttgttttttttttcccagtaggagcaagtttgcataatcagtatgtggggatgtgtggggagtaaggggaaggcaatggatatggggtcttacctggcgtagccttggatcaaatggccccatgacattagaagagtctacttagagtccccaaagaaaaggggcacctagaacagattaataactacttctgttttcaagttaaactggccagaaaacacatgaaaacaattttagcatccaaatacaatgaatcattaagtgatataaaatgtttatctcgaaagagagtgtatccattacttagagcttttctgtgtaaaaatgtatttcccaggtgtaatgacattagcatatactttcatgtcaaaattctgcaggcttggtagttgtaattcaatttattaaaggaacatacgtggaaaatgttattgctctgttctttctcacaccaccatatgttacacttgccaccattttctctcaactccaccctgagttaaagctgcttttcccaggatttggagacattttgcttatctttccttaactcgatccattatgtgccatcactagaatttaaaattgatttcatatccatttaaattaatttgatcctcacaataatcccaagaggtagacagagtggattgtattgttagtgaacttctttctcatatgaggaaagtaaggcccagaggggtcgtatgggttgcctctggtgatgaggttttcgcttttcaaatgttgcatgtgtggctacaaccatgcttcattgttcttcccacagaagacagtgtccacaaatcaggctttctctctctctctctctctctctctctctctctctca

SEQ ID NO: 35034 - DNA, 1108 bp, Homo sapiens
tcaagataagagtaactagaaatctttttagagcaatcaccaataaattataattctatacttcatttatttatatgttaagggataaggcttggggtaagttaaagtgatatatataaattcccatcataccatttaaaatatgggattactatgaagttcaatattctattaaataatagtaataacagcacttactcattggatcattatggggattaaaagagtaggcatatgcaaagctataggaagtactcaattacaatataattattatcattcatttattcctttacaccaaaatttcataagtacctattacctgtgtgacagagaaaatatattttaataatcaaactaccctgaaaatgagttttaatcttgaaagaccttagaagaggtctcactgaagtcttttccattcttcaattagctctggtaaggaaggctatcaatttttgtggttcaaaggaaagaaatgaaaaacaaattttaaaatttttgaaagaaaaaagagatggaaaagacaaactgaaactatatatttgtcagctccatgaaaaaagaaagagatatctaacgggaaaagcagaaaattctactgtatgtatttttcaacaatttttttacttgacagaacaatcatattcagcaaaattctattaatagatatgatacagacctcttccaaaccctgtttttatctcagttacccctattttctagtcaaaacagaagtaaaaatatcatactacaatgggacagactcactctttccaatgctgagctccattttggttcatttgaaacttctaaacgcctaaaaatattctggccctatattaataatgagcagcttggagcctcatttccttgtaaacttgcattgaaattatgtaataaaaaatttaagtgacggaggaaatgtacacacacactacacaaactgatcttagattggaaattgtggactcttttctaaggatagattctcctaggttagcaccacacaaaaagctgttcacatttctcagagttctatagaacagaatgggttagcagagttctctgtccaatctcctcaggctaaaattaagttgttagctgg

SEQ ID NO: 35035 - DNA, 1024 bp, Homo sapiens
ttacaagaagttaccctagaactaggcatttctcctgaaattttcatttttatagtcagggttaacttgactatattctgcactagagtgattttaggctgataaggtcctttatgagcagaggatggatcttatttataatttttacccgtaatatctaatatagcacctgaaacaagtttaccactcagtaagtatttcttgaatttgttagtataaattcctaatgtacattgtgctcttgtcctgtgactagtttgaatgtcccatttttttgttgtctacatttataactatttactgtatatctactttggtataatatgtgtacacatacatatgtcaaacagaagatatttagaaagagaaagggggggaaagtgagcattgaggaaatgttttgcccatgcggtaatggttaaaaaacagcaatggattttcttgaacgcggttatattttatggtatttcagcatatagccttttctctattcactcacctaaaaaaaaacccaaggctctatcaacttgattgaggaaaggattgtgggaatcactaaaaagataaaaagtcaataaatagttccaactgccaatcatataaccacaagataaaaaaagaaaatcaaaacaggcaaatacatgtttcattttatttgggtaaatttccacatatgaaagaatatcttgggttagcagggaaagcaatctgactttaccagcagctttgcaagcatggtcactatcatcgccacgcatcacctctgattgacttcctgcttgctaccaggttcggttggtgctggattagaaaacacagagtttgagcagtgcaacagcatgctgccggtgggcttgccaaattaaagccccaagcccagggttgtcattgttgttattttcatagaaaaagactaaggataatgtaacagaaacaattcaaatggccagaaaatataggaaaatgtgtctttgttaacagttaattctattaatcagcttgagatatttgtaaggtaaaattg

SEQ ID NO: 35036 - DNA, 1749 bp, Homo sapiens
tttttctccttaaatcatgtataatagagtattggttcttaagaaattacagataccaaagaactgatattaaaatacttaaaacatgttgagtgtgcctgttaaagaaccagttctcagaagctatggaagtactgctttgttttatcttaaggaaattttagttgaaaatctgctttaaaaagctacggagagctggactattgctgtcaaggaggatataaagtgtaattcgtttttcttttttcttttgcatttatatcaagtaaattcatgcaaatccttcttagaaaatatttctgtttaattgttgttatgaataatattgtcagtatattgtgtacatagcactttcagattttatgtatctacttatattcaaagaatttacataaaataaataaccttaatatcagtattcctgctattgactcaatggttattttcagaatatttccaggatagagactgtttaaaatgtcatttgggcttaccgtagtttgactgaatgggactaaattgctttgttgattggaccagtgtgttaaccaaaggaaggtgaaaggttatcactatcgttagtcctatacaaaacatccgaaaagttttgaagacaatgggatgggatttactaaaattctcttcaaccttcttgtaaacagtctacttaaattaaaaagacgagcctaaaattttgatactatagcccaggaggaaggagttaatcgataaggaatgcaaggtcataaagtatactttctatttccttataagaaactaaggctatagtttgacttgctgcttgccaacttacctatatggttaccagagtaacttcctgttctaaattatgctgtatgaaacttacgtgtattttcttaatttagaccccaaatttagattctatttataataactaggatgtggtaggagagagttctctaataacttcacatttgtagtttcttgctcaaaatgaaaaactttttggtggcacataagtatttatagtagtgtaagtcaatacacagcacatttaaccagatcataaatcaaaacagtctaaataaaatgaattaggcaaaaagcagttttattttgattgatgattttatagtatgagtattaaaaagtataccatagagttaatgtttatttcccttctgtatctcttgtggcaaaataggtgctagaaatttatgagcatattttcaactgggcataaatatttatagagccttagagaatatgctacctccatcctttaataaaacctcacattcaggtattagagataactatttatgcactcctttgtttattcaacaagcatgtactgttcattgtgagctacaaagcaatgtgctagacaccaaggatcccaaatcaaatgttctatttatcctcaaggagactagagggaaagatggtgttttagtctctgctgctataacagaataccacagaatgggtaatttatagtgaacatgaatttattgcctcatggttctggaggttgggaagtctaagatccaggggccagcatctgatgagggccttcttgctgcatcattccatgggaaaaggccaaagagtgagcgagaaagagcaagatatgaatgtgtggtctcaagcccttttataattggccttgatccattcatgagaatggagccctgatgacctaaatacctcccattaggcttcacctcccaaccattgcattggagattaagtttccagcaaatg

SEQ ID NO: 35037 - DNA, 1050 bp, Homo sapiens
taatcatgcaggcatcctggtctcggtctccagaaccataaaaaataaatgttgttttaagctgccttgattatgctcatttgttatagcagcctgaacccatttaagacaatgtttcttggaggggtactaagatagagaggggcatcattattttcccaggctacataggaacaacaggtacccaggttacaataaagaggatatactaggccgggcgcggtggctcacgcttgtaatcccagcactttgggggccgaggcgggtggatcacgaggtcaggagaccgagaccatcttggctaatgcagtgaaaccccgtctctactaaaaaaatacaaaaaattagctgggcgtggtggccggcacctgtagttccagctactcgggaggctgaggcaggagaatggcgtgaacctgggaggcagagcttgcagtgagccgagagggcaccactgcagtccagcctgggcgacagagggagactccgtctcaaaaaaaaaaaaaaaaaaaatactagatagtttttctgaaaaatggtttttaaatgtggctttcttgatggctcaagaaattgcagcttctttgttccatttcagtcatttatccaaagagataatgaatatctccttaggcgaaagtatttatatcagagttcagatacaaacttccatcatattttcaccattatgcattttggagcttgtcacaccaactaatataacctgacaagtacaatgagtcaatcggtgttaaaaaatgaaaaatgtttaagtgttgaattttactcttgacttatatttgaatcttacggtagataatccttatcttttaaaattaattgtattatcttgaaagaatgacacgacaaaatatcaatatacttacaaatatattttatattctatttttagaggtgatatgatctgtagaaagatctagagatctcttcctaggttgagtatttagagacttgataagctctgtgaccttgggaaagtcattttacctttttggagcttcaatttcttcattgatctcaaagtgtttg

SEQ ID NO: 35038 - DNA, 1058 bp, Homo sapiens
gttctggttctgcactctttcttttttaacctgatttcttaaacctatgtatggatgcttctttggtttcatttcttacttggatttgttattgcttatgtatttgtggaggagggctacatgaatatgagacctttggtattattccagtatctcttagctcaaggatgttttactcacagaaacttggtgctgttttttaatgctactttgaagtagagtaagtttgccttgagcgatattcaaacactagtgtttcccttttttctagttttaaaaaaagaaacttagtaatgggataatttatagtttctcttattttaaatatttgttattttcaaacttacagagattttaataaaaacattttataggaacacttttatgagctaacaagatcagaaatagaaaacttttttttttatcctgtctacctgtatggagccaccagaagaatttctgccttttcatgaaaacccaaaacatatatcatgttgcagatatttggactctttatgaacaatatgtttgaaaatattgagctgaaatttcagaattaaaaaaatagttttgtgttgaagttgtactgtggttttttgttttgagcattgctgctccccaaaatgttgctcatatataatgagattttgaaatacacagaagaatgtttccagattttataagtatttaaaacatacctccccttctacatggagtacatagtgttaaagttgccatgacattaattaagttgaagttacaatttagaaagtgagctatagctttgaaagtgccaaatatgcagatatttgtccttaggtcagtatagcttttattagcaatgagcagtgattcaaaagtgccttgtgtggcaaaagtgaagtataacatctgaaaatccccatgtttggtgaataccctcttttagttaaataactaaacacatcttattgccaacgtggtagtggaatgtgagcgtgaggggagccgggtgaaacttcattatatagatatgcctgttagagttcttattttaaataccagggctcacaataatc

SEQ ID NO: 35039 - DNA, 1033 bp, Homo sapiens
cagagggagtcactctcagaagaaacattaaaattacaggctgcaaccactttaggaagataatggggaaaattgtgggggttgagattgagccagtgctattgccttgaagttttagcctacatatttttttagtttgacttttatatttgtggcagttaaaaacaaacctgttcacatttcctcacaaattagaaacaatggcttctatggatagagtatggtattagaagtaaagttcttaagcaattattgtgcactcatattgcatcctaggctgaatgctatttgttagaaacggaatgtaaccaggcagtttaagccctacaggaagacagaagtagaaccatggaattataattcactttcttaagtataaaagcggacacaggtatagtactttctggattcagacatccgaagatagtaaacataggtgaagctaggattctaatgtgagtggtgggtggggggttctaaaatttctacacagaagaacgtgggagcagtgatttggctggaagttgtatgttcttgaagctaagtttgcgttgcaacagcattttacttagatttaatgcaagtttcatctggctctggggaggcacaggctaagagctgttaatggtgtatgcccattctgtcagttaacatagtgattaccaatgtttcctaatactgcttccagcacctccagctgtgtgactatgagcaagacatttaacgtttccgtgccttagtttcctcatatgtaaaaatgaggataatatatactacaggttacaattagagcagcttttagctcatagaaaataagtattattccttgactttcaattctacaaaccgttggcaaagaaatctagatgtaaaagaaactaaaggtcaataattttgaactcagagtgatgatagctgctgacactgcttccccaaaagcaagaaatggagctatctgaagagatgctgcggagtagatcattgtaaactcctggacagagtacagttctctgaacagcctgtgggaatctca

SEQ ID NO: 35040 - DNA, 1019 bp, Homo sapiens
gttagaataaaaaagacagacaataacaagtatcggcaaggatgtggagaaaacgaaaccctcatatgttgctaatggaaatgaaaatgttgcaacctctttgggaaacaatttagcagtttctcaaaagttaaatatagtgctaccatatgagtcagcaattctactcctagaggagtacccaaaagaattgagaaagtgtttacccaaaaacttgtatgctcatgttcatagcagaattattcataattgccaaaatgtgagagcaatgcaaatacacatcaactgaggagtagataaacaaaatggggcatatccatgccatggaatatcattcaaccatcaaaaggaataaattaatagcacatgtatatgaaccttgaaaatattttgctacatgaaaaagacagccacaaaagccccatattatatgattcccttgatatgaaatgtccagaagaggcaaatccacagaggcaggaagtagattagtggttgctaggtctgtagggatggtgggatgggaatgactgctcacaggtacagggtttctttttggggtaatgaaatgttctgtgattagatagtggtgatagttgcatagctttgtgaatatactaaaagcccctgaattatacacatttcaaggatgctttttaccacatatgaattacatcttaaatttcaaaaatcaatgatttaaaaaaatgggacacagtggccagggaaacaagttacaagtgtcactgtttcactcacattttcttcctttctcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaat

SEQ ID NO: 35041 - DNA, 1064 bp, Homo sapiens
cacagttattcccaacttttgttgacacatcatcatccagggacattctcattaaaaaaaaaaaaaaaaaaaaaaagcatatccaagaagtagcccaatagtcatgtaatgtgtgattctcttccccagcatttctgccacatcatcctccagcgtcttttcttaaacatccctgagaagagggtacacggtgtgccccacccagggcagcccatttctgagcagctctgtctcggagaagtttttggaggctatttaacctgaaaattagcatgacttattctaacaaggagaaccgaggggtacctggtcttacagataagttcacaagcagctggttctctcttgtggatacatgggaccacagtggctgtagctagtttcctaagactccatctgccttatctgccagatccttcctttgccacacacacacacacagtgtctctctctctctccctccctctctcatacacacacaaccaaatgcttcattcttcacctagtcagaaacctggggagcccccaggagagctctgtccctgattgccacctgccaacctgccagtcttcttggcttgaggcatctcagtgctccagtgctcagctcaccttgccagctttcctgtagcctgattgggtcctggtcatactcatctgttgccactatttcatcagtttcggcctccatgccccaaaatgtgggatccttttttttttttttttagatggagtttcactcttgttgcccaggctggagtgcaatggtgtgatctcggctcactgcaacctctgcctcctggattcaagcgattctcctgcctcagcctcccgggtagctgggattacaggagcctaccaccgtgcctggctaattttttcatttttagtagagatggggtttcaccatgttggccaggctggtctcaaactcccgacctcaggtgatccacccgcctcagcctcccaaagtgctgggattacaggcgtgagccaccatacctggctgggatcctctgaattgtattttttttttttaagtaaagatggggtttcaccatgtt

SEQ ID NO: 35042 - DNA, 1028 bp, Homo sapiens
ccttttagcataatacctgaaaacttaaggggttgggaaatatcattcatacagccaattttttttaataccttctgtattcaaggcactgtgctggggaaacacaagtggataagatggacatggtctccattctcatgatgcatacagcctactaggggagacagctgaaaaacaactacagatataattagaaggaataatttcaggaagtgtggttagtaatatgaggggggaataaattcgcaaaggtggccagaaaagactttactgagttatcatctcaaacaaacccttagggtaggagtaccctgtctttataaaggagagaagaaagagatgcaattagcaggatgattgacgtcaaaaattgcttgatatagtcaaggaatagaaagtaggcctgtgtgactggagagagtggtatgatgtgaaattggagagttggtagaaaggagagcacagagatccttagggattatgaagtatcgtatggtgcacatactgatggattttcacaaactgaagaaactctgtaaccagcacccagatcacgaagttggacatgttcagtaccattggggctgctggaagcagtaaccacccacgctgttagctctcttgtgttcacatttcagggccttgctttaggaaaacttctggtgttctcaggctatttcttctattaccatccaaggcctaacacttctagctccaagcagagtatctttctgtgggatttttatactcatgtcacttcctctccccaacccccaccttgaacatgtattatacatggaattctttggtaaatagaatgcaaatttgttttcaaagcttgtttggcacatactctctcctttagaaagcaaagggtgtcctttcagaaggttcttataatatttgtggatctggccttcaggtctaagctgaagcttttgttttcatttggactttatgcatgtattaacagtttatattttctgtggtaatggaatattttaggggttgtttcttcattatattta

SEQ ID NO: 35043 - DNA, 1030 bp, Homo sapiens
atacacacaaatgttctgctgcatgctgtgttcccactgaaatccagggggtttatttgcatttatacttaaagaagaatgaccgtatttggctgactctaagccaagatgatacaggcccaaagtttttcatggaggaatgggggagtaagggaaataggaacatttggaagaaatagttgttgtttttccctgttttattcagtgggcattttattcacagatcatttgatgcattgcatttactcgtgttattctggttccttttgtgttttttttttccttttgaaacaacttcacacttacaggaaaatggcaaaaatactaaaataagaactcctataaaccttcactgataaaatcccttcagttttctccagttatcccagtaacgtcctttatagcaaaaggatccggttcaggatcactcatacccagctgtcatatctttccagtctccttcattctagaagcattcttcattcttccttcatctttcatgacactgacacttttaattacaggccagctgatgtgtagaatgtccttccttttcttaggagatgttttctgtccttccttgaaaaccccactagtgttacctgccacgaggagagctaggcgctctgccccctaccccaagctggttgctctctcttacaatgcttcattaatcaagtacccttttttggagcattgatgatattcattcatccttttagccagtaaatattttttgatgtctattacgtgccaaatgggatacatttaagaacaaagcagaccaaaaaaaaaaaaaaaaaaaaaacctgctctcatgaagcttacattttagtggagggtaacagataaccaacaagaaaaaataagtaaaacagcaagtacattagatcattagatagtgataaacgctaaagaggatcgaatcaggcaggaaaagggatgggcaggttcttgataaagtggccagggaaggcctcccacactagtgattgtggagcaggaaccccaaggaagggaaggaacaggc

SEQ ID NO: 35044 - DNA, 1053 bp, Homo sapiens
agggtggtgctctagaaagggcatggaagcgccatgtcccttgccccatacctttacctgtgaatctcttcatctgtatccattgtaattttttaaaataataaactagtaaatgtaaaataaccaaaacaaagaaaccaaatgccggtgtattacatataagttgatacctagccagttaaatgcgttcagatgtgtcttgtttaggaggtaatcacccgggcctcccccacaaagtatggttcaaagggtcatggtgggtggctcctcagagcatctcagctcccttagacctgatgaaggcttcacaggcatttcatatctgtgcctctggccagtatatctccagggaactgagtgccaagggagaccaaggcatctttactgacattgttgtaccttaagtgaggcaacatgtaaaactgtgacacatgggagtgcttgatttttgagcgtgcggagcaacagggtccagtgttatggtggcaggggcaggagaactcatggcatcaggagcgtagacagccccactgggcacgaattataacccaggcagaggcaaggcgcaagggtggtcagacatctggccctgaaataagaagagacaggtgggaaagtccaggccaagaccgtggagcagagttaagaaggagcaggaagagccgatctcagaaacaggctggctctgttgaaattggactgaggcagataatttctttctttctttttcttttcacctttcagcactgttggacatgaaggaaagataatttctaagtttactttttgatatttatagataaaatgctttcaagcagttaaccagcctattggagagtgacacttagatcatcttgaagttggtttgggcgatttagagaaacatttataattaagttatgcagttaatgaaagccaagtggggacatttgttcagaacaattgtttttgtaccttttctttgtgatagagctgtaaaagtgtatttacttgtaaactgcaacaagtttttgctccttcccccatcaaaagaataatatatctatataataa

SEQ ID NO: 35045 - DNA, 1021 bp, Homo sapiens
tgataagtattagaaggcatagggctctttttacttgttggaaaatttttctaaattacacttggcactaaggcttgaatttctaaaaatctggagggaacagctggtgctctaataaatattcaggccagctattttaatgcattgtactcaattaagtagtcctaataaaagaggaatacttgacttaagcatttctcaaagcataatgttgtgcttccaacaaaaatttcctccaactgttgatatttccccccaagcagccttaacatttaattctgccaagtaagtaatctaatcatggatgatgcatttaatgccaaaagttagttctcttttaaggtatagttgtatcaatgtggcctagccctttaactggagactccataggtcactgaccttttagaagaattcttcgtctggttcagagtgagagagtattgaaagattcatcctaacttgggcattctggtacccttgtggtgggagggcagaaagtctgctgttaaggagtttagactttgagtgtgtctggatttttacccagctatgttcccaagcttgtgaccttagacgttacttgcccaccttgcagttaagtctccccttcatctgcaaaatggcacgtttagtagtattaatattattaatagtagtattaagataacgtctatctcggaatcctgaggatttgaggagttaatatgtgtaaactgcttggaatagtcaataggtattagcaattattatactgttttcctcataatttattttgattgttttcccttctttcagaatcattaaaataatcttacattgtaacatatattttttgttctctgtaatattctgcctacataagtgcattctcaaaataacttaaaaggaaaaaaagatctaacaaatgttcacagtgttcttttcattgtaatgagtggcacgcagttcttatcgtggataccagaccatgaattcgcttctattgtttgttgttaattttcccttttttctttacccagtt

SEQ ID NO: 35046 - DNA, 1050 bp, Homo sapiens
cagcctcccaagtagctgggaatacaggcatgcaccaccatgcctggctagttttgtatttttcctagagacggagtttctccatgttgatcaggctggtctcgaattcccaacctcaggtgatccgcccacctcagcctcccagagtgctgggattacaggcgtgaaccaccgcgcccagctctgctgtgtttttcttaaataactgtgcttgcttatctctgtcagagcacttagcacactgtagttgtctctctgcgtcatttctgtgaattccgttgagtgatgagtttcagtgtgtcttgggtctctaggtatagcagggaatctgttatgtagtagacataacatacatatcttttaaatgaaagaaatggagaactctcattatttgccactgtaataacaactagcattttgcttttttccctaaatttttgtggtaaacataaacatttacagtattaactatttttaagtgtacagttaatgttaagtactttctgcaaccaattattgtgcaactaatctccagaactcttgttcatcttccaaaactctgtaaactctataaccctaaactcccttctctttggctagtggcaatcaccattctttttgtttctatgaatttgacttcttatacctcatataagtggaatcatacagtatttgtcttttttggaggggggctggcttattcacttaatgtccttagcttcccctcatgttttatgaagtgttagaatttccttcatcagggctttttagtattccattgtgtgtatatatacatttttcattcatctgttgatggacaggtgggttgcttctaccttttgacttttgtgaataatgttgcttttaacatgggtatgcagctaccattttttgacactgattttttatttttagatgggcactctggttttttaaaaatgataaaagcaaaacttggcaagcaaacctgcggctgatctccaagtttgatactgttgaagacttttgggcgtaagtaaccatttgttttagtatgtttgttgttttatt

SEQ ID NO: 35047 - DNA, 1132 bp, Homo sapiens
cttgaatggataaggtgttgcttcttatgggtgagcagaaaaaaaggtttcttgagatggaatctattcctggtgaagatgctgtgaacattgttgaagtgacaacaaaggatttgaatattacataaaccaaattgataaagcaactgcagggtttgggaggattgactccaattttgaaagaaattctactatgtaaaatgcttacaaacagcattgcatgctacagagaaatcttttgtgaaatgaagagtcaatcagtgtgacagacttcgttgttgtcttaagaaattgccacagccaccccaatcttcagcaaccactactctgatcagtcagcagcaaacaagggaagaccctccatcagcaagattaccactctttgtaggctcagatgatcgttagcatttttagcaatagaatttttaattaaggtatgtacatttttttttagatgtaatgctatttcagacataatgtagactacagtatagtgtaaacgtaacttttacatgcaccgggaaaccaaaaaatttgtgtgactctccttaaagatagttcctttattgtgatactcactttattatgatgatctggaactggactcacaatatatccaaggtatgcctctatatataatatgttaggtatatataagctattatgtattatgtaggaataaaactattttaagagaagtatatacagatatattaaaactggtatacattatttcagaacatatctatgcagcattactcaatctttattattttcccagttaggtatttgattaaatatagaatcacatttaatagtttccccactcctggcactctcatttcttcttggctaatttgttcctctgagaaatatcagccaacctgtttctcgccttctttttttttttttttttttgagacagagtttccctctgttgccctggctggagtgctgtggcacaatctcggctcacagcaacctccaccacttggattcaagtgattctcgtgcttcagcttcccgagtagctgtaattacaggcacataccaccaggcctggctaaatttttttgtatttttagtagaaaccaggtttcaccatgttggccaggctggtctcgaactcctg

SEQ ID NO: 35048 - DNA, 1038 bp, Homo sapiens
acatcagctttctaagtagctaggtccacaggtgtgcaccaccatggctagctaaggtgttttttttttttttttttttttttgagagatgcggggtcttgctatgttgctcaggctgttctcaaactcctgacctcaagcagtcctttccccttccccttccattccctgtccctgtccccatccctgtcccattccttgacagggtcttgctctatcactcacgttggcgtgcagtggcatgatcatagctcactgcaacctcgaactctttggctcaagcaatcctcctgccttggcctccagagtggcagggactatagacacatgccatcatgcctagcttattttattttattttattttattttattggagatggagcctcgctctgtcaccaggctggagtgcagtggtgcgatctcggctcactgcaacctccgcctcccaggttcaagcgattctcctgcctcagcctcctgagtagctgggactacaggcgcgtgccaccacgcctagccaatttttgtatttttagtagagacggggtttcaccgtgttggccaggatggtctcgatctcttgacctcatgatccacccaccttggcctcccaaagtgctgggattacgggcgtgagccactgcgcccagcccatgcctggctaattttttaaatgtctagtagagatgaggtctcactttgttgtccaggctagtcttgagctcctgggctcaagtgatcctcctgcctcagcctcctaaaatgctgttattactggtatgatccacctttcctggccccatagatctttatgtgtttaaatggctgggtgcagaggtttttgttttgaaaaaagattgaattatttttaaaaatccagcatgtatacttgacctcgttggtggttttcttgccttttcttcttcttttttattgataatggggtggcagttgctgacaaattatcaagtacatgttgaaatgcatctcatttttctgtctaggtgaagttaccaagcattaattataggattat

SEQ ID NO: 35049 - DNA, 1098 bp, Homo sapiens
gttccattgaaaatattaagttgccgaacttttaggttacgatagggtaaacagtatgccatgaaggtaagacctgcgcatcattggcttgatcactttacaaagcttttttgtcatcataatgttgttttgttttgttttgtttgtttttgagacagggtcttgccgtgttgcccaggctggtctcaaactcctgggctcaagcaatcctcctattaatcctcctattaatctcccgagtagctgggattgtagagacgcaccacagtgcccagtgatacagttgttatactcttgaaactttagtttccatcctgtatccttcctgatacccccttcagtaccatatgcagtatcttaatatgatggtatgttaagaaagatagaagattttcccaactttgttgcatagtctgtgacagtcttcctgctatttaaaaaaaaaagtgcaagtggaaggataactataaatactgttatattttcaaatttgagaaaccgtttgctctttgctcttaatgaagagatatgagaatagagaatggttctttagagtttggtctgtggtctgttttatgaagcaatctgctttaattccttcttcttaaaaaatactactagtgccgggtgtggtggctcacgcctgtaatcccagcactttgggaggccaaggcaggtgaatcacaaggtcaggagttcaagaccagcctgaccaacggggtgaaaccccgtctctactaaaaatacaaaaattagccaggcatggtggcacacatctgtaatcccagctacttaggaggctgaggcaggagaactgcttgaacctgggaggaggaggaggttgcagtgagccaagatcgcacgactgcactccagcctgggcaacagagagagactctgtctcaaaaaaaaaaaattatcagcatatcagttcaggtttagttagaatattgctgtcatagatgtgttaagacatttaaaataatgttttatattattttccactaggaaaccacccctactcctaatcccccgactacagaagaggagaaaacggaatctaatcaggaggttgctaacccagaacactatattaaa

SEQ ID NO: 35050 - DNA, 1084 bp, Homo sapiens
catgtctgataggcacaagttctttattcacacaaaactaacatatagagtagaatttatgggatgatgacgtcgtttgggatagaggtatggaaaaaactgcattatgtccaaaactttactacagtggagccagtcaacatgtgtacaacttaacacctaacaaaaatggctccaaaaagtatacatagcactatttctgttcatcccatctgaatggaaaattttacttagctggtaattctcaaaatgttttgttgactcagggaaggggaaacatattttacatgcacagaatgcttcagaacttttctgctcggctaccaatctgccatgtaggttgataatcaaagtcctaaagtacagtttagttctttgggcctacagggacaccttgttgactaactggcttcagccaatttttttcagttcacacacaagatcaatttctttgtcagcaaataccttttagaaaaagtacactacaaacacacttggaaaacattttattaagtactgtataaacagctatttagataataattgcatagaactataccaaggtaattgtgtctttaaggaacaactaccaagtgaacaagatgagcaaagtcctctattatacaagatttccttcggtggaacattatggtgacaaagcagcgtaatgggctcttaagcagattgatttttatcaaactggacatatcagaattccttatgtataagagaaatatgcacatgctcctttcaagaaaagagtgataacccaccatggaattacctccagtttaaacatgtactcttgactgccaaaaatatcgagatatgttaagcaagataaagcagcagaacacgctttaaaatatgttgatctctttctgtaatctacatgttaatattaaatgttcttatccttggcattgtttcctcagaatcatccagggctcaaattcagatttaagtttaaaaaattctatctggaattgtctggtgatctctgacccaactactgaaacaaagcaaatctgcttcatagccagtcacattctgtatagaataaaacagttggtagttgtcatat

SEQ ID NO: 35051 - DNA, 1085 bp, Homo sapiens
gaaatttggtccagactcaagcagactggcctatttcagaaatagtcattacctctttaaaaatcatatttcccagctgtcatgaggaaactagaagtgagttggattccacctgttttgcacacaggcgatggttctctccatgcttgaaggcatagtgcccataaaatgaccttgtttaccttctcttgctaacgcgcgctgaaagggggactagatgttccctatttcgttgcatataaatgcaccattgcttttatgtaccactaaaaaattgctgccaattctaattgttaagatgccatggattataagcacatgctgattttagagaggttaaaatatgaaagaaatgtgtcttagagtcaatgaaatatagtattataataaaatgacttttcttgtatctgtacctctgaattgcatgcacacatacttacacattcgttgttttaatgtcctgatagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtaaggagaatacttgaaccacttgtttaataattttggcttattcctatggggaaattgtttttctgataaaactacccactatttatgaataggtatcatctaagtagattgtcaagattaagttgattcctcatctgggaagcacaaatatttggatatttttttctctctgattttgcagactactgtttttgtgaaacttttctaagtacatttccaaaaccaattttggcatattaagcaagaatttttagagatgcatcaatgaagcaggattttgaagcatataacttcattgttcttcagttattgtttaaagagtttcatttagataaaaatattgaaacatactttttgcatggtcagacagtatctgaatgatgttacctaggtaaagttctaagacttgaagtttttaactttgcaaagccacatccgttgacaggaatttgcaagggctgatgttttcattt

SEQ ID NO: 35052 - DNA, 1031 bp, Homo sapiens
actttgggaggctgaggtgggtggatcacctgaggtggggagttcaagaccagcctaaccaacatggagaaaacccatctctaccaaaaatacaaaaattagctgggcgtggtagcacatgcctataatcccagctacttgggaggctgaggcagtagaatcacttgaacctgggaggcagaagttgtggtgagccaagattgcgccattgcattccagcctgggcaacaagagcaaaactccatctcaaaaaaaaaaaaaaaaagaaagaaagaaatgcaggctttctgataactttggagattgtgacatcagaataaaagaaaaaactttcagaactctcatagagaactgaaatgttcataaccatcaaacagaagttaactacatggcctaaactgaagaagtttagtctttttaactttgcttaaaacgttgctgatcctctgttttgtttttcagagtcaaggaaacttttattttgagctatttacagcttttaaccattgattgtactcctatgaacaaaatttggagcatatttatttctctctacctgatttctccagaatttggaaactagttgtgagtattcttaacttatggcactatagttatttgcataggtgcaataagaggctgttttcctttgtaacaggacacaattggagaaattgattattttgccaaggccttgactggaatagtgtgtttccctttagggaatttaacttgacttacagagccactaaaaaccccttggggaactggcctcataccttgcctacagcaatccttgtagagggtttctaatatatggtaagtaaagaatgtaactttctcacaggtctgggagccccaagttatctcctcaaaaggagaggaatttacccaactcataggtatttggcagggctcagcttttaaaaagtcttatctgagattccttatgaaacagagttccatcaaagataattaaaaagcctatgtgaaaaataattattcttgctgcattttatacaaataatcag

SEQ ID NO: 35053 - DNA, 1067 bp, Homo sapiens
cgggggagggggaaattcctttgctgaaactgagatccgcatcttgactgacctcattaatttctatacatctttctcaccttagttctggtggacatttccttcagatctccaaagtgcttcctgagaaaatgttccctctctgtattcccaaagtaaccactgcaaaagacagccatagtacttaggcattgcgttgaaattgtcaaatgatctgtttgtgtcccagccatctgcccagaccttcaggaatttggaagcatctttgcctcccctctgcctggcacaatggatttagtctattgaactacacttaatagactggatcaaagctatcaaggtgtcccccaattcttagcaaataactatcactaataaactgcttttggatttcacagttgtgtttgaatttcagaactctttggtggatttgagactgaccagtgtttttatgtgctgataaatgtgatttgaagcatgaagcattaactaaatgaatattcagctttgagaattcaagaataaattaagccaaaggcttgtacttttagtcataagatttatatcagaataaatgatttgagtaaaggatttctggagttgtgctgtgggagaaaaacatttttatagtatgagtaatgcaaactttcattttcaagttctctgaatgtgcaaaattgcttttcttcattacatacagatctgcatagatgaagatgtgatatttcagccctcctcccccacaaaaaacatactgagaagattgtaggcaaatagtaactttagtttagataaaaaataattctcagtcataattataacaacccagctgtgaaactatatatggcgtgggaacagacatatatattgggctgttgggggaggtgaacaaacttttattcatgcagggatggaatgttcccagataaagctctcctgcctggtggagaggtagacaacaaacaagccagtaagcaatgtcagctaatgggtcacatagttgtgtggggctcctggagtaaagagcccaaagagggaggcagcccgctgcaaacaggtgatggctg

SEQ ID NO: 35054 - DNA, 1050 bp, Homo sapiens
tgttttatatacatgtggcctaacatcggaattgacacatagtaaggacttaataaatggtacttgtctattgttatcaataaatatttggttgaataagtaataccaaattttattgtattgataatatccatcataagacacatcattcttttatgtaccaccaagaaacaaaaaatatcctggcagataaactatgtcatcaattttaagatgcatactgttttcagagttaagtttgaaactctattaatttagcttttgtatttagaatttaatgtacaatgagttttgttgacatttcttttttctttactttgtacacagagagactcttcagaacacttcatttgcttaggcttttccagcctcagttttcttaatttaaggaacagttccatctataaagattgatataagaatctgctgagatgttgcatgtgaattgagtgttgtggttcttgtttttgtgaccattgttgtgaataataatgtagaccatatagtgtagtgttaggagaactgactttggaattaaactgagtaaagttgaatcctagctctgaaatttttagctgacgaattgtaacctctatgagtttcatgtgtaaaatgggtgatgatgagtgggaggaggaaataatagctatcatttatataatgcctgtttcagtcactgtcccaagcacattgtaagtattaactcatttaatcttcacaacaaccctgtgagattatacttattttacacatgaagaaactgaagcaaagagagattactaacttgcccaaggtcatagaggtcgtttgtgattgaaaaccagacaatttgtctctagaatccaggccctgtgctccaacgtcttctcagaaataaccaactttatggggtttgttgtgaaaattaaatcaggcaataaagtacttcacacatagtgaatgctcagaaaatgtcagcaattatcatcatctcccccttgctagggaaaagttgataaaatgtaacttctaagagagtccttaacctctctggtcttggttttctcctct

SEQ ID NO: 35055 - DNA, 1043 bp, Homo sapiens
atgcctatatattcctagcactttgggaggcaaaggtgggaggatcacttgagcccatgggttcaagatcaacctagccaacagtgagacccccatctctataaaaaattaaaaaattagctggatgtggtagcacgtgtctgttatcccagctacttgggaggctgaggtgggagaatcacttgagcctggggggttgaggctgcagtgacctgtgattgtgccactgcactccagctggggtaacagagcgagaccttgtttcaaaaacaaaacatgattttgctgtatgttgtctacaagaaaattatttgataacactatatccagaataaaaataagattgaaaaaatatatcatgtaaatattaatcaaaagaaaacaggagttgctatattaatattagagcaagtaggttttagagtaaaaaaaattaccagagaagtacattatgaacacatacatgataaaagggtcagtcctttaagacataaatgtatatgcaccgaaagacagctgcaaaatatgtaaagcaaaaactaatagaactggaggaagaaatagacaaagtcacaattatagttggagactctgacacctctctctcaataattgatagaacaattagacagaaaatcaacaagaatatagaagaactaaacaccaccatcactcaacaagatctaatcaacatttatacaacataccgctcaacaacagcagactacaaattcttttcaagtgcccacagaacacacaggaagagagaccatatcctgattcataagataaacctccactaatttaaaatattgaaatcatacaagtatgttcactaaccacagtggaatcaaagtggaaatcagttacacaaaggtaataggaaaacgtccagtccttggaaactgaacaacaaatttctaagtatccatgggtcaaacaggaaatatcaaaacaaatttgaaaaaacatattgatctaacttggccaggcacagtggctcacgcctgtgatcccagcactttgggaggccgaggtgggtg

SEQ ID NO: 35056 - DNA, 2138 bp, Homo sapiens
ccgcggtgggggatgggcgcgccgccttggtaattctatattctccgttcctcctccgctcgcgggcgtgtgcgcgccgcaggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaatcttaagtagaattaattcctgtcactctcctaggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaactagttgtgtattaaatttgcttggttgtaataggaacttgttttgagtatctcatctagcagcaataactaagcacatttctttgtgactgaactgtcaaatctgtagatcaacaaagtgagatagcccaagtatatttttttaatgttatatgagctactaaagttttaatttaaaaagttggcaggagctggagtgggattgtcagtttcttaggctaagtgtgaccatttcagtttgtacattggcttcgcttgctgtgtgacagcactgcactagtatgctgttagcatggtggacttggggagggagagaataggtaggaatgtcctgtatatccacagaatgaactccgaatttaaactttaaagataatagtgctacgtgccaggccctgctttg

SEQ ID NO: 35057 - DNA, 1030 bp, Homo sapiens
tttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaac

SEQ ID NO: 35058 - DNA, 1052 bp, Homo sapiens
gattctcctgccttagcctcctgagtagctgggaatacaggcatgtgccaccacacccagctaatttttttgtatttttagtagagacggggtttcaccacgttagccaggatggtctcgatctcccaacctcgtgatccgcccacctcagtctcccaaagtgctgggattacaggcgtgagccactgcgcccggccgagaaatttgaaaaggagagtttttttttttttttaattaagaaaagtgctagagtgtgttgtgattcactatttatggggagcacaactacatatacataaagtagaatatcttttatatgctctctaatcattcattttatctgaaaatataaggaatagtatactcactgtgagaatgttcattttacatttaaaatttagtatgtatttgagcatttttctgatcatcagcttataccaagctaagaagcacagctttacataatttatttccctccttttccagcatagtttcttacttttcattgctgtagttatgatttttacaagttttttatcagaaatcttctgtgagattattcttcatatatattttttacttatttgattttatatgttcctcctctcacctcacttaaatacatgaagttttatttttagacgtcttagccactcctatgctgcttttcttgttgtgcttctaaatatagtgaccagttttggagctctcccagtttccattctttgtgttcattgaattgatttcatgatctggccatattgtttattggagagagccagaatattttcccttactcagcacatcatgacccctgagttcacaggtcagttgaggtagggaattttaaacatagagtagtaataggacaatgttagactgaaagcatcattgaatggaataactgaaatatatatatacatgtataggaagaccaccctaaggggactatttgccatcccactttaaaaaaaaaaaaaaaaaaagaaaaagtcttttcatggtctcttgttcattaatcatctaaaatccaagcacagagaattcaattt

SEQ ID NO: 35059 - DNA, 1032 bp, Homo sapiens
gaatatattaatctttaatataaaaaatagaaaaaaaacccatttagatatacaaaagaaaatatgctctgaggaacacagtggtgataagattcttgttctgtcaacattgaagcctaacctaaagttagtaagtcaaggaataacataataaaaacagtatttgagaaaaggcaaaaactttttcaagcttagataaatgcttggaaaatgaacaaaggatgagtagggatataatttaggaacttaataaagtatcttgaagttgcagtgacaagatctgaacaaaaatattgttaagaaaaacatttaaaaggaaccgttcaaaagacctttccgaggacttatgacgtagaatcaacaggtcttagacagaggggcaaaggaaacaaaagctgagtttgacggttcaaacctaggggcataggagggataataacatttatggaaaaagtcaccacctccaggagaaagatgagttctgttacaggcaggagtttgagtaaaactgacgtgtaattctagaaatgcccaagcaggatttggaaaaggagtcctagaaattgagaaagaaattggggctagtgacagaggcataggattaagtaataactgaatttattaagagtgaaataggcctccaagttgctgacttagaataaaatctcacaaaattaaggactgatttttaaaattagcctgcactgttaaagctggagatgaaagaaggagaaaataggagtgatgacagagcacaagaaccaggtttgtgtagcagttcaggcaacagctacttaaaaatatttgcacccagtgcagaaaaattaatatgagatataagtctggccagaattaggaccataactttggctatcagacatcagattgttgaaagagatgaatagcaaaatttatttgatttttacagtggcacgtaaaattgaaatcattgacaaaaggaaaacactaaaataaaattcagtgtgccctattctaatatcacattgtttttactttacatatttttatttc

SEQ ID NO: 35060 - DNA, 1066 bp, Homo sapiens
gtttgacacatgaggctttttggtacacattgtaaagccaagttgcatgccttgtacgtggtaggcagtcaatacatgcattgatttaagcatttttttttttttttggagaattaacagcaagactgtgaccagaagtatcctatcaatattgacccacagatctttatctcactttaaatcactcctataaccagtgctgataccctttctaaattggagttaaacatttgcagagcactttgcacatctggattgttgaattttctcctgtgaatctgtagacctaaaggaaaacctatttcctaattactcaaatacaccaatcaggtgaaaattacagtaatgacacatagcttcaatttttaaaaaaattatttgccccctgtaaaagtgattttaactatacccactcaccaatacaataaacctttattgagaacttactatataccaagctccatgctaggtgttggggatataaatgaaacaagacagacatggtctttaacctagtgtgcttaataatctggtagtatgatagacattaaataaataattccaccaatgattatttatatgtatttggaaaaagcaacaaagaaaagagtggtgtgatatgagagtgaaaattagtctatggggactaattggggaagtgacatttaagcaatcagtgagagtaaaatctctctggattgagaaatagagtggcagatgtgaacattggcttaaacaactcagtttggccaaaaattgcaatgaacctctgggaaaatgtattttataccttgatgtaaacacttgaattcattttctctgtagaggtacacctgtgcttcaaaagaatctaaagtaaacgacagtaggtttccatgtggtacaagttctttgtagttcagatgagttgttggatggacgggtgattagatgagtagttagatacatatgtagagaaatataaacatatataccaggggtatgtaacttagttccagtacacactactgacagtaaaattaaggaaatttgttaaatgaaaattattttggatttgagaggaaag

SEQ ID NO: 35061 - DNA, 1074 bp, Homo sapiens
tgacctcaggtgatctgcccgcctctgcctcccaaagtgctgggattacaggtgtgacccacgatgcccggccaactgtatgttatcttaatgataattttttcctgttggtcagggaatttgtacaaaatgtgtaacacagaaactatcttttcttttataataaattatttgaataacatacattactagaatgtttccctgcagtgctatttttataattgatgaatgttttcaatggtatatagtttaagttctagtgaatatttgcagtttgaatattggttttctgtaccttgatttgcattgtcaaaaatttatttttataatacacatttgtttcattaaaagttcttagagcagagacataatgactgtaaaaggtttttcaggtttaatttatgatttgaatttcatttataatgaagttatttgagtttgagactcttaaaagacaaacataattgtatattggatgttttatttagtcaagatagataagtcttaagataaagttctgctgatcatatttaaaggacaaattctaaagccttgtgaatatccataattttgtttaggttttgaatgatataatcatcttattgtacccataatgttagataaagcaataacttgatttcccaccgtatgggaggagtcttaaatctgggagattatagaaacaaaaataattaggaggcagaagagagcatatgtattctcttctgcctgcaaactcagttatctctgttgtatacacatacatgcacacatatgcacaaatggtgcaatatttgagaaaattgagacttatattttaaattcattatcttgttatagttatgctccgttcactttgtctttaaatgtagacttttaaaaatttatttttctgagagtggacactttcctaatgttttataatggcttatgttttttcccccagttcatgcacctcaacccctttctgattatgtaaaaagtacagctgtagatgctttttctgccacaaggataaacttggccttagagtcaagaggcttgtttcatgaatgatgtatgtttgattatctt

SEQ ID NO: 35062 - DNA, 1030 bp, Homo sapiens
ctttgccctttggatagaatccaaacactttaccgtcctaccacttcaccccgaatgctcagaggactgctttctgctttctgctttcttctccagccttctcttggtcctttccccttaatctccagactctagatttactagatacctaacatttaatggaatttgttaagctcccctttgacccagataaaccttactcaccctttgggtctcaaattaaatgtcactcctatgggaaatctttatcgacagaagtataccatctaatgctttcgcgttttttttccttttcttttttttagtgagactagtacacttagatttacttttaatcacacattcagtggcctatgttatctgtgatctttctagaatatatgtttatttcttgcaaggactgtttctctgcctctttcttcattgtgtcatactgtgcttgccccatggtaggttatcttaaatatttgcagattgactggttgattggttgataaggagaaagagttgtacaaggacttaatggcatgatagagaaatctgtttctagtaaaatttactcaagttatgttattgcattttatattattttctgtccaaaatctggtcttacaactgccaattttcttactttgttagtagcctatgacattacatgatcttacaaagtaaaatgtctttattcagcacctactacattagaatgtgatcatttggacagggtgtactgacagcttttagaggtaactcataaaaagaaaaatctttttcaaatatccaaaagcattatagatgtattattttacttacaaacacttctgctagttattctcaattactcttacctatttcttatcaagtttcataaggatttatgttaatacatctcaacctagatcaaagtactatatgattttccaaatattaaaagtgcatttttatgtctatctaatcattaatctatccagtcagtgctttttaactggaagaataaattaaaaacatctttaatactaaattgtggatattt

SEQ ID NO: 35063 - DNA, 1066 bp, Homo sapiens
tgagaccttatctctacaaaaaattaaaaaaattagtcaggtgtggtggcatgcacctgtggtcccagctactcaggagactgaggtgggaggattggttgagctcaggaggttgactgaggtgggaggattgcttgagctcaggaggttgaggctgcagtgagctgtgtttgcaccactgccctccagcatgggcaatagagggagaccctgtctaaaaaattaataataaatttttaaaaatcagcttttatttaaacttatcaataatgctgaaatattttgaaaccattaaaataacttttttcaaataatcttcagtgttgaatcattattacataattcattatataagccatttgcaattgtaatgaagtaaccaaaatatcaaaaattaaagtagtgttgtgatagaacttctcaagactgcatgcagaggaagttgtggactgtcactcatttctgtgtccttgaatccttagactcaagaatatgtggtggaaggagcatgagaaaatctgtacatgggaaggataaagaatagatatacataaataagtatatttaaatatatatacataaacatttaaaaactattttgaaattcagataataaaagaggctctgtcctgctcaggtacttattttctctaattaattattaataccttatagttgaagaataattttgtttgtttgtttgtttttttgagatggagtcttgctctgtcgcccaggctggagtgctgtggtgtgaactcggctcactgcagcctccgcctcccgggttcaggtggttctcctgccttagcctcctgagtagctgggactgcaggcatgtgccaccacacccagctaatttttgtattttcagtagagacagggttttaccatattggccaggatggtctcgatctcttgacctcgtgatccgcccacctcggcctcgcaaagtgttgggattaccagcgtgagccaccgcacccggctgaggaataattcatttaattagtctgatctttattaaataattgcttgtagcacatttcagatttaatctcaaaaa

SEQ ID NO: 35064 - DNA, 1045 bp, Homo sapiens
agccttggggcaagcccaactttgtaacccaagcttcttcaatgttagccccccaaaataaggactaaatctcttatttgagagtaaaagtccattgtaattaacttgagtaaacatttaaatgactgataatcttggttatctctggctggcatatgagtacagattgagaatgtcttaacgctaggtttgaaagtggggggaagatgggagcgcctacatctgtggcaaccctgtcacttgtcaaaaaccaaagattttattttctttgcttggaattcttcaatttccttcttctctaggtagattttttagagaaataacaactacttttgataatctacaatttacaggcattttcagattaatatagcgagctttagtggagagggcatgggatttggagtcaagactctcggattatgtcgtggctctgcccacaagctgtgttatttttaccatttaatgtgaactcgttttcttcactctcttaatctataaaacgaacactgtgatacctattacatagggttattctgaagactgaatgaaatcatacatatgaaaatgtgttaaaaaatgtaaagcatatgtggatagtgtcttatggttgttgggtttttttaagttgaaaacctcatattcataaaagagctctttgttccaaatgataacttttcttatgccctgtagagcagccaaattaagaccgctagatcagttttatactgaaattaaatattgggaatttacttatccatcattggtttgaagatacctaataccatttagtaatcttcaaatcatatttgacttaaaccagtattatacgactacagtcacatactattaagaaaacactgtgtgcattataggttaaaggatattaacttttattgcatggtcatacactgtttcatagtatggtgcacatatgacttaatagaaatcaggaataagaaactttttaactgttttcaaactgatgaacaagtatagtatgtcctttccttaaaaaaactatcatatttatgactttgattaa

SEQ ID NO: 35065 - DNA, 1580 bp, Homo sapiens
tttcacatacaaatgatttttggattaagtgcaccactgacctgcatgattggcatggataattaaattttaacttgtgtctttgcagctaatctagctcttgataactgtgtttcagtgtaggacatagctttcatcagatatactggagcaaaaatgaatatgtttacataggctaaagcatattcctttttaatgaaagttcgttcatatttgtatttattgattaagagtagatcctcatactatccttgtacgattggcctatctttgatgtaaatgatatttttatgaaacacattttcatcagtgcaatgaatcatccattcctggatacctgccaatagatagttatgaccttggaataaaataacaattgggaaaaataatcagatttccatatgtaatgttgggcaatttaaaaaatataaggtgtacccttcctctagtacacttaaacacacagaattgaaagaaaaatgaagttaatcttttgtgtattattgtatttatggactggaaaaaaacaatggctaaaaagaacaattatggcataccattgttattgaatgtatttttaatgtgtatttgaggtggagttgagggtggaaagttttacaaactgagatatctgattctgtggggaaatgaattgcgtccacttatattatcatgtggttctcacatatatatttgaaattaaatgactttctctcctaactaaaggaaaagaacaatgtgtttgtcataagggcaaaactgttaacttcataaaattcctaaaataatatatatgaacaaagcagtgatttttccagtggtcttaaaaagcttgataaatgattgcaatgatttaaagtatttttagaatgcatttataatctgggtttcaaatttaaatacaagttattttatatttatgagaagtaataagaaaaattcaatagatcgttaaagaaaacaaaaacaagttaaatatttgttagatatctcttactgatttgatatctcctatttttaagtgtgtttgggtaatattaagaatgcaatctataagaaagaacacgtgtgaactttcagttatctcagctaccagatagcgaataagccatacatttcttttagagggaagagtattttgtttcttgaaacagaaaagttactaaatgatgctgttatatattatttttgtacaataagtatgttttggagttgtaaatatgattatatatatgcagtcatccttaagattgacattcacgaaccatgaatatgccttacatttctgtgtgcccattgctggtgttggacttgaattttttatgtggtttttcaataaagtagtctgtttagaataatttcttcttatatattcttttttattttgttttgttttgttttttagcgaagtgaatggaattctcagaattccagttgggaattgtggttgtttttaaattcttgcatctgtgaagggaagccaactagaatgctgtttacttctcaaaatatgcgttttattttaaacaaacttttaagtgatatgacctagaatatgtcagatctgacagagttagaaa

SEQ ID NO: 35066 - DNA, 1044 bp, Homo sapiens
tttatggaacaattcttaaaaattcataaagtcacactgtatttaatctactttggggttcaaacttacaaaaaggacttttaggcaatgattttttggaatgtaaaatataccataattaaaaatgaatattatcgaattgttaagtcttatgtagggcatcaaggacttcactagcccacctgtaaattaagaaataaccattcagattaaacaaagcaagtataaaggaagttggatggaccctttttgccaatatgcagatgtatcatttctagaagatgtactttaattatgaccatttaacagaccaatactgtctaccttaaaacctcctttggtatctaatttcttgcaacatagtgcatctcaaataactggtaggaaattgtttgtgtctttaaacatatttttagtgtctttaaacatatttttgtttgtgtctttaaacatatttttaggaacgtatggcatcatgcatatgtccttttctttgaatctgggaggtggaagaaagcttagtttgaacaagcttatctagtacctgacattgaacatcgctgtatgccttgtgatagagtaatagattgagacacatatttacaacaattgataaaggttttattggttgtgaaggtggtatgcacacatatgaatgacctgtcacggatctcacagatacttcctttttatgcagtagctatagccactttaaaagatacagatgttatatagtaaaaatactacaaactcagaacctcttaaaacaattttttgcttcttgcaaattgctgtctttatgcaatattcctcaaagatcttgtttgcagtgaagcatccttcaaagcatgtgaaatgtatttttcattaccatctcacatgttatatgcccttaattccatttgtaggaactccttctaacatttaatgaaatcctcagcagccagctgtatgccacagaggttaccatgggttaaccaacattttatgaaatgttcacatgttcctggaaaaaccaatgagcagcttatagagactggtaaa

SEQ ID NO: 35067 - DNA, 1033 bp, Homo sapiens
gtaccaaaattttaatgtaacattttgaaatagtaggtgagatttggataggatggttagcaagttggtttatcaaacttagcctgtaaatgaccacacaggtttggaaatagaaaataatttacattatgtgatatagtacataagattgtcatgtggaaaaacaatacaaactagattgaatattcaccatatgagaaaaacactttcttcccttttgaatcacattagcttttaagaatcttcaaaacttttcaggaacatgctatatccacccaaccccttgttttttggttaattgttgtttgccctatcctaaggaccaaaagctatacttacttccatttagtttgtcagtcttttaaatttatttttctaaattgagaagagcctgattaaggagttctgtggcaatagaaaatctctcttcaattcattgccaaagcatagaggcttctgtatatagtatttaaaagtagagctctaaagtaattatttccttggatcctaagaggactcgtgttagtgaaagcaaagtgggacttatttcgacccacaaagaagagctgatttagaggccatgtggtgatgccatgggagaggcgcatgtactgctggtttaggacgagctcttctgataagctctcagctgttacaacagataagagaaaattgatagtttcagaaagcaatgaaagtcaactaggactacagataaacagcatctatgattcttttcaaatgtttgagtacaaaacacccatattttaatttaataaacaattactggagacttactatgtataatatgctagaaatgttagaagctctaaaagaatgataggacagagttctgcccttaaagactttagaactttttagggaagagtcaggtcccactataggggccgtgtgtgtgtgtgtgtgtgtgtgtgtgtgtgtgtgtgtgtgtgtgtgtgttcatgggctcagtgcagcctcgaactccccgggctcaggtgatcctcccacttcagtctctcgaatagctgag

SEQ ID NO: 35068 - DNA, 1033 bp, Homo sapiens
tggctggaagcctgatggataacataaagttaattaacatatactgtgtatgttatatgtattatatataccatattcttacagtaaagtaagccatagaaaagaaaatgttacgaagaaaatcattaaggaagagaaaattactatgcattaagtggaagtggaccatcataatcatccttgttgcctttacattgagtaggctgaggaggaagaggagagattcgtcttgctgtctcaagggtggcagagaaggagtaggtagaggaggtggcaggggaggcatgcatactctgtataacttaatgaaaaaaattcatgtataagtggacttgggaagttcaaacttacgttgttaaagggtcaactgtaatatatatatatatatatatatctccctgcttggtataggtattgttagttaggtgtctttacatcaagatttctttgtcttagaccaatttaaaaggaaatatgaggctttggggtcctgaatgacattgggctacatcttagggactcttgagtctatctgagggtacatctttctgtaatgctggcataaggagctatgagacccattagcttattctgaccctaggatatatataggagaaatactacagtcctaggtctttggaactgagaggaatctctggagtcacttattggaattgcctattcccactgagaaagccgcgtgagaattttccaggggacacaaatatgaggagtcagtttaagatctgattccctgattcctggtcctatttctttgcatcaataatgtgccctcactcctgatacagtggagagcaaagtaaaaacagctaaactattcaaaagaaacaataagaaaacattataaggcatgaaaacccaatcaaacagttgtatttcaacatgagagaaacagtttgcagcagattttcagtttaaatacatgtttaatttcatgtttaaatgcaagccaaatctcagatttaggacaggggatcttcattatccagatgaatattcctgcataaggaag

SEQ ID NO: 35069 - DNA, 1041 bp, Homo sapiens
ccaggctaagttttgtatttttttgtagagacggagtttccctgtgttgcccatgcgccacaatgcccgaccaggaggtctttgtagaaaactctggattcctttttctgggaagtatcttcctcttgctaatggaaaaatgtttaatcttatgtatataaaatttcacattgcagaaagtatgttttacttgaattatgaaattttttgtgactacaaaataaatgaattttggctaacactttattaaaaataattatgggccaggtgtggtggttcacacctgcactcccagtgctttgagagtgagaggacctcttgaggccaggagttagaaacatagcaagaccctgtctctgcaaaaagttaaaaagttagctgggtatggtggtgggtgcctgtaatcccagctacttgggaggctgaagctgcaagatcacttgagcccaggagttggaggctgcagagagctatgatcatgccactgcactgtagcctgggtgacagagaccttgtctgtgaaaaaaaaatctgaaatattacatgtaaggggattttgtgaacattctatatgctaggtattgtgataaaactgtaaccaagtatattgtatatagtatggaatgatagtaataccaatatctttcatagagaagtttctcctttccagttttaaaatttaggattactttgggtcaggtctattcatctttgaagaaaataattttttaaaattccattgtataacatgaagatttttgtatgtgaaaaatacattaaaatcttgataaataagttttaattttacatttcaggccagacatttgttgtatgaatctatgagagcacatacaggattccttgtcatatgtggacatgagtcattataaagtgtactgttaaattgtttggaggcacacccaatagatgaaaaggctaaaaaatgtaatatgtaattatgaaattctcccttgactgcttagtaaccattatgctttctttatcactaattatttcgggtaacagattcaataggtttac

SEQ ID NO: 35070 - DNA, 1031 bp, Homo sapiens
atacacagaaatagaatagtatactctcctgcaaaagaatgttatttactttcattttgaaggatgttgtcttaagcctgtttttctgaactccacttaatgacccacactgatgctctggtttgacaaacaaaatcttcagatttgatgattttgttaatttctagagcaggctcaggtgaaaatatcagccagtgattctgaggtgttgcattcctatttttaaagcagtcattaggtaggactgatgtaggcaatgaaataggatttcagtttgtaaattaagtctttagtactcttgacattttcagcattttaaaatcattttattttacaataattccatcttttatatgaatccatcaattatatttcatatgagaagtgaaataacaattgtgtattcctccatggttaggggttctgaataatggcttaaatcagatgggttatcaactttatgacctagcccagttgctggtatctcaaatccgttttaacaaatatgcactcgggtagtggaagctttagatattaaaaaaataaaagccctcactgacaaagtggcaataaattattaaaatgctatgtttttggaattcaggtagattctttttgagaccatcatagagaggaatagaactttgctgtcctttttgttttccttatccatgcttttgtctcacagcaaaatatactatgactctattttaaaaaatggtctacctgtctgtgaacttctgtctcttgcaactggaaattttgcttgtgtctgtctgcaaaagagggaaacaaatagatatcagggatttataaaagctatctcaatattatgacatactagtttacaatgtttgtcaatttcaggtacttttgacaactgtgaaaccggaagaatgatggttgatgttcaaagagagagttttatttatatggagctaaattaaaaaaattttcatcagctctaagattcttagacttagagtctttctgtggtgattttattgtcccagttttcctttctttgggga

SEQ ID NO: 35071 - DNA, 1035 bp, Homo sapiens
attcagattgttattaccatggcatgccatggcatttgcttacagttatatttattagtgtcatctggcttttgttgtataagaaattgctatttacaaataaagatgtgcttgtggtttgtagtaatatgatgtgactgttttcttaattgtacttttagaatgcagctttagagacgtaggttgagtctgtctcaactatgttatttttgaggtttatagaatctgctagcatgtattcagagaccctgatcggttttctaaaccttaaaaatgaaagagaatgatggcagtggagatgaaaagtatttgtttagattatcccaggagagaaagttacttcagttagcaaaactagtgctgtatcattttgactcttcttggattaaaacaatggaaagtagaaaaattcagagaaaacatcttggtaatgacctttgctggaaatcaaaataatatggtccgtttattgctttacattatatttttaaagatacatacagcaaaccgagggcaataaatagaagaataactgtcttcctccccttgacccccgtcctgatttttctcttagtgatactctacaggccttgtctcaaactttggcttttcttcatttctctctgttcctgcctagaatgctttgtctggccctagcattccctattggtcatggaactttgctatgtgatagttaaaaatacttagaggaaattaaaccctatgtgataatgagtatttggctttgttaaatctcttaacctaccttccctctgttcccatctccaagtattttgtgatgggacttctaccttaactcaaaccgatggtaatggtagaaattttagaaactatgggaggctgttgagggataaatttctgagaagagttttgtggaatctctcagaaactatagataatgcgttgttgtgctttgtgtaaggttgcttttggccatagagaatgagctgtttttcaggtgtattgccagcttacgtacttcatgtagacagagtacacataggagaattctga

SEQ ID NO: 35072 - DNA, 1125 bp, Homo sapiens
ttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccatgtattgtgtcatttgttatttaatatttgtcctgttgagtgactaccatgtatctggtattatgggggagagatataaataggaaatcagtgatgtgctcaaactgtaaatctaaccccgccatggcttatttctataccagttgctt

SEQ ID NO: 35073 - DNA, 1031 bp, Homo sapiens
tgcattgtttttccaccttccctgtatatgtttactctaaacaagtgagttaagaaagaaattgtggatcactgttctggacttcattattctctaagattatttactatatgagagtctctcaattgcatttatacaatattatatagcaaaatttattcagagcatttattttacaattctttgaagatccagaatcaaataatcctttgattgattttgaaattgcaagaagatttgcaaattattaaaattgtttttattaattgtctgacttataatttatatttatatccacatcttctaaataatattaataggcacaatttcttgagcacgtatcatataccaggtaatatgcttagcacttaattatttgatctcatttactttttataacaactactcagtgtagggattatttcttatgtattagaactatattggtttcaagtgatagaaatcaaacaaaattatatatgcacaaaggacaacttactggaaagatactagatgactaatagaacagccaagctacaggaaaaacaagaacctaggaaacattagaacccctaggactctccctccttctctttcctgtctcttagtatcattcttttctttcactgtaggctatcttttccataagtgggatacatagccactagcagttcctgaggtttgtcttataatttcagctactagaaggaaattgacctgactctttcagtcctaaatccaaaatctctggcaagtgtcttcctggttcagcttgaattagatgatcacttctagactaatctaagtgcttagagggctgggcccctttaatggtatcaagggaatgtggatggagtagaggagtggttatcaaaaagggatgctgaaaagatagtatcactggtgtctacaacaattctcatttgacagatgaagaaagtggaactttagatgttaaataacccctccaggtttactcagctagtgaatggcagatccacaagctatatagttaaacatgatataaaagt

SEQ ID NO: 35074 - DNA, 1172 bp, Homo sapiens
accataattgtaaccaatttatttggtgagcttcttagacctctaactatcttagagaatacagcataatggtttacaatctggcttctggagtcaggcaagcttgcgctgaaattctaattctcttgtttaccacctgggaaatcacagccaagtgacttaccctctttttgtaatccttagttttcacatccgtaaattgagaaaaaaagagccttactcataggacagttttttggactagaaaataagaacaatattaacatttattgagcatttaacatatttcgggcacttatatattcagtatgttatacgtgccaactcaataaagatataagacttttttccattacctatattgcttccaataatacgtaatacaaaagacaatgtatgtaaaatacttagcattgggcctggctcaaattatgtgctcaatgcatagttattatcatcataatagtatgttactcgatatagctacattatccttaacaaaattgtcttccattgatgatctgaacacccaagcgtctgtcaactaaaagaagaaagcacagccatgaaaagacagcaagaattaatgaaaaaaaagatcagtgagaaataagtcagtccagtgcctttgatttcagtcttggtttccatggtgactcaccttcagagaggcttttacagtttacctccacttccctttctccaaacactggtagtaaattcttgaaaatgtaaaccttaggagtagagactaataaaataatttgagtacttcaatgtgcattgaaattattacctcccttccagaggacttctgatgctacatttagaagttggctttattttattatttttgccccagattggcatcaccactgaaatgtgaatgtttggggaaccatataatacttccagaaatggatagaattgcggttttaaattgagatctacttctaaatctgtatggacctctatatgggttttgcaagccgaagaatccaggaccctctgcatttagctgaaccctgttggatagaaaacagataagagaatgagcattattttagtctaactggaagaagtgagagatgtatctcttcagcgacagggaaacagaaagttagcccgaacttcagcgaacagtaaaatcagtacaccgattctgagcttgg

SEQ ID NO: 35075 - DNA, 1163 bp, Homo sapiens
acaataggtttttagtagatgtcctttataaggtcaaggaaggtcccttttatttctagttagctgagtgcttatatcatgaaagaatgttgcatttttcaagtgctttttcttcatctattgaaatgattatgtgattttgctccccctgcatcagttgtataaagtaaccaaaaaaagtcttttaagacaatttcaaaatctttttcaatttcgctacctgaacacaactataatttgcttatacacattgaagttatattgtacttttaactttaatgatgtcataaccttagctctacctttggttttttaaaattaaaaaattaattaacgaaaaattgtatatacttatcgtgtactacgtgatgttttgaaacatatatacattgtgaaattccataccccgttttttaattgctcccaaattgtggggctaatcttttgggaatactgttgtttcagagtgaaggaggatgaagttcagtatcctgacgcaggtaggaacaagtgttgagaatgggaaggaaggaatgaaggaagcaagaatatttactgaataattgctgtgtaccacgtactcattctttaattcgacaataatctacccactccactttgagacccagggggaaatcaaagtactgcaagaggtcacagatagatctcccaccctgcagtgctttgatttccttttgggcctcaggcaaagtggagtgggtagagtattgtctaataaaagagtgaggacctggcacacaagcaataattcagtaaatattcttgcttccttcattccttccttcccattctcgacaataagtagctgggttcagacttactctctgtctccagagctgatagattttcttttcaccacgctttagaaagattagtgttagaaattgctaaaccttttccttaaatctataataatttctactggcctccttcaaataatggaattatttttatcccatatttttgtgaaatgcctgatgatgttcagagataataaacactatattttaaaatagaaaaagttgaggataagtgctgctcattatgaatcatttgttatctcttgatttactcatctttttttaagctacactgcttagttgagaatttgaataggtgattgggaaaataaaataaaccaa

SEQ ID NO: 35076 - DNA, 1080 bp, Homo sapiens
taaaatatttgcatatctctggcctcatctggaagaacatttctgagttaaaattaataaaaggtgtttttccatcagctatgacaaataaatcaaaagagctggctataccctttgttgaacatgtatgtccaaagaagatcaattttgagaaagttgttgacagatttttagaaggtaaggctgaaaatagcaaatattattatttcttactatagcataccattatatatgttattccctttgtttataattttattaaatatattaatataatcaaaacttgaatctattaacttttccttttttgtacgctaatatttgttttacttttttaaaaaactggcgtgattatacaaagttcagggaaagaaaatttttaatgtctacattcttttctggacattatcattattcatttcatttcattacttctattgaaaataactttgtcatatggaagaggaggtcttaaaaagtgatcctatctggtgtcagatatactagatacacatctggctacaaggatgcataactgtgccgatgtcaatgttaatctgttaacttctggttgtgctgtctgcaaattgcaagggcacgacaaagaatgtctcttgtgtcatcctgcacagacctgtttgacaagagctatttgtggagacccagagcttgttttctcaatacttttacatgggggagcactttcagaacaaagacagaaatgcagtgtttggttgtctcttaaaatacatgtaaaaggattttagcaggtttgacatttgacaatgtttagaaataagtggatttctttttaagaagaaaattgcccttttgaaaatgtagtgatgctattacagctttttaagtatctgatacaaacagctgagaagcagccttgggtttgtgaatcaatgattcattacatatcatctgtttggtctgccagagaaagaaatttgaggagtaccgtatttatcagtcacgtacctcttaggccctttagttcagatatccttaattcttgtttgaaagaatgcattcaactatcctgcacttttaaagttaatccttctattttga

SEQ ID NO: 35077 - DNA, 1083 bp, Homo sapiens
gtgctcaacttttcaattatgctgaccccctcatcaattttgttattgcccaagttccttgttttccttgttatggcattgctgtctcactcatgggccttcacatgcttctctgtgcccagaatccttatcatcttcctctgtacttagctgaggcatccttctggtctcagctagataccactttctaatgaaagcattccttggccaggcatggtggctcatgcctataatcccagtgctttgggaggtagaggctggaggattgcttgaggccaggagttcaagactaacctggacaacaaagtgagacctcatctttacaaaaagtaaaaagaaaattagctaggtgagtggcacatgcctatagtgccagctgctcagaaggctgaggcaggaggattgcttgagcccaggagttcaaagctacagtgagctatgattgtgtgactcccggggcaacagagtgagaacctgtgtcaaaaaaaaaaaaaaaaaggaaaaagaaaagagagaaagccttccttcaccctctctgtattagctgtgctttctgatgtcctgtttttatttctcaggacaaccttttatttctcctgtcctgatattattatgcttttgaatttgtctatagacttttagttcatgagagtaggggccatgtttatcctggtcaccatttaattcccatcacttagcagagtatatggcacatagaaagtcctcaggaaatatttattggataaattatctacatttaaagtataactttattttttcacatttgattaattttaatacatataaatttataccttattacataactttaaaacccatttacattataaagtaaaatactattactttttactttataaagtatttttacttaattaaaaaggaacaaatgtgtattattcttggaaaatttattttatctttccatttgtcattttctgtttatgctccataaagtttttatgacttacaatcataacatttttagagtggaagtctatgtaaaatataccatttttgttattcttcttcagaatgaaggattaaactgaagattaaaag

SEQ ID NO: 35078 - DNA, 1145 bp, Homo sapiens
caataaagataatataaatgttatacatatatccatatgctattttgctccaccctctattcaatttgtggcatttaaaacatactctcaagttatctagatagaacatagccctttgtcactaacatcaggaatcagatccagttttctgctatcacaatgttttggacactaacctctgggtaggcttccagaacaattgcaagttgcatctaggtatttctgactagattgacatggtccagtgggaagacacctgagttggagaccaagtgaagagtcttgggtctgaattctggctttgtgaacatagaataacttgaggtatgcccgtcatttgtacatggagctaatccctgatatgaagatatagtgaaataacaatgtaaatgcactttgcatgttgtaaagtgctatacaaccattcaaaaagtagagtggtgatatctattttggaggcttattactataattacaggtaatgaacaagatgctcagcttaggttatatgaagttagtggggtctttactttaatctcttaatcctgttatcttcataaactgagactgtacatcacctcaggaccactattgtacaaattgattgtagaacatgtgtgtttgaacaatatgaaatctgattgtaaaatgtgtgtttgaacaatatgatcagtgcaccctgaaaaagaacagaataacggcgattttcagggaagaagggaagataaccataacatctgactgcctgtggggtcaggcagaatagagccatatttatcttcttgcagaaagcctataaacggatgtgcaagtaggagaaatatcgctgaattcttttcccagcaaggagtaaccctggggaaggaatgcattcctgggggtaggtctgtagacggccaccctgggagtgtctgtcttatgcggttgagataaggactgaaatacaccctggtctcctgcagtaccctcaggcttactaggattgggaaattccagcctggtaaattctagtcagactgattctctgctctcgaaccctgtttcctgttaagatgcttatcaagacaatgtttgcacagcgggacatagactgtcatcagtaattctaattttgccttgccttgtgatctttattgccctttgaa

SEQ ID NO: 35079 - DNA, 1049 bp, Homo sapiens
atgaataaagagcaagaggctattaaaatgatcaatcagatttgaaaaataaccaaaagcagtacttccagaatttagaaaacaaactaattaaaacttaaggataggtttaatagcctagttgacacagctaagtaaagaattagaggaatgaaagatatgagaaaatcattctgaatgtagcacgaagatgaagatgaaagtaacagcttaagaaccatggaaaaataacttggtctaacacatggctaattggagcttgaattcgaattcaatttactgcttccaggctccaaatgcgcctttcaataaagtagttcctcattatccttgggagatacattgcaagacccctagtagataattgaaaccacagatagaactaaacccactatacactatgttttttcctatatatatatatgataaagtttataagttagccacagagattaataataaaatacagcaattataacaatatactgtaataagatgaatgtgaactctcaatacatcttattgtactgtactaacccttcttgtgattatatgagataaaatgcctaaatgaagtgaatgacataagcatgatgacataaatgaataattccagaaataaacaattcatgttttaaattgcactgtgttctcagtaacatgatgaaatctcatgccatcccactccttcctgctcagatttctgttagtcacttagtagccatcttggtaatcacatggactatcacagtattacagtgctgtgttcaaataactttttttacttaataatgttcccaaagcacaagagtagagacgtaatattttcacaccatggtgaatcatgggtaagaaaaactgtagaaaatgaaaccatagataaagggatactacagatggtgtttgacttacaatggttcgacttacaattttttgacttcatgatgatgcaaaatgatacgcattcagtaaaagccatacttttgagtagccatacaatttttctgttttttccttttctttttttttttcttgtttgaaacactctg

SEQ ID NO: 35080 - DNA, 1050 bp, Homo sapiens
tgcaaagatgtgtgaagatgtttactcttgttcttacctttgcctaggatgatcttaccccacataccatacagcttccttttccctaactaggtctctattcaaataccttatcagagtggtttttcttgactattctataaatacaccaacacagcatcacctctatagagtacatcatggcatattcagtattatctatcttataggtaataattgtctcaccctcagcgccaccccagttctatgaggacagattttttttctcttatttatcaatgacgagatgactacttgcaacattttaggtgatcaaatatttaacacaaatgactgggccaaatggtagtctgtcaaaggtacatgtacttactcgtcatttgtatatcttcttagggaaaatgtttaatcttttgcttgcttcatttctaactccaaaagaacaaagaaaactaatatactattaaaaatttgttaatcagaccttctttattgtaagtaaaataatgcagttcagattctgtcagcctggatgattaccctgataaatcctttgaaaaagcaaccacttgctgggggaaaactttttttttttttttcgatgtgtcaatgttctatcaagaaaggaaggagtactctcaccaaaaccaaactgaaaccaagaacccagaagaaaacagaacatacccagaaccagcttgcattgcattttgaaaacacttgaagtacctaccccaagtgaacttttttcattttttctacaagacagggtcttgctgtatcacccaggctggagtgcagtgatacacccctcgacctcctggactcaagcaatcctcccacctcagcctcctgagtagttggggctactcgccatgttgcccagactgttcttgaactcctgggctcaagaccattcgccacggcctcccaaagtgctggggttacaggcgtgaaccatcatgcccagctgacctttaattttcatgactctggcaaagcccaggatgcacccaaaagtggtgtcaaatacgagaaacccattcctag

SEQ ID NO: 35081 - DNA, 1087 bp, Homo sapiens
cttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatt

SEQ ID NO: 35082 - DNA, 1060 bp, Homo sapiens
gttaaagtataatttttgttttgtcttgcacctgctttctgttagctgagtctgaggaggcatttctatcttaattatcttggtgtttttatacctaacatgcatggcaccaaaaaggcaatgttcctatgaatgaatgaatgttttgatggtgaaattaacattacattttcattttagaaatggatttaaattaacctccagtgtgaaagttaaccttgttactcctaattcaattttaagacttagcttcatttagatttcttacatgtttttcagcaaaactcaaaaactaaattgtgtttgaagtggcataaaatctacataattggtattcagatttggtctctcactactgctgtatatattttttaactccttaatataatccagattaaataagggatttattagaaggaaactgggatagttaacaatgaatggaataggtgtaggaaccagagcaagctacaacctcaggaaccaaaattgcacatctgtatggaaagtcagctctttgttattgctgctgttgaatatggtctctttagcttttgactttaccatgtaagtccatgacacgtgcctgtcaacagctatgggtcacattcttatagctcttgattatagaaggaagaatgtccctttgatttggaaactcttaggttgggatggacaatggactaatagttgggtcccagctgagggaacaaaattctgtggttagtcatgtccaaataattggttaatgatggctgacccaggactacagtcacatgatttggagtaagggaaaaggaattcatgagtaagatggtttattgagtagacaaaatgtctgctagctacaaagagcatctgctatgacttactcttttctcacttttttttcctacgatactgtcttgctcattctgtgggcatataatgttacaaaaattatttggtagctcaaaggtaagtgcttgtgcatggttttgttactattgggtactaagtggtactttaaatagtaatattagatactatttaaatggcaagaaagaaagtggtgaaataa

SEQ ID NO: 35083 - DNA, 1005 bp, Homo sapiens
cagtagttactgtctgcctgatggacagctaattgcactgcacttcgacctctattgttggttcgcacctttgtatttttctaggttggttgtaaagtcttcttgaggatgattcttaaaatttcttaaggcacttactccctttgtttcccacctcattttatcatctcttccagtccccaaagcagtgttttgtgttgctcagtataggtttttgaggcaagggctgtttttataatgctgattcacagtcatacaaatcttgtcttttgagtcatgtaaatcttgtctttagttctgaaagaaatagactctcaaatagaatacaagaaattaacctttagtaatggcataagcttttagttttccggaaagtgctgagaggaaatgtatctatactactgcgttctgtcctctgtatgacctttgtgtgatgacgtgcaaaatagatggtagagattgggataacaaatgatttgtggaacatcgtggtgataattttactgtcttaaaggtagaatccatgaacttggccttgccactatataggcttttgaattttgacaagccttggggggatgaaacctagaataagttatttatggcgttacgctttaatagggttgacacttaaaaccttgttttcataaatgctaccttttggttatgttgatctgatgaacagatactggctgtcattgaaagaaagttaaccgaatgttcagatacttattgggctcctggaacatggctgctctgtagcttcatgaatattcataatattcataaatatttgtgaataaatatttttagtatttccaatttataagctctttgaaaggagggaatttttttttttttttttgaggcggagtcttggtcagctgcccaggctagagtgcagtggcgcaactgcggcttactgcaaccaccgtctcctgggttcaagcaattctcctgtctcagcctctcgagtagctgggattacaggcacccgccatcatg

SEQ ID NO: 35084 - DNA, 1684 bp, Homo sapiens
gcttgagggaggccccggcccctctgtacgcgtgggtgtggacggctagggcagggaagggaggccggcccagtggccggccgggtaagaggggcagtgcgggacctgggcggcttgagcggccagcctattgggtgcggtgggttagggtgggaaggttggggaagccgcggcctctcctgctggaggaggagggggaatgggcgcgtcctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggtaacccgcggggacaagggcatggggtggtaggagaaaaggaaggctcgggccaagaggaaagcgtgggggtgggaaggaagcataattctgaaaatacctcttggatcacttcttccatggggggatggagaacgcagatatacttcttgaagaaatgaagtttaaagctaggaaacggagaacacttgtggcaagtgaggtgttatcctgagtgcttcagtggaatcggtgcaaattaggggtggaggagagtgacttaaggcgcctttattattttatttttttgctgcttaagaaggagtttttttgggggtccgaattgcggagagacgctccagcagatgtcatggcgcttcctattcttggtgcttgaaaacttagtttagttgtgagatcaaggttatctaggccttctaggggtaagaaagaaaactcggaggagagaaaaaaaatctggcgagtcccgaacttgactgagggtcgggtagaagaagtcttgcgtattgaaggtcagtcagtgagtctagtagaaactcttagtcgactctgggcaggttacaccgaataagtgggtttgggaggagatggaatgacacagtgttgccacttcctgtattttgtagttgcagcttttcacccgaagctatttatccgagggacaccgggaactgatgtaaaaggcattctggaagctcccttttccttttggctgga

SEQ ID NO: 35085 - DNA, 1020 bp, Homo sapiens
aagtagattaatgaatgtgaagtggttttcattacagatagttatctttttctaaaccactttggtatatgtgccaattattgccctgaattttatcttaaatatgcttattttaaaacccagtattataaaacataataaaatgttatgtgacccaagcatttataatacaggttgaatatcccttatctgaaatgcttgggactataagtgtcttggattttttttttttttaatatttgcatgcacctaatgagatatcttgcagatggaacccaagtctaaacaggaaatttatttatgtttcatatttatacaggtaatccgaaggtaattttatataatattttaaataatttgtacatgaaacaaagttgcatttgactgttacctgtcatgtgactttaggtgtggaatttttcacttgtgtgtcatgtcagtgctcaaaaagtttcagattttggagcatttcagattttagatttccagattagtgatactcaacctgtactaaaaatagtgactgtgctaaatactcctagtatcattcttgtttcaagctgattagctagtaataaagctgtgagttttttctacaaagtgttatccttgatgctagtcatagaaatttgatttgtaaggtgatgatgcagtacctataaatatgtgtaaaatatatacagttttaaggatttttaaaattactttaaacacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggtaaggatgaattcagaaagagatggcaaaagatgaagttgttataatggcagattactaaataatatggttgaaaggacaaaaagaagttcacttctcccaaacataaaaactagttggtga

SEQ ID NO: 35086 - DNA, 1075 bp, Homo sapiens
gctggtggcatctcctgtaagaagcagcattgtaactagaaaagcacagtgtaatatttattttacagtaagaaaggtacatcaaagattcatctatccaggagactaatttgtcaaattattgtggcaaagcatcaatagataagccactctggattatatcattgattcatttgaaaacctaatgttgtacttagagctttcttttcaagactccatgatcatggaaacttactatattattcaatttatatagatccattttgttttctgaactttgaaaatagtcaaaacaggaagcatgaggttgaaattaaaatgtaaatgtgataaaatgtacattttatgttatatatatttcatcacaatttatttttaatttttaaatataaatgtgaatacatcttaagaatcaagaagtcttacagtctctcttttcttcccccacatttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccaggtaagtaaatatactggttacttggaaatcagagggtaacagttggaacttatcattaatatgtgatcccaaagggcaagtttagataagagatgatttagttgagtaagctacaatgacaggcttcatttgctgactctgtaagaaagttgatttctccaaggcaccccacacagtgaagtgcaattcacttttaccccaagtgaagtctttagtctaccctttaagcctttagtttcgtccaaagagagacaagcaactttctcaaggacatgaagatactaccctaaaaagcaacttttactgaaaagtcttatcaattcaatggaccaa

SEQ ID NO: 35087 - DNA, 1055 bp, Homo sapiens
agaattgtttgtatactttgaatattggtcttttatcagatgtgtcttggaaatatattctaccaatctgtggcttgtcttctcactcccttggcattgtgtttcagagtgcagatttttaatgttaaaaaaaagtctagcttatcaattatttctttcatagattatgcctttgagtttgtatctaaaatatcaccaaacccaagatcatctagattttctcctatgctgtcttccatagtttttgttttacatttaaaccaatgatccatcttgagttaatttttctgaagttcttaaggtcttttttttttttttttcgcttgtagaagtccagattcagcacaattatattgtctttgctcctttgtcaatgatcatttgactatgtgggatctatttctgagctctctattctattccattgatctatttgttctttcatttatagcaaatctggaaactgctgatttttatagtaaatctggaagtcaagtaacatcagttctctgacgtcgttcttcagcattgtgttggttattctgggtcctttgcctctccatataaactttggaattagtttgtccctattcacagaataacttcctatggttttgttgggattgcttctaatttatagatggaaagaactgacatcttgacaatatcgtgtctttttatccatgaatatggaatatttctccatttatttgattcttttatttttttataagagtttggtagtttttctcatatagatcttgtacatatttgttagatttgcctatgtattttattttggggggtgctagtataaatggtaatgtatttttaatttcaaattacacttgtaaattgctggtatacaggaaagctattaactttcgtatattgactttttatcctgcaactttgcgatagttgcttatttagttccaggagtatttttgttgatgccttcagattttctatgtagatgatcatgtcatgtgtaaacaaagagagttttgttttatttcttctttacaaatttgtgtaccttgtattttctttac

SEQ ID NO: 35088 - DNA, 1032 bp, Homo sapiens
agctacttaagaggctcaggcaggaggatcacttgactccaggggttcaagatcagcctgggcaacatagtgagaccatctcaaaaaataaaaattaagatgcacttcaggtattgtagcaattagtcacaaatttgtcattttgacaagctttaattctaataggtacaatctgttacatcatgtatactgccaaaattatattatgcaaataactagaataaagttttaacttacaattatatttcttagtttactttaaaatattaagaaatgatattaaaaggaagaaaagcaagagtccactaggtattgccctctttttattttatatatatatatatatatatataaataaaatatttggatcaaaactttcctaatgtttaaacaatttgacgcttatttttcacacaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgtaagtattactttttgctgtactacttttttgttgctgtttgctttaattgtcctacctcattcttaaaagggcaacttatgtatattttctttatttgtatatgctttaaaaaaattgatttgataaaacgtgttcttcctctaatgtattattcttccttatcaattcatactgatcaaggtaacgaaatcttgttgtataatatttagtttccacttgtgaaatcttgaatcctcttactattgtcctctttttcttctccttctcactgcttctgtaagaactgagccttttccacgagtagccttagagatcgtaagacatgagtctgtttcaagctatgggcagcaactgtggtaaagtcatagacaagcctggccagctactttagatgggcctcatgtgctt

SEQ ID NO: 35089 - DNA, 1061 bp, Homo sapiens
cctccacacatttgcacaactgtataaagatatttgtaggatattctttgcaacaagttgcaataatgaaataacacaaacaaaaacagggaaaattctaaccatccattggtaagggactggttaaataagtgcagcacattcacgtcatggaattctatgccacaaataaaaaatgtggtagagctatagtgctgatttgaagggtgaagtgtcctgttagggaacagggtaagttcaggaatagtgtatctagaatgtattgacatctaaaagtagcttagagggtgagaactaggaggcctcagaagagggtggaagatttttacctcctgccctatacctttctatagcatgtggatggtactactctcaatgtattatttttatttttctattgataaaggacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggtattttatttttaagttatctcagttactgagagtttgaatcaaactttttgtgtaatgaaacaagatatgaattaccctaaaattgaaggcaagtgaagacttacttgcctactcaatttagaaactatcattgatctttttatatctactgataatcctaacttattgtatgattatctcaagatccaagaacttcaggagaaagaacatcaacttcttttttttttttttttttttttttgagacagagtctcgctctgtcgcctggagtgcaacggcatgatctcggctcactgcaatgtctgcctcccgggttcaagcgattctcctgcctcaagtctcccaagtaactaggattacagatgcatgtcatcacacccagctaatttttgtatttttagtagagaggaggtttcaccgtgttgaccagggtggtctcgatctcctgacctcatgatccacccgcctcggcctcccaaagtgctgggattac

SEQ ID NO: 35090 - DNA, 1050 bp, Homo sapiens
gaaaatgaataatgagcagtttgtgatccaaggtaggcctgagggttcaagatgactttccttgctgtgaaaagtatcctgatcttttccctttaaaaatttatgataatggccagtgggatgcggtggctcacacctgtaatcccagcactttgggaggccaaggcaggcagatcacctgaggtcaggagtttgagaccagcctggccaacatggtgaaaccccgtctctactaaaaatacaaaaattagccaggcatggtagcacacacctgtaatcccagctactcaggagactgagacaggagaatctcttgaacccaggaggcagaagttgcagtgaactgagattgcgccactgcactcccacctgggcaacagagtgagatgccgtctcaaaaaaaaaaaaattatgatcataatctcctgatagtaaccttggtattttatgaatgtcctaagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaagtaagtttcgtattttcctcccattttaacaagtgtcttataagaatcaaggcttgtgtttgtgttatagttataatgtttgtattataattatgttaccagtttttttaatgtctcttaatcatgaaatgactagaaacagaacaattaaaaattgctcttgaataccaagaaggtattgaaacagagagaagatgtttcagagaaaagaactgttttcttaaatattcaaaaaataatttagaaaaaataattctaaattacaagaaagggtgaaaccaaatatgagattgtttta

SEQ ID NO: 35091 - DNA, 1050 bp, Homo sapiens
ttgtgcattttaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacagtaagttatacccttttccttcatctattaagtgtttcttttaaaatctgagccacttggaaagaggggagcaatgttggaagaatattacaatattctttaaatttcactcgccaagggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagaggtatgtcttttattcctttcatcctttgtcacttcttccttcctttctcctttgaaggaaagataagcagtaagaagtagctaggatgtggttcattaattgactgggtaagtatttgtcgagtgtttaatgtggcaggcacactcctaggttatagaaatgcaatgagaacaaggtggacaaaacccctaaaatccctctgatccatttgtagtgaaagaaagtagctgataaataagcaatcaaatgaacaagaaaacattaaatagtggtaaatgctatggagaaagtgaaacattgggattactgggccaacctgtattaaaagcctactccatgccagacattgagactgtagatataaataagacattgttctttccccccattataaactagaaagaaaatcccttaattccaatatggtaaatgcagaaatacgcaaaattacatggtaccactaatttatca

SEQ ID NO: 35092 - DNA, 1031 bp, Homo sapiens
cctaaatccagaaatagcacatacctcccaaatgaacatatttcaatgctagtattttggacaattttaacttacactgagatctaaactaacataccttatgaggattatattattccagagtctttaggtgagagagggctttgtatcatttaaacaaatcatatgatgtattcattcatcaaatatttattgagcactgtcatgggccacgcactgttttgggcacttgagatatattagtcaacaaaacaaagattctttccttgcagagatgcattagtcattttgaaatgtaagatttatcactattaccatctcttagatgtttgcagtttcctgaatcatttcttatatagaagttaggtgttattgggatatttgtgtaagagctaagacccctgtaacagctgtagttcccaagagattctaaaatgcacccatagagatctttctatataagctaagggcagtgccacttgcataatagataatatagtacggttctgttattattctgtggaatattttttcttttttctttcctccttttttttttgagacagggtctcactctgtcacccaggctggagtgcagtggcatgatcacagctcactgtagcctcaaccccccctgggttcaggctgtcctcccacttcagcctcccgagtagctgagactaaattagctgtgccacaacacccagctaattgttgtatttttggtagaaacgaggtctcactgtgttgcccaggctggtctcaaactcctgggctcaagcagtcttcctgcctcagccttccaaagtgctaggattacaggtgtgagccatcatgcccagcctgtttttttcttaatatgtgttttcttttaattctgatccctttcactatctcacctaattgagtttactaaaaccttatgtctatttcatactcctataaaaaaggtaaaatcaatagcctgtgaaggttaatgtctcagtatttgggggagccacccataagcatcttattggaagtgaaaataa

SEQ ID NO: 35093 - DNA, 1070 bp, Homo sapiens
atatttctagtatttttaaataatgaggtgctttgttgcgatagcttgaacaattgatctcagtcctttctaactgttgggtgattctgaagcagtgaaccagtgcccttttttttctttttctttttttttttttttttgctttgctttattaactattggtttgctctgttacctgttcacatgctcttacagatgcaactaattcatgaaatttcgaacttaaagaatttagttaagcatgcagaagtatataatcaagatcttgaggtgagcattcatgttggtatttctattgataagcaattagaactataaaacatgcaacatatgtaactgaacatgatgtcagaaataagggaattatgtttttaaaatattagtgactttgaattttactatgaatttaaactaatatatataagttctgttttaatcccttagacttcaaatcagattctaaattgttactctctcctttgattcttttagaatgaactcagttcaaaagtagagctgcttagagaaaaggaagaccagattaagaagctacaggaatacatagactctcaaaagctagaaaatataaaaatggacttgtcatactcattggtaaaaatcaggcgtattttgttgtgtaatcacataaatatatatagcataccatcatcttagcaaatgcttatactggacctactttgtgctgtgtattgttgtaataaatttatatatatttcattaaatctgtcaataaccctatgagatagggactgttagtatatttgccattttagagataaagtcacatttgtggaaagttgatcatgtcatcctttgagtaaatataaggaagttaaggacaggctcccattaaaaatcagtaagttttaggccagggcacagtggctcatccctgtgatgccagtactttgggaggccgaagtgggagatcacttgagcccaggagttcaagaccagcctgggcaacatagtgagacctggtctgtacaaaatatacaaaaataagcctggcaggtactgccagctacttgggtaactgaggtggcagg

SEQ ID NO: 35094 - DNA, 1027 bp, Homo sapiens
ttttttgctattgagttgttttagtttcttatatattttggatattaaccatgtgtcagatgtatattttgcaaatatttctgcaaatattgcaaatattttgcaaatatttctgcaaatattgcaaatattttgcaaatattgtctctttattgatgatttcctttgcctttagttgtaattccgtttatttgtttttggtctttttggttgtgcttttaaggtcttattcaaaaattccttgtcctgaccaatgttatgaagcatttccactatcttgttttctagtagtttcatagtttcaagtcttagaatttaagtccttaactcattctgaattgattcttgtatatgatgagagacaggagatctagtttttcttcaacatatagatattcattcagttttcccagcaccactattgaagaaagactatcctttccccaacatatgttcttggcacttttgtcaaaaatcagttgactgtatatgcatggatttatttccgcgttctctgttctattggcctgttgtctgtttctatgccagtagcatgttattttggttactatagttttgtaatatattttggaggcagatggtatgatgcctccagatttgctctttttgctcaagattgctttggctatacagggtcttttggggttccatacgaatgtgaggattgtttttaatctacttttgtgaagaatgtctttggtgttttgatagatatcgcattacatctgtggatcactttgggcaatatggacattataacaatattcttccaatccatgaacatgcatatcttcccatttgtgtcttcttcaaattctttcattaacgttttatagttttcatttgagagatctgacacctccttggatagtttgccattaacatatagagatactacttttttttatgttgattttgtatcctgcaactttactgagttttttattagttgtaacagttttggatggagtccttagggttttctgtatataggatcatatcatct

SEQ ID NO: 35095 - DNA, 1057 bp, Homo sapiens
gtatttttaaaaatctctaaagaaaaaaactaataacagtggtttcctggtagaggtataggaactggttgaatggggataaaagtggaagggagctttttcaaagtgtactttttttttaaactttttgaaccgtgtgagcatattaacaatttaaaaataagaaattagaggctaatttggttgtaagttcatagttgcctatatttagatgttggaaaaaaattgatttgaactgaagagctagagaagctctttcaggaaacaggttttttttccctgcattcttccctccctcttcatttttttctttttactatttttctcaggtaataacctttctgattcacttgaagtgggaccaatagggagagagctctttctaccactgatattaaagatgggctcatgtctaaaccagagcatagactttagcatctgccctctaatttctctcattaacttagtgataaataagtttatcatctagaaaaggagtcaagtttagttttcatatttgtttaataaattcaggtgtgcggctcaaggaaggctgtaatataaatcgaagcttatttattttgggacaagtgatcaagaaacttagtgatggacaagttgggtaagtttatcccgttgtgcacttacctactgattcttatatttttcattaggttgaacattgcaacatttcgatgacactcaaatgtactgatttcttccatatattcaaaaacttatacatatgattataatctactgaatttactttctgttttaaatattttttagtagttttaatctgcctcatataacttgtaaactaatttttgaaactctggctgatttaagagttctgcattaaaaaccaactactttattatataaacgttctcaatctttttctcctgtaaacttattccttgctaagtggtttcataaattatcgagatagcaagttaacacgaattctccagaattccttgggaggaaatgcaaagacacgtattatctgcacaattactccagtatcttttgatgaaacacttactgctct

SEQ ID NO: 35096 - DNA, 1048 bp, Homo sapiens
ttatttgcataattcagttagtggcatatttttataacaagtagattaactgactaaacatgactgcaaattatttttgtaaattaaattacagtagctaaagttgacttattttatgcatgaaaccttatgaatatttctgattgattttagaacatcacttacccctaaaattttagtttcagatttatctgccacattatgtctccatcctggtacttttatagaaatataaattacttttaaacaatgcttatgtacagcaagtgctgatattaaaagaataatacattatatttgttaaatcagaaactccctgtcagttaatataaataagtattatattcctgccttgtgagtttatagagaatgcaacctctaaagcaaggcccaactgaaatttttaaagtcctttttatcctccatggaaatatactgatgttcacacttcaaaagtaaaaaagttcaatggagagaattttatattgctgtatagtgaataaaagaccaaaaaaattctgacagcatctctaaaatcacctgagatttccttgaaattttatttcactcagatgatagtcaggaaaatgtttaggtgctgctatgtgatatttacacatgcattcacttcatttctatcagtaatccttttaaagcccttagttatttccgtagatacccattcataataagaaatagctatttttaaataaccatcccaaggcaagaggataaagtagtcacaacagaaaatactagacttttgtggcctaaaataaataatgtgctctaaatttagaaaataaggagatgaaactaaaatgcatattacacatcgtttgtctctttatgtatttacctatgaatgaaaatattcctggtaaaatatttgtcaaataactgttatcagggtagaggatttttatttatgtatttgtttaattgtctgcctaaaggtaatgaaaaatggaagaaatgtgggtggatgaatataaaaagggaagagatggcttttccaaatttgcactaatttttaagtaacaggtca

SEQ ID NO: 35097 - DNA, 1139 bp, Homo sapiens
tctgaagtcagattatctgagtccaaatctcagttctttaatttataacctgaaacaaattttaatttatttacatctttgacttcttatttataaaatggggcttataataatagtatcttatcaggctgttgtggagaattgaatgagctaatccaggtaaaaatgtccagcagataaggtattcaataaatgttgggttttattgtcattactgctataagtgtagttgagttaaatcgatcaaagagagagaaatcccttctattccagcctcttctttccaatacttctaatgatgaggatatcactcctttatgagttgacccattccattgttgggtattggaaaagtcagccttactaatttttctagacatatgagaattagtcctactttcagagactttaataggaagaaagggaggaagaagaggtggaacaagtggaggggaaaagtagttggtttaaccactcttcccatctgggaattcttttccccaaaattctcccatgtgctttgtttaagcactttcctctttgaggaaatagaacactctaggcattatgcaaagttggggaaatatgaattaaacaatgtgtgaggttctctaatacttggtactgtagtcattttactggaaaaatgatcgaactttatgaggctccacacacaaactggtggcatacagaactgaggagagagccatattcagtgctaaaggattcccagacttgcttcagacatgtgcacagcctaactccagggatttaaaactcttacaatctagaattcaggccaagaagagtaagtagctatacacttgctcagttctagggaaccagacccatgccactgtgaacctctagctcatagtagtgatggaagaagttcaaaagcttaatgacttctaaaactgagcagatagaatgcctcccagagaggtctcagcaccctcagtctgactgtttttgcctattcatcgacagatttccactaaaactagtctcggataaacctggagcacacaagactcagagatgatagtgatgatggtacataggatgctaaatggatggtgttttgaagtaaaaaagtcaagggggaattggaacttcaatataaatgtattatttct

SEQ ID NO: 35098 - DNA, 1035 bp, Homo sapiens
ggattttacccatagttcctagtttgccaacccctgatatagattatccctattatattctacttcatagatgaagaaattgaggcttagcaagcttaagtaacctgcccaaagtcacacagctgacaaataaggaagccagaatttataccaagctttgcctgactctggagctcatgctcttaacaattaactgtcatcacaagattagttttgtgttagtgtaacaatgtgactgatattaaatacgtctttttttatttgtttgtttggagctaggcttttgctcttgaagttattaaatccactcatcaatgttggaaagcattgcttatgaagaagtgtaatggaggagctataaattggtaagaatttgtcttttctatgtaagtaatgttatattaattggtattaaacagccacataataatcagatttcagatttttgcattttttttaatttaaacaatacagattatctacctattcattgggcattactaagtgttgggcactattaaactaggaattgacgtgatcttttttctcaaggaatttataatttagtgggaatactgataaataaatggacatttaattgaaatacattgtgcaaagatgaaaaacgcaatttttcagcatgtaaatctatgcggtttctttaaaatctaataactaccatataatttcttagaaagtaaaagcctccttattcatcatgatcactaattgattgattaagaggaattaagtaacagtaacataaacatttaatttaaaacatttaaatgtatattcacccatttttggatatagggctgagccccttttaatatagattccatatagattttatatacactctaacataacacaggatagaaaataaagattctgtaatccttaagctccttgtaacttaaaattcctgacagatttttagggttcttttaaaaaaatcatttaaattatgttatctacaccaaatttttgtagtgattcacctttattgaggctttttagggcctcagtatt

SEQ ID NO: 35099 - DNA, 1076 bp, Homo sapiens
ataagaaaaccgttcgttcaaggaactcaatattaattaatttttgcaaaacatccctgtttgttttgttataacaaaacagtataattttaatatgctctaataaatatattgtatacaatacaatatgctgtgacaatatactgtaataaaattaccagcaccactactctcgtgctttgtggccattctgaagcaaaataaaggttaactgaacacaagcactgccatatcaagacagtggatctgctaactgagaaggctactaagtgactaatggtgggtagtatatagaatgtggccacactgggcaaagggatgattcatgtcttggacaggatggagcaggacagtgcaagatttcatcaggctactcagaatggtatgcaatttaaaacttatgaattgtttatttctggaattttccatttaatatttctggattcagttgactgtaggtaactgaaactgcagaaaacaaaaccgtggataaagggagattgctgtgtatatgatcctcagtgactggcttttcctaggtgtctcctccctctcccctgcctcctaacagtgatgttctatccatgcagaaccatctttgtatattctaaaatatagtcccttgcttttatgtgtgctgttccttctaccttttcccctcttgtccagttagtgatgtacttctcacttttataatgctttcttttactccctcttctatgacattaccattgcttctgtttatctctgttaaaacctcattgcattttaattgcagtttatctatttgtctctttccctgagttaaaaactgagtatcttgatgaaaagaactttgttgtatccatccatttattccccatacatagcacattgtctgaagatgctttgtaaatgtttgtagagtgcaggaatagtattatacatatgaaaacacaaaagtctgaaggtgatatacatatcaatgatgatgctgctctaggtatcacaatcaattgtgcttctggttagactgggccccatgtttcctggctccctcagtccaatgctctgccactaaagggaattaattttgg

SEQ ID NO: 35100 - DNA, 1048 bp, Homo sapiens
tcttctgttagtaaaaagacctaaattatcttcaaagttagtgctgtgggaaacccagtttaaattaaaggattagatgatttcttggggacattggcacgtttttaagtgctttagggtaactgttaagtgatgaagctggaagttcaatggaggtcagtctgacctgagacctgtgcatttagccactttgttatatgcttcaaatcaaaattagattagaaatatttgaattccttccatatacaaggcagctgtatggttttcattttactggtcatgtgaaattacttgtaaactggtaatgaatgtctatattttgagaaaaatctaagtcttttctgagaggtttttctgctacagtgcatatagtctctatgtagaattaccttgtttggtaatactcactttgacatgtgttaattccattattttttcatgatgttaatacacatttttagtacaggttttgtcttggtaagagtacaatttatgaaaaggagaatggagaaggaaagggcaagaacaatgaaagatactcttcattagcccatgaatgttaaacgtagatatgcagaacagtttggaaacatgaaaatcttttagagattctgagtaagcataaattattaagaaaatcagttctctttgcagggacctctatttgtgatacagaaactacaatgaatgttattaaatgaaacttgtttcttgtgaatgtttataagtcattaaaaacacatgttcttgcttcccacagagtttctttagagggtactagttgtgcacatgtttagttctgtgggagcaacatttatagtactgggatgagagtgttgtgcaaatgaatcaacatcacttcctttagtaaagtggaaactcctttttcatttttcttttttcctcccctttggacaaaattttagcataaggctatatcctggtgtcttttttccccttttatataataagggcaaagagatagggtattacttttatgtcactggtttttatctaaaaataaaaaattctcagccgattgtatgct

SEQ ID NO: 35101 - DNA, 1033 bp, Homo sapiens
cctgtcacctctctttcactttcttcctcttcctttcactccttccttccctcctttcttctttccttacttccatgattttgatggtccaactgctgttgggaactgttttgaaagcatcctttgactaggaataaaagcatacgatactggcatttttaccctgaaatctcttttgttcatatgactaacaagaagaaactaaggaaggagtgttcatcgatgacaaaagctatttctgcacctagtttttgtctcttcttgtacaaatgaagggaaaagtaactgccctctaacgaaattttgatgtcctagaaattttaagttctggaaatagcttggcatgatttaattttgtttggagtcagacagacttcagtttaagttctggctgtgctacttcctggctgagtgactttgggtagatcattcctgaatttcagttgctcatctctaaagggagatgattatacctacttgtaaagttgttggcaatataagaaacgatttatttaaagcatctggctttcacataccagtgttgaatatatgacaactattattattctttgaccaatttttcctctatttttctttcctgttttattcttgctcaggatcctctttacttgtaaacctcgattctaaactggaagatattaccatttctaagatgactgaacctcattaacaatgtattaatcttagtttatgtacctttttttgcacttgaaacaggaagagatttcttttttgtcattcttgtatataactgagaaagggagaggtctgatagcgtgaagtgcatgtaacctcaggatcaaaagtaaaatgtgaaaactacaattaaaatatgagctcaagtctataaaccatatatattccttatctcattattttaccctgattttttctatttttatacttttcatatacatatatatgagaacagtaaataaattttatttagttaaaaacattttttagcatcttaactgctcctcaaatgagaattgataaggtaatagtccca

SEQ ID NO: 35102 - DNA, 1113 bp, Homo sapiens
catgtccctaatctagatccaaattacctcatatctatagtgttatagtcttctgatttgttagcctctatcttgtccttttatcatattagagaacctaccttgacactctgttgcctagatcagggcagtggcattggaaatgaagaaggcacagctatgagaaatgatgcacgtagtgttgatattacatgtttaaactcacatgtgttcggtcttatatgctgttcggccctggggtgtctaagtcacccaaataagattgtaaatccttgagaacaattcattctttctttaatacacagtgcctaatatagagccgagtacttaatagaggctaaacatgtgagtgtctaatataattgtgtatattcccttggaattcagatttcagtttagtttatacaatcactttagtcagttgtgttaactaattacaattccatgcagatttatgttaagattttagaatcaacttccaaatattctgacaggatttatttgactttatgacttgaaattctagtattttttccctcaaaataaataatttcaggacacagaagtgacttttttctacataccttgttttctaaatgtaaaactgcattttgaattctgagaaatttattctgaagcatgtgttcaaattccaggtttacagtgaaaatctatagccaactaaacctttaaaagtaaaaggatatatacaaagaatgcatgcatataaacttgacgttggcagcttgagggaacctcactgaaataactttcttaagcacatggaacatctgcttaagtcacgctatttctgggtttctcttaaaatatttttgaaatattttatgaaacctgttttgtcaatatcatttattattttcttaaggctttactctattatgttttacttttcactagtaaccgataaatgtggtttgttaaaaaggtactatgaagcaatgtaaaaggattctcaggtctcttttcccctcaagcagcaggaatcaagtttatattatgtaatggtacatacaggtttattttctatttagtgtgagtgtctaggcctagtagataccttaaatttcaagatatgtaaataacttcagtttc

SEQ ID NO: 35103 - DNA, 1051 bp, Homo sapiens
ttgtgattaattttttaaattgaggtacaattcacataaaattaaccattttaaagtgtacattaaaattagtggcagttaatacattcacagtgttgtacaaccatcacctgtatctatctagtcccaaacatttcatgacctcaaaaggaaaccccatccccattagcagtcactccccatttcattctctaactggcccctggcaaccactaatttactgtctctatactataggtttacctattctggatatttcatgtaaatggtctcacatgatatgtaaccttttgtgtctggcccctttcacttagtgtgcttttgagattcatccatgttgtagcatgtatcagtacttcattcctttttatggctgaataatattctgctgatggataatattaccttttacttatccattcattagttgatgggcatttggcttgtttctaccacttggctattatgaatagtgctgctatgaacattcatgtatgagtttttgtttgaatactcttatccatttttttcacctaggaatggaattgctgggtcatatggtaattctgaatttactctttgaggaaccaccaaactgttttccccagcatgttaactccaacgaacaatattcaaggattccagtttctccagatcctcaccaatactcattattttccctttttgttttttaacaatcatcctagtggttgtgaaatggtattgtgatttttttaattaaaacaagcttacgtctgattttatcttaaacaaatgtggataattattttatccaataaaataatgcatttaaaaaaatagttttagccataaatgtgaagtagatttttttctagctttgttgagttataattgacatataataaactgtacctatttaaagtgtacacaaattgatgatttttgatataattacatgcaaaattattatcaaaaataagaaaatgaacatatttatcacccccaaatgttttcttacacttctttgtaatctcttcctttgacactcccaaccctctgtcctcaggca

SEQ ID NO: 35104 - DNA, 1021 bp, Homo sapiens
agtggcattaagttctttcacattgttgtggaatcctcatcaccatccatctccagaactttttcaccatcccaagctgaaactctacacgttgagcaacttctcatttcctccctcccccgaggccctgggaagcactattctactttctgtcttatgaatttgactgttgcaggtatttcatttccacttcattttacaatgggaaaacctgagagaattagcacaggaacccagattttaataataagttaattatcttggtagatggtctaaagtaaatgtacttcattataaatgaaatatttcactttaaattataagagagaagatggtttgagaggctgttttagaacccaggaacaataatcttttgggagtagaggagaagaaaaacacttataccaaccgtatgctaaaatgaatatattctaaatatatatattctaaatgtatgctaaaatgaatatattctaaatatatatattctaaatatatctaaacaaatatatgtggctgtcaaacctttaatagttcttgacttaggaccagaacatttgattgatgtctgtcattccatctcctgctacaagtgtccttttatccctctgattctgatgccaggcagcttttcctgctgctttcctgtctccttttacctttccagcttcatttccatttattctctaccccaactgaaacttacagctccagcatttgaatctacttccaaacatacctgtgggggcctttaaattcctacaacctttgcctgctatctgtcttctatttttctaagctggtgtgattcttgaaccatctacactggaaccacttagagtgcttgttaaaaattcagattccgtgccccatctcctatttactaagtcagattctccgctggatagggcctggttaatctaggtatttcacaagtattctaggtgcatcctaaacgtgaagtttgagaaccactgccctagatgttgagtgaacaagggtttccagatccccaggggac

SEQ ID NO: 35105 - DNA, 1032 bp, Homo sapiens
agaacaatgtgtctattgctttaattctgttttgttttgtttgtttgtgtctttgcagagaatgtaactggtcactacatttccccctttcatgatattcctctgaaggtgaactctaaagaggtattgttttgacttgttttgggaatgaaaacgtgtactgccagtatcaccattagatgctttttggaagcaccttgaaaggaaaaagtgttgttggaagtcaggaggacaaacaggagttactataacagggtcataagcctcctatatgaattaaaagttgtatgagaataggattcttccatgaggaattgggagaaaggggtgttactggtacataaaacttagaattcggtaggaaataaagatttaagggtagtaatttaggaaattaccaagaggtttatttacaataatcagctaacgtttgtggattattttttatttgctagccactatgtgaacatgatgttatttaattgttatgagttgctatttttctttccaaggacactgaggctcaaggcatttttatagacttgtctaagatctggtaagtgccagagctagttttggaattagcttctgaccacaaagcttatgctctttaaccactctatgaaacaggtgttagagaaataaagcaggggtaaaaatggtggtgtttgaatagctgttctcttagaactgaaaatcacttgacagttgtcagggtgtgaaagatgccaggagaactgatgctatcaaatcaaaattgttggggtgtttcgagatctctcatgattagttggtaatatggcatatttggtagtattcatgatcatcattaagttgtaggttatttccttaaaatccaagtagtgaattaccaaatttttaagggggtacaactattaagtaaataaccaggaccacattccatgttgaaattatatgtaactcgttaatttggggttgggttttctaggatgtggggtgatcaatataggggcagaggccactgaagaactgaggaggctacttcagatg

SEQ ID NO: 35106 - DNA, 1036 bp, Homo sapiens
cccttcccccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggtatcagtgttatccagaaccaagaactcagtggaggaatgaaaaaggcagcatctttaaaataatgttt

SEQ ID NO: 35107 - DNA, 1035 bp, Homo sapiens
taacaatattaatcttaaatgtaaatgggctaaatgccctaattaaaagacacagactggcaaattggataaagagtcaatacccatcactgctgcattcaggagacccatgtcacgtgcagagacacacataggctcaaaataaagggaaggaggaagatctaccaagcaaatggaaagcaaaaaaaggaaggggttgcaatcctagtctctgataaaacagactttaaaccaacaaagatcaaaagagacaattaaggccattacataatagtaaagggatcaattcagcaagaagagctaactatcctaaatatatatggaccctatacaggagcacccagattcataaagcaagtcctagagacctacaaagagacttagactcccacacaataataatgggagacttcaacatcccactgtcagtatgagacagatcaacaagacagaaggttaacaaggatatccaggacttgaactcacctctgcaccaagcacacctaatagacatctacagaactcttcagcccaaatcaacagaatatacattcttcttggcaccacattgcctttattccaaaattgaccacatagttgggagtaaagcactcctcagcaaatgcaaaagaacagaaattataataaactgtctctcagaccacagtgcaatcaaactagaactcaggattaagaaattcactcaaaaccacacaactacatggaaactgaacaacctgctcctgaatgactactgggtaaataatgaaatgaaggcagaaataaaggtgttctttgaaaccaatgagaacaaagacgcaacataccaaaacctctgggacacatttaaagcagtgtgtagaaggacatttatagcactaaatgcccacaagagaaagcaggaaagatctaaaatcgacaccctaacatcacaattagaagaactagagaagcaagagcaaacaaattcaaaagctagcagaaggcaagaaataattaagattagagcagaactgaaggagatagagaaacaaa

SEQ ID NO: 35108 - DNA, 1077 bp, Homo sapiens
actgccagggcacctacctatggccccctgccatcctctacagagctattgttttatacatcttacacattagaaaacttagactcaaagttaatctcatttgcctgtgtcagagccaggattgaaacaccagtctgtatgactctataaatcacacccttaactcagtgagctccgaaggcttttgagtgtgaatgctgccacatatcctgttttctaaaacaggcttattctgactttcacagatcacagtgttctcccagtgtgtgaaagcaagacctgaaataaacttttatgctgtatgtgctaacatgcttagggctctattttcataaaacattaacaattttaaagatgatatctaataaacagaccttgtataattatctttttaagattgccaaatgttttctaatatcttactcattgtactaaaccctaggcttctgttcattttaattttaccataaaggtaaaaacatatatataagtcaataggtaactcatttctttcattaaataatcaattaaatacgtcatctatgatgtacaaggcattgtatagaacactatattgccaatcaaagtgctagtaaaaataaaagtttaaaatgtgaaggcaatctcgaagcatgactattcagattatttattgctactagtatcatatatttttattaaagagccatcacattccaaataagtcagtcaatatcatacttatcagaaaccagatgctatgataaataattctttcttcttcacgtcctccatactcaggcatacttatagacaattactgaacaaattatatgctcagctagtatgcttcaatccaacattaggaaatcgtttcaagaaactgttttaaacatttttatagcaatgtatctttaatacttttctcagcatggggcagaagagaactttacatatttacttgcatgtactttacatctttttgtctgctgtacagatctgtaggcctattgtttttccttcccactaattttgaagtgtctcagtttaaagcatatttgttggaattatattatgtatccatggttgtcctggata

SEQ ID NO: 35109 - DNA, 1037 bp, Homo sapiens
acagacacttctcaaaagaagacatttatgcagccaacagacatatgaaaaaatgctcatcatcactggtcattagagaaatgcaaatcaaaaccacaatgagaccatctcacaccagttagaatggtgatcattaaaaagtcaagaaacaacagatgctggagaggttgtggaaaaataggaatgcttttacactgttggtgggagtgtaaattagttcagccattgtggcgattcctcaaggatctagaactagaaataccatttgacccagtaatcccattactgggtatatacccaaagaattataaatcattctacaaaaaagagacatgcacacatacgtttattgtggcactattcacaatagcaaagacttggaaccaacccaaatgtccatcaatgatagactggattaagaaattgtggcacatatataccatggaatactatgcagccataaaaaagatgagttcatgtcctttgcagggacatggatgaagctggaaaccatcattctcagcgaattatcacaagatagaaaaccaaatactgcatgttccccctcgtaagtgggagttgaacaatgaggacacatggacacagagaggggaacatcacacattggggcctgtgcggggtgggggctaggggaaggataacattaggagaaatacctaatgtaggtgacgggttgatgggtgctgcagaccaccatggcacatgtatacctgtgtaacaaaactgcacattctgcacatgtaacccagaacttaaagtataataaaaagaaggaggaaaaaaaacatactactagagaaaatcacctaaccacaaaggaagactttaagagaggataaaaggaagaaagtgtctacaaaacaagcaaatagcaagtaataaaataacagtagcaaattcttacctattattaataatcttgaatataaataggtttaatttatccaattaaattaattatccaataaaaagagctagaatggctgaattgatttaaaaaaaaagacacaactata

SEQ ID NO: 35110 - DNA, 1041 bp, Homo sapiens
aaaaatattctaaaatttatatggaaccaaaaaagagcccgaatcaccaaagcaatcctaagcaaaaagaacaaagctggagacatcacactacccaatttcaaactctactacaaggatacagtaaacaaaacagcacggtactggtacaaaaacatacacatagatcaatggaatgggttagagaacgcagaattaaagccacacacctacagccatctaatcttcaacaaagttgacaaaaataagcagtgaggaaaggattccctattcagtaaatggtgctgggatagctagctagctgtatgcagaagattgaaactggagcgcttcctttcatcatatatgaagattaactcgagagggaataaaggtttaaatataagaccacaaacaataagaatcctagaagaaaacttaggaaacaccaatctggacctgggccttgggaaagtatttatgactaagtcctcaagagcaattgcaattgcaacagaaacaaaaattgacaagtgggacctaattaagctctttaagcttctgcacagcaaaagaaactatcaacagagtaaacagacaacctacaaaatgggagaaaatatttgcagactatttatttgacaaaggtctactatccagagtcttaaaaacaacttaaaccaacaaggaaaacacaaatgacccctttaaaaatgtaaaaagtacatgaacagacacttctcaaaagaagacatctgtatggccaacaagcatatgaaaaaatgttcaacatcactaatcattagagaaatgcaaatcaaaaccacaatgagatactatctaataccagtcagaatggctatgattaaaaagccaacaaataacagatgctggtgatgttgcaaggaaaagggaacccttatacactgcctgcgggaatgtaaactagttcagccactgtcaaaagcactctggagatttctgaaagaacttaaaacagagcttccattcaacccaacaatcccattactaggcatatacccaaaggattataaatcattc

SEQ ID NO: 35111 - DNA, 1102 bp, Homo sapiens
tatgcaccttttactcataaattcataattgctaggtgctgaaataatatttatttaaactaaccctgtaggtagtaaagaagtctttaatagcagcctgtattaactcataaagtgaaataaaattagtgctttttcagtaaattattgttgatttttgatacttgctattgacaaaggagatttttactctacttttataaattaaggatgatttgtcacttctaaaaccttctaaaatttgaaaatgtatatgtctatatgtgtgtatatagaacgatatatactatatatatagctatatatgtgtgtatgtatatatttctaggtagtaaacttaggagaataaatttgtcaaattattaataatggtaatattagatcttattacttttagtctgttatgaagcatcctgttaattaagtggtaacaaaaagcacatgcttcataataccttttattgagacattttgaacatttaaaaagtatctaattaattcttaaaaatacaattaagagtacctcaaaacttatgaggactgtattagggttctctagagaaacagaaccaataggagatatataaacatagatagaggagatttattatgagtaattggctcacacatttatggaggctgagatatcccacaatatgctgtttgaaagctggatacccaggaaagccagtggtataattgagagtctagaggtgtttgtaattctgattccaaaggtctgagaaccaggaagctggtgatacaaatcccagtctaaaggcaggggaagattagatgaaatgttccggctcaagcagtgaggtagaaaagaagaggcacattcctccttcctctacctttgttttgttcaggctctcagttgattacatgatacctacccacactggagaggacagtttactgagtccactgattcaaatgctgatcttatctggaaacaccatcacacacaaacacacacacacacacaaacacacacatttaaccagatacctaggtatcacctgatgcagtcaattaactaacacaaggatctttaaaatctcagaaatattctgtacaaacctgtaaagtaaaatat

SEQ ID NO: 35112 - DNA, 1044 bp, Homo sapiens
tgtcacctaggctggagtgcagtggtgtgattatggctcattgcagtctcaacctcttgggctcaagtaatcctccctcctcagcctcccaagtagctgggaccacaggcatgcgccaccagacccatctactttttaaattttttgtagacatgaggtctccctatgttacccaggctggtcttggattcttggctcaagcagtcctcccgctttggcctcccaaagtgctgagattgtgggaatgagccactgcacctggccatgaattttgaaataagtaaggtaaccaagaaaacctcacagaaaagttgacttatgaataaatgctttaagaaagcaaaggaaagagcaaaccaagcgaaagcagcagcagttgctacagccctgatgtggaagcatatcagagatgtggaggagcagccagtagaccattgtaactagagcacagtgaacaagaagataaggtcaaataggtaatagagggccatattacatagttttgttgatcatcattaggactttggcttttattgttagaggtggaaagccactgatgcttttgagcagaggagtgatgtctcatgtaaagattttaacaaggtcattctggctgctatgctgagaaaaatcgaaggatgggcaagaatggaatctaggaaactagtcatggactattgcaatagtctaggcaagagataatgttggctcgaatcaagatattagcagtggaagtagtgggaagtttttatatgctgcatatcttttgaaggtagagccagcaggactactggtgacaaatatacagtgtgtgaggaagagaggagtcaagtacctgagcaattgaaaggggatagagttgcttctaactgagatttggaaactacttggaggtatagattttgaaggaagtctcagaagctcgttttaggatatgtgtatctgttagacatgcaagtggagaaaacaggcatttggatatacagtttcagaatttgtaggagaggtttagggatggagctgaaatagggtcctcaaactaca

SEQ ID NO: 35113 - DNA, 1335 bp, Homo sapiens
ccaaaaatgcaatagtggtattgttttacctttttataatcttttacatttttataatctttttacttgtttaactatatgaagaaaatgtgacctcacacagacacgttaatagtttctcagatagcggtagtttcttaaacttctcagagcagtggttttttttgttttttttgttgttttttttttgagacagagtctcactccatcactcaggctggaagtgcagtgatctcggctcactgcaacctctgcctcccgggttcaagcgattctcctgcctcagcctcccaagtaactgggattacaggtgtttgccaccatgcctggctaatttttttttttttttttttttttttttttgtatttttagtggagagggcttcaccatgttggccaggctggtcttgaactcctgacttcaagtgatccacctgccttggcctcccaaagtgctgggattacaagcgtgatccactgtgcctggcctcattgtttcttaaagctagttgctatgtacagtctaaaaccatgtcagtgaacttctcatactctgttatactaaaatccatcactctatcttgcaatttagatggctcttttactcatacataattttgtagtgtcatgaatttgtcattgaaaaatattggttgctgagttacacagatcttccaactatgaagcatttcattatagaatatttttaaaatcacatttattaatatcacaacaggtcttctccaaaaagtgattaagtattgggaaccgaccaatttcacagtggcagatattagctttccaaaattttaatcttcgcctaaaagctctcattttttcttaaagtaactgtttcactttgtacatttaaaaaaatcattgtttgggccgggcgcggtggctcacgcgtgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaatcattgtttgtctgtcattctttcaaataaacatagtatttcttgcagaaaccatcaatattagctcacagatgattacccaagtgctttacctctttgtacttcagtagatagcacaagtgctttacacttactt

SEQ ID NO: 35114 - DNA, 1050 bp, Homo sapiens
ccagtacgtttggtcgtctggtgagggctgcagtcttctgagagagaaacactgtccttacaaggcagaagggcaagctaggcaattgctatgtgaggtctcacctttataagcctcttaatgccattcaccaggggaagagcccttatgacctaattacttcttaaaggcctcacctcttaataccatcacattggccattaagtttcaaagttcatgaagcctaaactttggagggaacacattcaaaccatagcaatctgtgaatgaaaatttattttacacacttgggatccagttggaagctattttaaagcaatgcttatttctctttaagtatttgctttttcacagtgactaaatttgtataaagtacaaataaaaactttaaaaacatcaaaaacttctagattagcaaacatttgaataaagtatatttctaaaattgatcattttaattaattattttctctctttatttaccaggagcttcctgaaactgtgatagatcttttgaataagtgccttaccttccatccttctaagaggttgatattatttagagattgggattacattgagatcctttacgcataagcaattggtttttttcttgttttaatataatggattaaagataatgtacatatggagtagtatataattgacatcagtatcataactgtgaatgatgtaagctttcattttttgtgaattaatgaaaaagtaattaaagttaaactacggtcagaaaactgacatacactaaagaagttactagttcattttcaagcttttaaatagaatattaactaaactatggaatgtaggtattcctagacccaataataacatcagtgaaatgagaataaaagtttgttgtcaatatgtattatagcaatgaacttggatcagtggtgtgataaactaacaattgttgacaataaaaaaggatttcttagaagtttcattaattgactttgacttgatgatgtcactactagtcatacagctatccctaaattcctttactatgtaatgtttgaaaat

SEQ ID NO: 35115 - DNA, 1035 bp, Homo sapiens
cctttaacaaaatgtagtttgtcacgtttttagggttatggttttgaaaatttaccagaataccattagtattgcagaagttatacgtgaagactttgatgggaagcagactatgtctgcagctgtttactagcctgatggaaaacatgatctgacttactcaaattagtgagttttattttcccctgttaaaacattgcctactcactgaatgagatactcgaaagaatttggacacattctggaatgtggtccagagttgaataatgagctacaggttgtagtaatcagaaatagatgttagatattcttattttataatataaactgataatggatcttgaggctttcatatcttttttacttttgaggaccgtagtttcaaaatgcatttgaaattatggtagtgaagtcatgtgaattagagatttatataactgatctataattctcttcctgttttacatgttttgtttaaagaaggaaaataataccgaaagatgctctacatttagacttgttatcttgcaacaaacttttgctttctgcctctcttgtaccttatatcttactaattgccaagtgttgttaatacaaacttggcaatagttctcacatatctctgtcttatacattctttagtttaaatcttcactaacaaacagcttggctattgcattgtaacgttctaactggtcttcctggcttcagccatacttcagtcctcccactttttctgctatgttaatatttttgaagatcagtccattctctgttcagaaacacttggaggttctccatttctttttttttttcccccagaggaaaaggcatcttattagcataggatctgacttcaatctaattctctcattaaataactccaattactactactgcttctctaaatattactctctaactctcttattatttccaatgtgcctaaattgtacaattagttttaattattcctaatacacattgaggagagtgaatgccaaaattttgaaatttaccataaaaactgaaatg

SEQ ID NO: 35116 - DNA, 1034 bp, Homo sapiens
ttactgtagccttgacctcgcttactgtgatcgctgcttactgtagccttgacctcctgggctcaagcgatccttccacctcaaccaccctagtacctgggaccacaggtgtgcatcaccatacatggctatttttttattttttgtatatacaggggtctcattatgttgcctaggctggtgttgaactcctaggcccgagtgatcttcttgccttagcctcccaggtgttgggattacaggcacaggcatgagccaccatcccccaaccttttttaaaaatgtttttgaactttgaattgtattatataaggatacaatcaatattgctttgccagtatgattaaatcattagctcatgaaaagttttgcatttctgtgcttaccattttttatctttgtttgaaagacgacaaatcttgtggcaatgaacatcagtggtttcttcaatgattttgcttttgtcttcatgaggataaaatagtgtagatggaagcacattctttgaggatgtatattaacatgagtaggattaaatgcaaaatttacatgatcttttatgccagttacattttcttttttcttttaaatagaacatatagtagccttaacaggtctttccattttttccattgagatgtatttaagcatttgtgtaaataaagtactatttttaaattattctgataatagactaaaagtcagtgttttctttgtacattttggaatataacattcagtacttactgccttttagtaggaatgatccttttaggttcagttccaagttgttatctgatccatccatctaaattaattttgctgagaactatttgacttttccacatatttggattacattagtctccagtaacagagcaggtatatgtgtagagttgatgtactgcaattttaatcaattttataacctgtttatagaaagtgagaagatgttcttaaggtttataaattagttctttcctttactaccaaaagtaagcacctgcacctgcaagaagggctgatgtaaacag

SEQ ID NO: 35117 - DNA, 1018 bp, Homo sapiens
gagaaagaagggagggggaaggggagatatgcatggagcagtaaacagcaattgaagacagagcagtactcttgggctttgcccccagtgtggaattctagtgagctggaatcgactacgttgaagacattttttttaatgccaggaagccaaagtagctttgaacccaaagcaggacaaaggtcattttctctttctctaaagccctgatggggtttgaccactcttgtaaagtatcagtaccagagaaaaagtaaaaagagcaaatgagacagttcctgaatgagtattttccctaatgcatatgtagagcagtccaggtctccccatacaagtgcccttgatgtcctccagtggaagaaaaataggtcccagccatttgtgctcactctgaaaaacctgtcttccggctgggcgcggtggctcacgcctataatcccagcactttgggaggctcaggcgggtggattacgaggtcaggagatcaagaccatcctggctaacacggtgaaaccccgtctctactaaaaaaaaatacaaaaaaaaaattagccaggcgtggtggcaggcacctgtagtcccagctactcgggaggctgaggcaggagaatggcgtgaacctgggaggtggagcttgcagtgagctgatatcgtgccactgcactccagcctgggtgacagagcaagactccttctcaaaaaaaaaaaaaaaaaaaaaaaaaaaaaagataaaaaacctgtcttcctagaaagtttcttctttgtggctaactagggtgccctgattttgatgcattcttgggtgaataaggggtaaatggagtaagtgccccctaagaggtcaaccaattgaaaatatgtttgagaaaaattacgagagcatttaaaaagagaaaattaacacctatgtcaccaatactttttgtgtggtttgcttttattctctttatacattaatctaacacagttgtacgcagttgagtttataatataatagagttttgtgtcctgcttttta

SEQ ID NO: 35118 - DNA, 1029 bp, Homo sapiens
taatagataccattttatataattttatggggcttattaatctttgactataaattccagatacttcagacatgtatatgggattattaagcttaatttgctttgggtgccacaggtttctcccaccttcttcccgtctttctctctttaaattcataatcacttctttggggccctatttagaatagtgtcctttgggtttgacacttttcctacgtgtaggctctttttttttcttcagggaggaagataattttaagtttttcttgaaaaaaaaaaacttgattttgagaaaattttgcagctcttcacttattttttcactaatgtttttcctgttccaggattcagtccaggattccgcactgtattcagggttcagttggtttttaactataattctgtataatgaaaatacagattcctgtggtatttatgatgcacaggactttgcatcttgcttttattccctgatggttaaaaactgaaggtaaattgacactgtatgattttaggatcacactatcccatattcccctaactggttaccacaactccagttctgtgtgccctttagtctgtcctataatattcacaaagtaatctttctaaagtgtagtctaagcatttcctttttttcgctctaaaacacttactgatttttccattgtttatagaattgagatgatttatacctggcatatgccaggtgtggtggttcacacttgtaatcccagcactttgggaaactgaagcaggaagattgcttgaggccaggagttcaagaccagcctgggcaacatagtgagatcctgtccttgtctccaaaaattttttttaaaaagtagtcaggtgtggtggcacatcccagatactcaggaggcagaggcacgaggatctcttgagcccaggagtttgaggctgcagagagctatgattctgccactgccctccagcctggatgacagagtgagaccctgtctgaaataaaaaataaataaaataaaatgcatcaataaaaatcaaata

SEQ ID NO: 35119 - DNA, 1096 bp, Homo sapiens
attaggggactctggcaagcttccaaactcattcaagttgttagcagaatctagttgcttccaggtgcaggacgaaggtttctaatatcttgccggctctcaactggggaccactcttagctcctagaggcatctgttccagatcagtgacagtgtgtggaatgctctcacacatggaatgtttctgccttctgcttcagccacatcttcctgcctgagctggtgaacattctccacttttaagggctcatgtgattaaattgggcctacctggataatccagtatactatcactgtgttcaagcctacaatcctaattacatcttcaaagtcacttttgccatgtaatataatacattcacaggttccacagattagggtgtgctcaactttgtgggcccattctgctgaccacaaggtgacatcatcaactgagaataaggaagtagaaaaagttctaaaaacaatggaaacagtttgaagtaaccattctggaaagtaagaacaagaactttgtaaaattgacaggtggcaccaaaggctgaatcgaagtcagcactatagattactatactcttgtataatcaggtataatcttggtattaactaagtggctgtctctagtagcactcagccacctgggcataagcacagagaatggagctggtggttggaatcgatagaccaaaaaagaaaaagcctaggatggcatcaatgaaaccatggactaggaaataaaagatggtcagggagacaagcaaatagaggaggaggctaatgaataagggaaaagtgaaaggatcaatggcctagggtttccaaggacattgcaaaacatatggaccaggggtaacagatggaagaatttggaaacgtaagaggtcaggtggtgagatttctaatttttaaaaaatatttaattgacaagtgaagatattcaaagtatacaatgtgatttgatatatgtatacattgtgtaatgatgatcacaacacatttgacaccactcatgttgtacattagatacccagaacttgctcatcttacaactaaaagtatgtacactttgatcaacatctcccccatttcctcctcc

SEQ ID NO: 35120 - DNA, 1078 bp, Homo sapiens
aacgggttgtttggaccctcagccagttccttccacaaacttggtcccctcctagtttcctgtatttcttccacaataatttttcccaaataactttgatgtcactgcacagagctcattctgggctcattctgcccaaatcctgctttctgtaggcagcagttctgggggagagtcaacagtccccctagagatagggatcaaagcaggtgtctgcggggagagggacactcctctggccacttcttctgtttgtttgatcttgaagggatttggcctccttccctgcagcgaactcagagctgaactgtgtgccaagaagaggctaggtcagccttctttctgggagctgagccttctctgaggtcacagctggcatgcgggtctgtatgaaggggtgttttcctcctggttctagtttggttgctagggctgctggcaactacctgtttagctggaaggtgactttgaactgtttcatgactacagttgtcttaagtattttacacaataattttttcctctagtttggtctatggctgcaacaatatggaaactctaataaagggcttatgaacaataacaagatgtctgtgtggctgtgcttttaaagaagaagagtcatgagcgagtaatgtaccgttctgacagaaaagaggcccctaacatccgcacgatgtagtagttgttgaaaaatcgcatttaccatttctgccacagaatgtgatcttccagatgtggaagatgagaactttaagagctgccctgtgaaacctaacctctaaagatacacacacaagaaaatgtggactgctttttaatagaaactgtaaaatttgatggcaattaagtatcttaatactaatagaaggatgtgattctatacaccgtttatactgatttattgtgggaaaaaataagattggttttcttggcaataattcagtggatatcattctggaagtggctcttctaaatttcttcaactcttttctgggaaaacttttattatctttactctgcagccaggcgtgactcagggagcgtgtaccaaggtgactcagatacacctacctct

SEQ ID NO: 35121 - DNA, 1022 bp, Homo sapiens
actttggaaggctgaggcaggcagataacttgaggtcaggcattcgagaccaggctgaccaacatggtgaaatcctgtatctactaaaagtacaaaaattagctgggcatggtggtgtgcgcctgtaatcccagctactcgggaggctgaggcagaagaattgcttgaacccgagaggaagaggttgcaatgagcccagatcgcaccactgcactccagtctaggtgacaagtgcgaaactgtctccaaaaaaaaaaaaaaaggatcttctaatcctgccttaggtgtcttttgggtgtagtttgtctaaagggggagagctaatcttcctcatatgacctttgtaaacttcattgtgctgtgaattttattcagcattgcttcttgaatgcctttaaatttgtttttctaattcttaagtaatgagttttaacttttaaaaagacatgaaacaaacacctacatattctatctctttctctatctgctctctcttctccatgttgatgggtgggaagaaagtagttttaaagaaagctactgtaatgtgatttatctttaaagatttccctctgcacaacttttaaaggaaattgttttgcatattccttgaatgaagggaaagcccagcttcgttcatagtgttttcatcataatcaaaataagtcattcaattactgaggcaaacagaagctgatcaatgatagtactttatctaaagatactgttctttaaataacagtactgtacagggatagaataaaggtaaaattaaggcatttagtgccagaatggtatcctgatcctcagtgagatcgtgtgaaatatatatctcaattattcagtattaaaataccctattacatgacatagatttataatttgaacttgtttttttaactttggctaataacaggctaattaatagtgcacaaattttcttgggtgagattagccaaatatttataatgttagaacttttcaatttagtttttaatgctttccaatattatacagtccgt

SEQ ID NO: 35122 - DNA, 1045 bp, Homo sapiens
aatatcctgtgaatctgtaaatgatacctctctgttctgtttaacaggcatgtccagacatcctccagctcctgatatccctactttttatcccttgtctccgggtggtgttggacagatcaccccacctcttggctggtaagaaccttgctgcacccttcagccaggcatttgaacacatgttcctccactttccattcatggaaattagatttatgaatggtaacacttgtggagttgaagaaatttcacatcaacaagcaaggtgctaactttattcatttcaatttaaaagattaaaaaacatacagactttgaaatggattgatccgtttgctaatatgggtagaaaatgactgtagcatttgctttgaagcttatagttttatggattccctttgtggctttgggcatttgctatgcctgtacaaagttagtgctcagtgtggttcttcttttctaggttttttaatgaacaacttatatttttcaaaaatgaatttagacgcattgaatatctacctttacttgtaagtgggcaagtgaggtaaatgacaaaaataactagagagaaattcaacaatataagagcattttttggatgttaatgaagtaagcatccaatttgagttcagagtagtaaaaaactgatttgggggccttctttttttctgaatatgaacgctagtgctctttattttgttgtttatttctaaaaatatgcttactgctgcctccaaaatcttttcaattatgaaggtgaaggaaatatattttgggaagaaagaataacatggtatagcctatttttattattttatgattaacccacaacatttcctcctcccactcccatgctctctccactcttccctctccaattctccctccatagaaataattctcaactcaagcaattgtttctctcctttttccacttgactctctatgtcacagcccccatgtcattgtaccccatctccctacctggacatccttgcattatccttcttcagctaggaagggtcatcctgccatggacaat

SEQ ID NO: 35123 - DNA, 1069 bp, Homo sapiens
aggaaatctttctggaatttgtcccccctgaaccaacccgccccaaacagtgccctccctctctggttctggagtccctggggttgcctcatgtcgcctccggtctgagctctctggatggtagacagagaaagcttttgctcctgacttctcactcactttaattgatttgtttaccttccattattttccactgacctgcacaaatactactttcatcaagctgactacacttcagcttattaatcataataagttattatgcagtgattggattggtaaaatacttctctcagaataaggcagcagatattaaaaaatgtctaggttttaatcattatgggtacataataggtatgtatatttatggggtacatgtgatgttttgatataggcatacaaggtgtagtaatcatgtccaggtaattggggtatccatctcctcaagcatctatcatttcattgtgttaggaacattccaattccactcttttagttattttaaaacttacgataaattattgttgactatagtcacgctgttgtgctagctatcaaaactagatcttatcctaactatatttttgcactcattaaccatccccactcacccaacccccattccaagctgctggtaaccatcattctactctgtatctccgtgagttcaactgttttaatttttagctctcacaaatgagtgagaatgtggttatttgtttctctgtgcctggcttatttcacataacataatgtcatccagttccatccatgttgttgcaaatgcaaagatgtcactctgttttgtggctgaataatatttcattgggtatataccacattttctctatccattcatccattaatggacactgaggttgattccaaatcttagctattgtgaatagtgctgcagtaaatatgggaatgcagatagctctttaatatactgatttcctttcttttgagtataccgagcagtgggattgttagataataaggtgataatatttttagattttgaggcaactccacactgttctccatagtcatcatattaatttacatt

SEQ ID NO: 35124 - DNA, 1030 bp, Homo sapiens
acatttgtttactgtgcagctgatgctgatttatctttacattttatctagttaacaaacatacttatatatcattacgagccagaaatcattctaagaacttaactaatagcagctcacttaatccttaacaaccctatgaaataggtactgtcatcatgatccttattttccaatgaggaaaaatcaaggcacagaaagaataagtaacatgcccaaggttgtacaataagtgtcagagttgagattcagcccctggcagtctggcttcaggcgtcatcctcttactgcctcatggctgtgtgcccatgggtgggtgggactggccatcacacagtcctgaatggcattgcaagggacatttttctcattgcctggagaaaccaggatcagaacactctaccccaggcatggggcatgcagcgaaaaactgactctcaagcctaggagctatttgtattggctttggtccttggacctctgcttacagaagcagagacctcacagccttcatctgaccacacgaaaaccatcataagctcataggacagggttccagagatggaagcttctaatgccccagcagccacacagtgtgtatcaatgcctgacctcccaacatcctagcaccattgaactcccaacaggtcattaccactgttttttgcctgtttccaacagccgagctctttgcatactcagatcactagctgctgagccttgtaggggaattagggcagggtcgatttcacagatgagaagatacagtgtcaatagtccaccataagactaggacctaaatcctgctgccactttttttgtatgtcagtacttttactttttaacctgagacaggttctcagtctgtcacccaggctagagtacagtggcgcaatcacagctcactggagctcccaagcttaggtgatcgcccacctcaaccttctgagtagctggactggaagggtgcaccaccatgccctgctaatttttttgtatttttttgtagagacagagtttcgccatgttg

SEQ ID NO: 35125 - DNA, 1051 bp, Homo sapiens
cctccctaaccactgtggagcccggcctgcaccttgccctgtgatctgtgctggacatagtcacatttaacagcccttcaagtttccaggttttaagggagaaaaggatagttagcttggcattgtagatgtagatgccatgctatttaaagatgcatgttctatatataaactctagttaatcatttgactaaaaccatcataactttcctttgcatagttcagatgattcattgttttgaaaactatgtaaactcaaatggaaaacaaccacgcactgatggttgcaacttatatttcccagtatagagttaatgagcagaaaaatggcagagccgcttccacacatctaaggctgaacatttcttggaactattaatgaatgtactttactgtaaacattgaagcttagcagtatgttctataggccctgagaagaggggaatgaagattctttctagtttcttacaattataccatggcagggaatctcagtctgtatttttaggtatttgtcctccaactctccttcaggcctggttcagctagcatttccagtccagtctctaccatttcctatccgtaatccatccttgttatccttccaggctacttagaggatgttgctacgagtggcttcatgtttacatgcaaggaagggaaggcagaggaggaaaatggggcatggtggcacatgtaggtcacataggcatcatgcgtcagcaagctccgttctgtcccccatggaagcatctttgaattcctgatgttctcagccctaaattctcagctcttctattctcatataggcagtggcaacttcaaggcgtttggaggagttggggctagcccccataatctccagcaatacccttcaccaccccaaataaacacctttgctaagtaaaaatattcttcagatacagcatttacttcaatcttgcaaccagattgctgttcctaagccccctttgtgtagaaatgtatatgctaggtaagctgtcaggcatactcgtgtgtgtgtgtgtgtgtgtgtatacacacacataca

SEQ ID NO: 35126 - DNA, 1046 bp, Homo sapiens
tacaggcaaaagtctgccaaagagcattctttgcacagcaagcaattaaaatgtggtatgtgcttcatttttaggagcagttagtggtgatttttgtggtatcatgatgttggtttaaataagagaaattagtttagaattaactggaattgtgatcattcctgagaagttgcaacagtgagtttcctttaaaaagtgaagaaacttttctttctaaggagacattaggaacagtcttttcttctttttctcaaaaggaaatatctttttttttttttggttaacagtaatatataaaaacgggggaaaacccatgaaagaacagaaaaaataaataaaaagtacctatatttctgtcattctgatataatggtttcattttgatgaattgtttcatttcagacattctttctgtatctatacctgtaatacaaacgtttttgtaaatgagcttataagattattattctattataatcttttgtcattaaaaatgtattacgtgtgctcatctttatgtgaatgtaggtctgtgtcatcagttgtaatggctggatagtatccagttatatatatatatacacatgtacatatatgtacatatatatacacatgtatatatatgtacatatatacacacaaatatatacacactttaatttattggatttatcctcagttatggatgttaaagtttttttgttgttattttaaataccactacaatgaaaccgtgttaaaaatatatttataatctattttttttttttttttttgagacggagtctcgctctgtcgcccaggctggagtgcagtggcacgacctcggctcactgcaagctccgcctcccgggttcacgccattctcctgcctcagcctcccgagtagccgggaccacaggcgcccgccaccacgcccggctaattttttgtatttttagtagaggcggggtttcaccgcgttagccaggatggtctcgatctcctgacctcatgatccgcccgcctctgcctcccaaagtgctgggattacaggcgtgagccac

SEQ ID NO: 35127 - DNA, 1030 bp, Homo sapiens
cacgtagctgaagactgtgcactgaaagtataggagactgaactgtaaacagttgccaactcagagcctgagagtgtggtatagtttctatatcctttctggtactagaagtgactgaccagtgtgcaacaaacaaaacaaaaaagaaatacagactggacaagaccaggaagaagaagagaaaaagccagacaattttacaaaggacctggccccagtcccggagagtcttggtgaactgtcttatcaacaccctctggaggaggtatcagaagctgtccctgggaacaaggattccaggaagagctgggcagaaggcaccatcctgtgaggttgtgcaagctttagagtttcagttagatgaaattgatctttctatgttttccttcttccagatctccactcttcccattctggctaactggcctccattctcattatggacttgagtttatttagcccagtgtgccttattttagttatttgttctcattcttacattcacttctgagcctgtgtttatttgaactggcatgatgttcatttactacatggtactagtctcttggtttctcttgctttgctatgagaatgacctctacttgggccatttttgactcttcgttttccattcttgggcaatccccctgctactttggtcaccatctattctcctggaatatctttcccctcagaggctgctggcctcctaggtgtgactccaagccaacccagtgcctctattttccccacaactcattattgctctagatcacactggtagctaatttaaattattctctctgtgtttatgtgtgtctgtgtgtgtgtgtgtgtgtgagtgtgtgtgtgtccacattttacaaagtggtatcaaatgcatgccatagagtagggtcactcctcaactaatcctcttatttattttataaagtcctgtgttaaattaactattgcagatattgaggaagcagtatctataccagatggattcaaccaacatatggagtcactctcttagtgagcacac

SEQ ID NO: 35128 - DNA, 1023 bp, Homo sapiens
tcccaaagtgctaggattacagatgtgagccacctcgcccagtgtgaccttattttcttaaaactggatggttcattaagaattaagcaaatggcatacttttggctttttaaaaatactccctctactataagatagaaggttaaattagaaaatgctacagcctgttcatatcataaaattaattagtttagaggaattttaagccattattaaaatgaggtaagaatacctgataaagtaacagccatttcctgaaaatccttatctgaaacttattgaaaaggaaaatattattctaatgtggacatatgtaacaaatatataggcattgcttaataaaaactttttcctgcagttttataattttactgatggatatttaaatactcctttctccaaatagtttgtttaaatcacttgaaaggtttacagcaatccacagtaaccttagttaatttaagttgactagtctgtatatttagattttctacaaagtatgtgttttgtaatcctgattcatgcatgcattatgactttcttccactgataaacaattattacaagagctttgaggaatttgtttttgtaaaaataaatgcaatctaaataataatgcttagctttcctacataataatcttttatttaatcttaaataaatgatgctacaaaatccaaaatttgggtgtcatctcctcacttcatgtctcctttagattcttcaacaccttgggtctggaggagttaatggaaaacttctcctcttccctggcacttaaagtctggggcttctctttggcaaatttctctttgaagtcatatttttatttcatttaaactcatgaagcatctcacatattccactcagactttgtaatggtaatttgagttcagaatacctctttttcctacttctttcttccatgtaaccctggcagatttctccctcctcaaaggtattagcagacagaattgctattaatgaatttcctattacagagcaatccaagagctggaagga

SEQ ID NO: 35129 - DNA, 1037 bp, Homo sapiens
ttagccctttgtcagatggatagattgcaaaaattttctccctttctgtaggttgcctgttcactctgatggtagtttttttgctattcagaagctcttgagtttaattagattctgtttgtcaattttggctcttgttgccactgcttttggtgttttagtcatgaagtctttgcctatacctatgacctgaatggtattgcctaggttttcttctagggtttttatggttttaggttttacatttaaatctttaatccgttttgagttaatttttgtataaggtttaaggaaggggtccagtttcagttttctgcatatggctagccagttttcccaacaccatttattaaataggaaatcctttccacgttgcttgtttttgtcaggtttgtcaaagatcagatggttgtaggtgtgtggtgttatttctgaggcctctgttctgttccattggtctatatatttgttttggtaccagtctactataaagatacatgcacatgtgtgtttattgcagcactattcacaatagcaaagacttggaaccaacccaaatgcccatcaatgatagactggataaagaaaatgtggtacatatacaccacggaatactatgcagccataaaaaagaatgagttcatgtcatttgtagggacatggatgaagctggaaaccatcattctcagcaaactaacccaggaacagaaaaccaaacaccacatattctcactcataagtgggagttgaacaatgagaacatatgggcacagggaggggaacatcacacaccagggcctgtcagggggtggggggcaaggggagggatagcatttggagaaatacctaatgtagatgacgagttgatgggtgcagcaaaccacgatggcacatgtatacctatgtaacaaatgtgcacattctgcacatgtatcccagaacttaagtataataaatcaatcaatcaataaattttaaaaactcatttgtttttctgattaagttcacaaaaaaattggaatgccaaaaaaaaggaa

SEQ ID NO: 35130 - DNA, 1049 bp, Homo sapiens
ttaacctctccaaactttggcttcctcatctgtagaatatggataataaaacttttctcatttgtcctgaggattaaataggataatacatgtaaagtgttttgtgcagtttctgcactcatccatgctacagtcattaacagcaataattatgaaataaaccctactcatccttcaggacacgactcaagtctcacctccagggatccaatccacaataatagataccaacagggattccccttctgtcacatagggccttacattactccttaatccttaactattttggttctgcagctcttgtctgcctaactagatcactagctccttgaggacagtagccatatttatacttcatagagatatgaatatattaaaaaactgtaaaacccgaacacttttacattcataaactatgagatgagtactataactttgtccattttactgaggaaactgagatgtacaaaacctaactaacttaccctagaacacagaattggtaaatagcagagccaggagtaaaacctaagatgctagattacagagccaggaacttaaccactttgccatgcttcttgccagcagtgcttaaaaagtgactgcagaatgaaaatggatattcattcctatcttgaggtataatgatggcctttatcaattccctttaaaggtctttctatttaccaacatagctatttgacaggcatttaccaaaccatttccttatctgtaaaatggagatgataatacaaacattggataattgcatattagtcaagtttctccagagagacagaaccaataggatatatatagggagatagatagatgagtggggatttatgaggggaattggctcatacaattatagaggctgagaagtcccacaacaggctatctgcaagctggaggagaccctgggttgacggtagcatggctcggtccaagtctgaaggcctcaggtccagggaggcagatggtgtaactttcagtctgaggctgaaggcataagagcctgaggggcactggtacaagtcccaaaa

SEQ ID NO: 35131 - DNA, 1017 bp, Homo sapiens
cttatcatttgatatttagcaaaaataacttcacaaattaataggtggtttcatattatagagttaaattatggcatttcttagtaacacacacacacacaaagatggctttttacaaataatgggaagatcataaaaatttaaaaactatttatttaaagtgataagaaagtgatactcagcattaatcaaaaataaccttgtagcattataaataaaggggaaggcatttaaaaggaagggctgaagcaggttgctgcagtaagtgcttgtaggttatcggggtaccagcttctcttgcaggaacctccgtgctttgaaatctagttgtcccttctcctgaacttgaagcactttcttggagagagagagtacttgagaatgtggaattgattatctccctccaaaggcaaaaaaaaaaaaagcaattttgattatactatttatcatcttactttagtcttatatcctccatcacaaaaatatcccactggaccctcggaatttgcctagtcatctgtggactagtcagaatgttttgagctttttgaagttgggagggatgttaaacgatttgccacctctagcaaatgcttttattcctcaggtcttaggaaatggccagatggagtttgtcgaggtcaggtagctctgatattttcttttgtttttctctccttgactgctgactatagtgaaaagaagctattaattgacaaaaactcttttcatcaagagtatgtagacatactcttctacataattatcaagtactgttgggtaactatctggtatttgatttaaatcttaggctctatttttggtttaataagctttgtcttctctaatcaggatgtgggagatacactttccttataatgtagtcagtgctcactataaattagtaattttgaaaaggagacaatttaaagatacgtcacaactattagtggtcattggatatttataaatgtagagctaaaggcttaaattttatgacatagttttcttaactta

SEQ ID NO: 35132 - DNA, 1037 bp, Homo sapiens
tacacactaaatttgttaatgaactaaattttaattagaggcactatagccataccattttatggatacattagtttttgtttttttatttgtatgtcactttagcaataagttagaagacatgcagtgaatatgtttagattcatactctcatttgagtctgaaacaggaaacacatgctagcagtttatcgtctgagcatttggatatcaatgcccatacagtcagattttagaccacagatgtagctagcaagtaaatgtggattctatattaggttaaatctcttaaagatcatgactctgcctttgtctagcagtagctgatgctgtagataaacatatgaatagaaaaataaaatttacctattagcagaaaagggaagagagaataaatcccttcttgtattttggaacctgaagatgtagtaaaataaggtttccaacttcttgaagtcattgagaggataattgcttcattttaaacacttaggatggacataatttttgaggaggtctttcacattcttttaacatttctctaatttaaaaacagatttttctctcaaaactaagagtctaagcaatgactcattaggcccagttttaggtaaagttgagactctttcaaagagcctagcagaactttgcaaaatttactatttattttataatatttcctatcaattctctatttaagaaatttggaattagtgatacagagatccatggtctgctttggtttgaaaaagcaactgatcttctcagacaatctaattttaggtcccttagtctttcaaatttaaaggctaagtttttactgctctccaagtctgtgttttgctaaaaagtctgtaagacagttgtgtctctaaaaaataaaccaaaacaaacctgctataatctcgtatagtttacactgttttcagagtggaatattcaaatagattttcaattacttaataaaacattgccttatcataatgattacttataaatacagtttagattcattctggaagtttatagatttactca

SEQ ID NO: 35133 - DNA, 1080 bp, Homo sapiens
ttccttgcctagcatgctaatgatatctttaaaatgtagcactaaacacctaattggtagcattttcacagtcaagatgattgaggaatataaatcagcttcctcaaatagagattattctgtttgaggaaaaaggtctttctgaggtgagaattacctatccaattctctctttagatctcattaaaattagaacccaaactaaggagttataaaacttaaggcttttttttttgtgagcattttgaaaatacgatcaaatagaaagctggtcatgctcagagatgagtacaagaagtgacttatttacacattcaaatttcaaaatatttttaagtcctaccatgtgtgctgctaaaaggtttttaatttaaaattattttgttagataatcctgtttcaagtgacattatgatttatcgccactaatcaagattctgatccctcatagacttcttgtttgtatctgtttttgttctttgttacataaatatgaggtttatatataaaattctgactgtgtaatatagggctaatgagtcacagatggaaagatgctggcacattaccatctaataacattttaaactcatattccatagtaaaacaaaagcaaattgtatacatctgttttcaaacttgtagcatttctgaatttatgcagaatctatatttaaaggacttgtatttagagagaagaaaaagaggacataggtcacctcaaaactacgcagccacttaatagccttatcagaacggatttggcaaaagagataagattttctctgttttgcttcctgagaagttgtagtaccgaagactgagagtcaaaggcattagagctgaagaaatgtcttcagactacaaactaattttactgcctttcttaaaatgaaaaacatatctctaatatgaggaatgtgggggtgaaatattcatgaaactaataaaattaaaaatgtagaaaatgtagaaatttcctgggctttcctaaaaatatccacaagataaatttgggtgggaagagggagagcctaggccatgtattgctgtggttgttgtttattttatttatatggt

SEQ ID NO: 35134 - DNA, 1098 bp, Homo sapiens
gctgacactgaggacctgtgaccctggagttgtagtcaggttaaagtttttttaaaaagcagtcaggaagtgaaatggaaagacgctgaggtgaaaattcaagaccagtcttgaagccagttggatgtaggggatgaagttgaaaaagaagacaaagatagggctaaagtttctggcttgatgcttgataaaataggtcagaagaaagttgggaggataagtgagaagatggattttaattatgttgaattcgtgatcttgatgagatatttcattggaatagtgtaacaaacagaaacatgagactagaattctgaggcagtgccataactggaggtaactgttacacagctgaactatcacagagggagaattgaaatcctggaattagaaacatggtaggcaaaagagtaagaagagtactgccctagaatagagtctttaaaaatactcacacttacggagtgggatgaggaaggaaggagtgtcagcaaaaggagagcatttgaaggtagaagcaggacactgcattgtgtgaacaccacacacaaaactacttaaaaaaaaaaaaaagagtggccaatataatattctgaataaaaagagagcctcagggatgaggtctttcaaaagcctttggatttgctgttttggagtcatgggctattaaaggaatatcttttgttaagtagtgagagtggaagtcagattgcaagaagttaaaaggtaatggtaggaaagttgaccgtctttgaatacagttgatggcatatgatttaatgcaggagaaagtgggctaacttttcggcattaactttctttcagtatacattgaaccaatttcaggcctacagttttaggtgtaatataataaccacaaatatcatttggttttattctacgaggcactgagtgttagatttccacaaatgaatgcatcctgacataagaattgtacttcccgccttgattcctggggagatgtcattgcagatttgccactaatctttaattcattcttccaaacactgcatttcattaggcctttaggcttagggttgggatggtgctttatctgtgctgtcggtcaccacgcat

SEQ ID NO: 35135 - DNA, 1273 bp, Homo sapiens
ttatataatccattttctacacagcaggcagagagatcacttgacattgtaaattagatcatgttactcctgtgtaaaactttagaatgaaatccaacctgctgtgcttagctcttgcccatccccaccagttcatctcacactagtcttgcctccacctacaacactcagccacacactgtcctccatgtcctcttcagacacactgcactttcacccaactcgacagctttccatttgccctcttctggtcttcttgtgattgggttcttcttatcattgaaacttcatctcaaatatcacctcctctgagagaacttctctaactactcaatctgaaccagagattattctatcttgtttatgtatttacttgctcattatctataaagtatgcccccctccctccttaggtcctatattccataaaagcaaggttcttctctgtcttgttcataccccttcacatagaatagtgaagattcaataaatatttgttgaatgtatgaataaaatattgttatatcattatggccctcaagaagctgataatttcatgggtacctgagtaagaaaactgtgtggttatatgttatatccctcaaatagatataccaagaggtgctagaaaagtgaaaattctttcattttaaatgagcactgtcaactgtggaagaggtgacacttgagctagaacttgataaattggtaatctttaggaggatacactgaagagcaagacagtacatattccaggaagaggaaatagtataaacaatattatccaagtagaaaatggcaggatttagttaaggaacaataatattccatttgtgatttttaaaaatgtggtatacacaatggaatactatttaaccttaaaaaagaagggaatcttttcatttgccaacagcatggatgaacctgaaggacattatgttaagtgaaataaggcaggtacagaaagataaataactgcatgatctcacttatatgtggaatttttagaagttgaatacatagaagtagagcatttaatggtggtgacccatggctggtggggagggttttaggagatgttggtcaaaggatacaaactttcagttagataagaggaataagttcaacagatctactgtacagcaacgtgaccacagttaataacaatatattgtattcttgaaaattgctgagagtacattgtgttctcaccaaaaaagataaggatgtgaggtaatacaaatgttaattagcctgatatagccatcgcatg

SEQ ID NO: 35136 - DNA, 1036 bp, Homo sapiens
cagtgcacacctataaccctagctactagggaggctgaggcaggagaaccgcttgaacctgagatggaggttgcagtgagccaagatagctccactggactccagcctgggcaacagagtgagacccacccgccacccccccacaaaattagaagcttgttatgggtttttaagttgttgaaagctttcttttatttgatcaaatttttcttaaaatttccatgttctgtttacttggctcactgaaaatgatccttttcacatacagtatatgtctagtaacaggaacttgaaattttgattatcttctttttcttttttcctcttctttttgttgactcaaaatgatacctactttttttcttaaaatgtcaacccttttgatttctttgattttataagattttgacctaaaatgtcaaaatttgttttttgttatttatgtacaattcaacataactggcctgataattctgttcctctccagctctgggtctccctagcacatgctgttagctctgggaaaatggaagggtatggacactgcaaaacttcttctttcactccctgtcttcttttgcagctagttaaggaagacagcttgtcatctgtgcaaggtttctacaaacaaattctcccttagccaacccttaaacccacatttcccacccctgtctgagtcatgaccgtgtcattcagactcttctaatctacacttctgactttcaatggatttttcattaagacactattactaataatggtctacttctattatactatggggatatgttttaggtactttaggaataggcttttgtggattaggctgggaaaataaaccatattcatattgtgattcctacaggaagatctaattaggtttccaaacaaaatacttcccccaaaaaagggttgtaaatgtttaagttgggggattgatatggtttagatctgtgttcccactcaatctcatgtgaattgtaattcccaatgttggaggtgtggcctgatgggaggtgattggatcataggg

SEQ ID NO: 35137 - DNA, 1050 bp, Homo sapiens
cctctacacaggctggagctaagggttttgactgccaggtctaactatgccttgatttggtcaaaatgagatgtcattttctttgatggagtaaaagtaaagctttaaaatgtgggcagtacatctcgctggaactgcctgagtgctccaagtgccattgttctccctctggcatttcagcagcactcagcttacccagctgctggcatccttaaggttttgtgacctggtgggtgacgtttatttggtctcgctacagaaaatgtaggaatggtgatttgcgtaaattctttttttttaaaaaaagtattgtaacatggcctggcgcggtggctcacgcctgtaatcctagcactttgggaggccgaggcgggcggatcacgaggtcagaagatcgagaccatcctggctaacacggtgaaaccccgtctctactaaaaatacaaaaaacaaaattagccgggcgcggtggcaggcgcctgtagtcccagctactcacaaggctgaggcgagagaatggcgtggacccgggaggtggagcttgcagtgagccgagatcgcgccactgcactccagcctgggcgacaggtattgtaacactttaatatatggcatataattattgaaagttgtgtggcataagaaaacaggtctgcatagtagttatcctgaaacacacggcataaaggagttttggccaggcacagtggctcatccctataatcccaacactttgggaggctgaggtaggtggatcactttgagtccagttcaagaccagcctgggcaatatggcgaaactctgtctctacaaacaaatacaaaacgttagccaggcatgtagacccagctactcgggaggctgaggtgggaggatcgcttgagccaaggagatggaggttgcagtgagctgtgatggtgccactgcactccagcttgggtgacaaagcgagacccaaaacaacaacaacaacaacaaaatgaagttttacccttttaaaaatttttaacaggcattgcattgtggtacacctggaagcctgactttaa

SEQ ID NO: 35138 - DNA, 1054 bp, Homo sapiens
ttctgtattgagtggtttgggcttccatgtttgtagagagcactgtgttcagtggcaatctgttttaatgcttcctctgctatagtttctgtagatgtagtgccaggttaagcagaagtttggaattctggaagtggctacagtaaggggcaaagagctgcaaattgagcttaaataaggctgttaaagtaaaaaaattaaaattttaaaaaggaacaaggaagaagaaatagacatacaaaaatattgacaatttttttgcaacattatttttttcctacggtctatttctggataccatctgttttagaataactttagctgttgtaacagacggaccttaagatattagtggcttaccatagtaaaaattcatttttttgcatattgatgggcaaggctccttgcaggagcccagactgatggagactctgccatctttaacatgtgtgttccaaggctatcttgggcacggttacacagccatagataaggaaagagtggagggtcagatgggaggatttttttgaccattattggaagtttagaattctatgatttatatctcttctgaccacattcctttggcaagagtcaagtcacatgttcatacctaactgtaagagagggagagaaatgtagctgtgggctcagaaggaaaagtaaacaaatttggtgaagagccagtctccactgccctaagtctccactgtcctactggaaataattctgaagaagtaaaaagaaccagaaatcatcagagaaacatacattggtgtatcacttgggaataatgtggtctcagtcttgtaacattttagagaagaacagtcattaaaactattatcactagaaacctagaacagaacaaaaattaaaggaaggggatttttttttaaaaaagggggtgacataaatttaaagggtggtctgtaaaaagagaaaagtattaatggcaggtcatgagacccaggccttccagattacttcataatctcattgatagtgaggactttttatctttcagtatttctcaaatctttaggcacctcta

SEQ ID NO: 35139 - DNA, 1034 bp, Homo sapiens
ttttctaagttgacttaaatctcctattttccttcaggcagttgtgtgtttttgtgtcagaaaatacactgacctatagtgtgtttaataagtgaccaaattgttagtttcagcatttgtaatccaagagtcaggctgtctggatatacatccctaacccaccatttactacctatgtgctgttgagcaaatcttttaacctgtctatatcatcactttccaaaattgtattgagatcacacaactaggaaaaataagtgagaccaagcatgtacagtgcttagcccagtgcaaggtgcgtgatggcactcataaatattagtcatcatcattgtcccttgtattatttcctagtattttgtgcttttcccccacatgatacaggggctcattaggttctctggcttccacaaacagatcttactctatcattcctgcactaattgttttagtatgcctgtgccttcgtgcttatttcactgggtccagacttctgcgttaccctctctctctgaactactcctactcttactcgaatgacttcgtcttgcctttctgtttattcattttccatcactcattttcagtgttaaaccagttctgtattattattctatgagtatttttactactgggtggaaattttggcatcatgctaaatgattaatttagcacccgcttaaatatctgggccatttgcatatgtgtaatggtgtatgtggtgctgctgtgtttaattcatccatcggcaatttggcaaaagcttgtggtgtcacaaagccattaataaaaacaaatcctagtttctattagcccactttttaaattttccatgaagattatttcaatctctgataaataagaattaacataattttatttattgaatatttgaaaaactatattcaacttttgatcttattttttttctgttagtttaacatttttatctttaaaagaggtgtctaccactctcagttccattagaaacatataatctgcaaagctaatttaaaatatttttctgcaagctt

SEQ ID NO: 35140 - DNA, 1050 bp, Homo sapiens
tttttctctttacttgtttgcttggtcccaacatactcatttgctgctcatttctatgattttgttcaagcttattttctagtttgcttcactccttcccctttttactgataaaaatattcatctttgatgattcagaacgatttctatctcctggaaatcatccttgatcgctccattctatattcctatctttctagctgaattcttacgttattttttttcagtgccattctttgggacatctatttatgtgctaccttctattactatttataattctttaatgtgtatacattcacaactaaattttgagtattttgaaagtagaggctgtatatcttttgtgtgaacatttactgtctgttataatgtagagcactatataatattatgcaaataaacactagtggaagcagaaatttaaactcttctgttgatttgactttaatcatcctcatcagtatggcctattttagtctccacagtctagagggattttattaattaacatatatatatgtatgtatgtatattctgtggaaagatggatttaataaattactaattgctttgttaagccaaggaattttcatctgttatctcacctcaaaaatccacaattcttttattcttttttttttttttttaattatactttaagttttagggtacatgtgcacattgtgcaggttagtcacatatgtatacatgtgccatgctggtgcgctgcacccactaactcgtcatctagcattaggtatatctcccaattcttttaatcttaaacaactttgcaagagagagagacaacttagagactttccttcaagggcttattaaacttggccaaatctatacaatctataacttcttagtttactatgacagtccagcaggaatgaaaatatggtatgggtgccacattggttgccagaaagataacatttaacatctgtcgaaggaataggacaaattttacaaatcaaagactagcctggcccaggtttcagttttatcacaccatatagtcatcacttaattcatatt

SEQ ID NO: 35141 - DNA, 1026 bp, Homo sapiens
aattccaaaaggaatcagcagtgatggcaaattgagacgggaagccaaatttaaaatcactaacagatgaatacctttcatagcttgctgtttgaccactaagaattaaacatttttaactagctaattttgctagaatatggcatatagcttgttatgatactcctctgttttcacaaagtacaccagcaggctttgggggaaaaaaatcaagccggctttcggtatttgagttgttctcattttagtccagggaagcctgcttcaaaacctgggtctaaaaggtctttagcttttatctagaaaagacaacgtgcttgagaaagttcctttagttttttgtttcagttgacattgacacactgggtcagacttgtcccaaagcaccatgtctaaatggcttcctttatgtggttctaattgggattctttctcaggaggtcaaattagagctcctgcagttggagctacagcaccggcagttgacagcatcagctcagttctgcctcttgagacatgtaagacagccacttagagtttgttcctacagtcctttgacaaatggccctactctgactgtgtacctaatagacagtttttgtttttcttatggatctgtgccaaaaacagggtttttccttaagcaccttacttctgctttgttctctttgctttgccttttgtttgctatgattcagtttgtccaaaagcattggctaattttcttgtttatgaatcatatctggcctacttacataatggtgcctggtttaaccaaattcattctatgtgagtgaacaaaacggaactttggacatctgaattgctctgttggtccgtggatgaagataatgcatgatagattagtctgtgataatttattttgaacatcatagcaataaaaattagttgattagctatgacaggatatgatctaagattcattcattcattgattactttctatgtagcaagacctctgaagagatatgtttagtgcgttacttttaacctatctctctagca

SEQ ID NO: 35142 - DNA, 2457 bp, Homo sapiens
cctcaatctgaatgttttgtaaatattttccttattcttgtgattaaaatatttgtcaatatgtttctgggcattggtctcttaaattttgcttaaaatgtgatgagcccatctcatttgtatatccatgatttttttcagtctaggaaagttattctttgattatgtcttctattattgttttcattccaattactttggaataaataccaaaataataggctggctctgcattctttggtctacaaacatattatcttctctcatttatttttcatctgcttgattggttctgcatttttagaggacatatcatacttttctttcatatcactgattatattttcttaaacatatattttactctttattgcttctcctcatttatttctatctcggctttgttagttattttaaaacataaaattgtaaattaatatttggaaacataccacaaatgaaaggaaaggcataggacaaatatttgctggggaaaaaatcccaccaatagtaaaagtcgttaaacttaatgtaaaaaagctctttcaattaaaaagaatatcagtggcttaagaggcaaaaatggcagagacaattacaagttattcagagaagacaaaaaaatagataaatacaggaaaagtgcttgacctaattagtaaaatttttaaataaacattaatactttgaaatatggagtattaagataaaaagtagatacagtgctgaggtggactttgtgaaatggataatcacaaatattgctgatacgagcacaaacttcaacaaacgttcttgaaacccacttgttgatatgagtgaaaaatctttttttttttttttttttttttgagatggagtctctctctgtcacccagcctggagtgcagtggcgtgatctcggctcactacatgctctgcctcctgggttcatgccattctcctgcctcagcctaccgagtagctgggattacaggtgcatgccagcacacttagctaatttttgtgtttttagtagagacagggtttcaccatgttggccaggctggtctcgaactcctgacctcaagtgatcaacctgtcttgggctcccaaagtgctggaattacaggtgacagccaccatgcccacccagccagaaaaatcttaaataggagaaaattcattgacacatcaatcttatttgtgggaatatatcttaaagaaataatcaaagatgttatgaaaattgtaagcacaaaggtacccagtatgatttaaaattggaaaatataaaaacctaagtacccaacagtaagagaattatacatgatagaatacacgatgaaatattatccatctttttaaaaatcctgttttcaaagaaaatgtaatggtttgaagaaaacattcattttagtgttaattgaaaaaataatttaaaaaactgtatgatgtttattaactaaattacttcccctgccccctacccccaccgacacacacagaatcttcacatatttaacattattactatttactttatcccatggtcttttaatcatactctgttttcttcttctggattcccttttcatgaaaggcctgctgttttgcattctatggaggatttccatggcagataatgtttagatgtttcctcattcttctgattgacggtctccttactttgtttgtagtactcttttccttttacacacttgatttttctttactcaatcttgagataagagatagatctatagatgatgattgccagtggcttgccgttgtccccattcttgggacccctttggtacgattccattctcaaagctacagtttcctggaagtttgacacatgtatctcttagcccagtttttcacatctaataggcttttatccagtgtagcttagctggagtgaaatggtgtcttctcttgtgtttgattcccccaccccacgtttctctgatactctgaatatgaaatcatgaaaaaatgcaaggtggagtgcgttgctttctgaaagcttcctgggtctactctcagttacaggatccagagcaccaccacgtgttcccagccttctcttcccaaacttgttgtccagttgtttccttctagctcagtctccttggaaggagagttagtgaggaaagaactggatagggcatgaggagcatccaagagaggggtggctgaccagttgtatatttgttgtagtccctgtatgtatgaatcaaaaagagatggtaggggaggagcatcggaacatcggctctatagtcccactttagagttgacattgcaattatgatctcttattgtgtttttcgattagtttcattggccttgtaattagtgggaaattcttccatgttcttgtcacgggtttcccttactctcacttttcattattgtgacttatctccttttggagggtgccttcataggtgttttttcaagaagttggaa

SEQ ID NO: 35143 - DNA, 1026 bp, Homo sapiens
ggccgaggtgaaaggctttcagggaacgtggctggaaacagtgggctgctaagccctcaatcttttgagcagctgccaagctccctgtgtttcaccctctcttgtgggcgacaagtaccaaatctgtatggcacacaagggtatgaaaatgagtttggggttcctggcctcagctgcttgaatttgtcaccctggtcaaatagcacaaattccctcctctcttgtgcattgtccttcttgatttcccacaagaacgtatttttcctaacctgacaggcaaatacataatttatttcatcactgaatttactgcgaaactaattgttttcccaatgtgtggaaccagtgtaaacaaaaccaagaagcatggtttgtggcttatttaaaatcctgctttctgtgtactattctaggaagctgtttgcttcggaatagtgatctggtatgtattagcaaccttgcaggaaaatgctgaagcaatttgccatcttcccttaaaagtaacatgactatagaccagaagagtgataggctttatgccacagatctaaaataatttcagacctcataaagtaaagccattctcaaagtcttattttagatgatcattttccctccttatgtgaaacagcaggtgaaaagatgccactctgtacttctgaatgtcagttttgatgagtgtccccaagtttgctagttagctataaaatccacaggcctatatagagaggagatatggattatgatataataatgaaattgcaagctttagaatatttagcctcttctgtgtaactgatcagttcttattgcatccatccactgcatattttcttcaagaagaaattacatcagtgatcaggcagtttcaggcctgtaaaaacttcattacataaaatgtttccattatatccattcatactttctcttagatgctgaccaacctactgtcttattttacaacctcaatctctcacctgctcctgccaaagttgcattgtttacgttccagaaagaggcaatgat

SEQ ID NO: 35144 - DNA, 1026 bp, Homo sapiens
cattggtaagagattgaactttagtgtcagatttgtctatttcttaagttgttaggcatcccaaagatagtatttgttaggcaaacttgcattaaaaattaagaaaagagagattaagtactaaactaagaaaaataattaggtttttaaaaagagtaatgtaacctgttgctctaagaatttcctttttaaaattcctattgcatctttcatttattcattgttctacaaccagctttggttgaatattacaggaaatgttttagttaagcaaagtttgtctttctacaatcttccactgtggtttttgagacccttcccttaatataccctgcttttattgtgcccagttgtattaattttctagggctgttgtaataaagtatcatacataaactgtggcttaaaacaatagaaatttattctctctcaattcttgagactcagaaatcaagatgttggcagggccatgctccctctgaagcctctagaggagggcccttccttgcctcttacagtttatgatagtaccgggcatttcttggcttgtggcagaagagctccaatctctgcctgtcttcacatggctgtcctccttttgtgtgtgtctgagtctcttttctttttataaggatgacagccatactggattaggacctactctaatccaggatgacatcatattaatttgattatatctacaaagaccatttccaaataaggtcatatacacaggtattgtgggttagaacttgagcatatctctttgaagaaacacaattcaacccataagcatttttaccatggcagcccactgagtttcttctttaactgcccccccttccttccttccgtctttccttccttccgtccttccttccttccttccttccttcctttttttccttccttccttcctatccatccattacataaaatgaacatctgctgtgtgcccgacattttcctaggcagtaggaacaccggatagagtgacacaaagttcctgatctcatgcacttatat

SEQ ID NO: 35145 - DNA, 1034 bp, Homo sapiens
ttgtagattctgaatgtaagtttttttgtcaggtgcacactttgcaaatattttactgaaaagagttctttgtggattatttttcaaagttgtcagatatacctactgaagtgataatttaattggaaagtctaaccctcatgagagctgagtgctctgtttcttaaagtgtggttccaagcccacctctatcataatcagcttgggaattaacattgcagattccctagggacttactctaggctgattaagtcagattttctgggagtatgactcaggtatttgtatgtatgcttgtatagatgtatgtatttatttattttgagatggagtttcactcttgttgcccaggctggcgtccaatggcgcaatctcggctcacagcaacctccgcctcccgggttcaagcgattctcctgcctcagcctcccgagtagctgggattacaggcacctgccaccacacccggctaatttttgtatttttagtagagatggggtttctccatgttggtccggctgatctctaactctcgacctcagttgatccacccacttcggactcccaaagtgctgagattacaggtgtgagccactgtgcccagccaggcatttgtatttttaaggtacactgcagcttgagaatcactcttctactgagttggtagaaacaagaatttctatcatattttagtgaagtaatttacattctttgactgaaatggatttgattttttttttaaactttaaggagtacagatgtagcccaagttaagtaaacataatacaatatagacaaactcccagatgagattttaagttaagatgactgatatttaaacatatatgcccgaacttagaaggataaataatcttgttcctttcaatgcagtcacttaaaggacctccaggtgtggtttctctccaaggccttaaagggttctacccatatattagtgggcaattccaatgacctttttttgatatttcctttcagagtttttcagaacctggttgatcaaacccccatacca

SEQ ID NO: 35146 - DNA, 1040 bp, Homo sapiens
ctagatggggaagatctgccctcaacattaatggataccatccaaatggcaggggtcctagagagaacaaaataaagaaggcaaattggtctctctgagagctgagacagacttttcttctgccgctggggacatcagaactccaggcctgctgccctttggactccaggacttataccagtggtgccccaggtcctgaggcttttggccttggcttgagagttacaccattgtcttccctggttctgaggcgttcaaatgtgaactgagccaccattaccagcatcccagaatctccagcttgtagatgacctgtcttgggacttctcagccaccataattgcatgaatcaattcccctaataaatcccctctcatatatctatataagtgccctattggttctgtctctggagaaccctgagtaacacagatttgctgtcaggaagctgaatatcatttttttcttatatattccttataacacagtggaagagatctgtaaaattgtccgcttgcagaaaggctgtgataagtgtatgaggctacttaatggtgaaagataaaaatttaaaagctaattaattgatgctgccaaagcagaaaatcgctaattgcaatggctgagcaataaccagactttcaaatggacagtttatagttacaaaatttgtagactataaccactttccaaatacaagtgcagcaagtgtttagaagattatagaaaagtggcaatgccagcaaaaattacaagataccttccctgccaagttattcagtcgtgtacgactactgctccttcacacatagtaacaattcattatgctatgtatttcatcttcacatcatttttaatactggaggtgtaaattgtgtaaataattttggagagttctaatttgttttatgcatttttttttgctgcgaatttgactccattaaactgcgttatcacaatgttgactctgtggataagaattgtatttgtatataaaaacattgaagcctcctcaaaaaacgaagaaatttcctttttgt

SEQ ID NO: 35147 - DNA, 1033 bp, Homo sapiens
ggatgtaattgcagaccaattgaatggatatattttgtgttgtaaaggagaatgcagcttacattaggaaattattattggctaacattcttgatcaagtctttcttggtagctacacaaatgcatttaatcgatgacacaattattaggataattcagtctaaaatctttctgttgaagacagtgactctatatgttataaaggtgaatcaaaatttcagccacaatttataggagtgttacttaacatcatcagtattttctcattcaatatctaaagtcatcttgtaatttttattgactgaaatagtaatacgaactatcttacttctttttcagtgtgtcatgttagaaaatcaattcgtatgatgaattctaagtatattgtgccaaagacttagagggaaaaattgtcagcatgaattatgatatgttctcctgttcatggtgtggctttattgacaaagtattgatttttgtacttaggatttaaaggtacatttttctcttcccatctgcttactctgcaaattggttgtattaagaactgggtgacttctgaaatcaacgacagtcatatttggatttttggtaacatctgggctaacccaagaaattgaaatgatgacttcagaattttttgacattatccagggccaaagaactatcgtatgttgagtaattgtatataactaagttctatgttagatattctttatagtttaagctgtttagttttcaaaacactaccattttgtgtaagtatttaatttccttcttctgcacataaaaaaacaaattcagcaagtttctgacttgcctaaaatcacatatttagtaacagagtgccgaggtttagaccaggtctgcctgaattgcaaggttgcgcatttccattcttccatgttgcctctcagcaataaagaaacatcttttccaataaaccttaataaacctgtttagaaaatcccatttagtttggatggtcaggatagaatttagagtagcttaaaaacataaagcaagcagagct

SEQ ID NO: 35148 - DNA, 1109 bp, Homo sapiens
cttctatggttttgaggctactggtatttaaggttgggaagaacgggatgggaataggctaagttaaaattccacaacttgctgttcttatagagattcaactgtttttcctgaataaaaattcatcagattgttgcaggcctttggttaatttccagagttctggaaaatatgattgtgaccatttttgctggtgttcttattgccagggagaagtgaattttgggaggtccttattctgccagtctggaagtgcttctttggtggctttatactgaggcaagtttttttgttatctaagatggctgccagcagcaactttgacatgtttcctgattcttaacatgcagggggaggggagagagaaagagagcaggattagcttttttcccccagaaacccttaacaaaccaaattgacatagacctactcttttctgaaactaatattaacaattgtcaacagagaagaaattgccatagttggcttactttaaacatttaggagtagagtagatgttggagagtctatcacactgctaacaggcttacttctggagaataatgttagaaaaggggaaggcacagtcttgaaggagaaaaacagttcagaaaaaagaagagtggagatgattgagaattcttgcccaagccttatctttaacgcttggcctttatttatgcaaagagacattttgatgtgggaagaatatttactttagttttaccatggaaaaaattaatttgttcacataggcttctacccattattttttctataatgtgataatgcagtaagattgaataaggctgcttcaagaaatagtgtggggcaatagattgaccattgagaacaagtttgtatggagtaaataggtaggaaagcagaatatttgaagctgaaagtattctgttgcacttctgttgctcaagttgtggaccttgttaacagtgcagtattatgtttggaagcagtagctatgatctgaagaccatgaaattgttgagtagatggaaaagggtgacagagttgtacctatcaagcagtattaagtatggtacattatgtactttggcctctggaagcctataattacccactgcagaaca

SEQ ID NO: 35149 - DNA, 1026 bp, Homo sapiens
tgatcatagtagagtcaattttttagaataattaaattggaatacaatttaattctaaaatatttataaaattttaagatttgttgaatgcctattcagatttttttaaatttatagataaagatatagatgtactaattatcataaacttgataggaaagttgatacagtaaaatatcaaatcacttttgagaaaacaagaattccttgagaattggtggagtactcactcatcaattagaataccatttactgtctttaccctgtttgactatccaaggtcagaatttcattgatatagatgaaaatgatgtagtctctagagcttacttttactttatttgtttactgctagaactagtagttttctagctctaccagcttactgtatagatttgtcatttgcattttatatctctgcttaattttatattaagatattggcacttacatgtaataccttgaggacaatttgaatattaatcattataatcgtcattgttttaaactcttgtatctgagcagccttaggaatttgaagtatctgctatgatagtatctattttcatgcttaagtcttttttcctactttaggtacccttattgctgttaatgttttcattttgtgtattgtttatgttttttaaattttttttttttttttttttgctttttaacaaaaaagcaactagaggttcctctactgaaaaactagttttcaggcctggcctctgcatatctctcctacccatgggcaagggcccctggtcttccatcagccggcctaaccctgatcctgatccctgggacaaatccctatcatgtggtgtgaacttgcctgtctttaatcattgagttgtttttttgctgctacctttggggtatagttgtattaactgaagctctgtcctattcctgttccatgattcttgacataggacttctgtctttttctttcagatttaatccttacgttgtgctgtagtttttgtaaacaatcatctgtttgtttttagctgataccct

SEQ ID NO: 35150 - DNA, 1057 bp, Homo sapiens
aagacaagactttgggaggggggctaaggtatagtaaaacaataatagttatttgtatgagtagagatgtttatttcctgtttaagttccaaaatcgttactccttccccattgtacccaatttttaaaaaaaatttgacccagtgttttccctgttacttttctatgtagctctctccaaattaaggactcagcttattatgagaatacttcttctcttgcttgctgttgaccaatacctattgagtaaaaagatacttcaaagaacttacaatatgatatctggcaaagaaaacatcgtcaaaatattgatgtagaaaatggaggcagctttgtataaggaactgggttaaactaaggacagttttttcacctgttctactttatacctggtacagctgcaccttgactcataaatgggaattctagctctccagtaaaaatttgagaaagagtttgcatcgcctgcatcgcctgtttgtcgtaaactaaatcaccattttcaagactcttccagcaaagcatgcaatgcatggatgatagggcaacctctggctacgttgcttatgtcttttcctttctgtttttctgttgttttgaaactggtgttgctttaatgggatgccggaggaaggtatagatgccagagataggtataaaaaatggaaatagtagctatctgcctgcacacacatcaaaggttgtttatgtgaatgtaaatacttagaaatataaacatgaatatatattacatgtttaaattgatgcttttggtaattctaattataatctttggaggtagccacaagtcttggtaagactgtgctgttgaagtgtaatgtggcatttctactgcagcaaaactagggtaatgccttgtgtaattgcaattaatcaaccttgcctttgggctttatatatcaaatcaaaataaagatgtaggaaaggaaaatgccattagtcacagtgacagaattgtagttcctgtctacagacttattcttccagtcaccatggcaatgaaatcccatttttctagtgattaagaagtaccaac

SEQ ID NO: 35151 - DNA, 1031 bp, Homo sapiens
ctaatttactgatgtagttcagtgccagtttgctccttctataggactgtataagactctgcatggcacttagcaatttcaggtacattaaaatgttcaattattagcatctagtttaataaacaattggggatatattttttacacgattaattttaaataaaaaatctcattactttttattggaagatttctacttagtaatgaggacaattactataatctttgcttttttaatcaattgagaatctggtaagaatgaagtatcttagtgagcctatggctatagtggattacaaagaaagtaacactatttgtggcatcggacctcttttcatcccttttgtctttagttcatataccctccttcccctttcccatcctcccttccccagttgatttttcatggggcatatattggggtatttctaaaatgcaaatgttatataatgcttaaatacctccattccttcaccattgctttttggatgaagccaaattgaccctaactttccttttctgtctcacttgacaccgtacttaatacccagccatggaggccttcactccctcagacctgctgtattcctgttgtgtgactttgtctcccctgcctggaatgttcagcactctcattctctgcctggtaaatgcctacccatacttcatgacatgctcaaatgtcagttcagatgataacgctccctgcaaatcttccaagcatggttggaagctctattaggccttgatccattgctctttatagtaataccactttgcatctcaattatttaatttctgggcctctctaactcccacagtgccttgtccatagtacatacttaacttccatttgatggaaaaactctgctttcaaagaactttatgaacagttgggaaatgaatacaaacaccagtgaacacatattacaaaggagattatttggctaatcttagctaatactctcataattccctctgttctatacccattacatgagggaattggattaaatgatttccagcatgta

SEQ ID NO: 35152 - DNA, 1188 bp, Homo sapiens
tacaaggagaaggctaagggggaataattaatgcaatattaataacaatattgttcctggagcaaagtaaatagtagttctattacatgatgcacaatttgaatcatgcatgcagtattttgttttgtttagaaagaagtggttacaaactagagcagttccaggcgggagcaatgaatatgaaagcatctaaaatttatcttgtaggaataacagcagaagagaatggaaacatttagcttgcaaaggacaagagctagaagtggttggtggtagtgatgttaaggaaagcgtggtggttgtcttccagtgtgtggtgggctatttctactacagggcagaacttgggtcccggagtggaaatgaacagggagcacatttctgttgaaaataagagaattttttcccatctaacaaggttgtttaaaaatggctttcttttcatgtggtgggctcgccatcattgagagaattcaagaattgcagtacagagcaattcctgcctagaccacactgactaactgaaactgattaccctgaaactactctatgactgacaccagccgctaaaaccctgaatgtttccttccctaacctcttctaccctgttggagatcctgctaaggcttcttcaaggtggtgctctcttctgctcagtaagttgaataaaacccagttttgtaagatttccccccaaagaattatactataaatagttattaagcacctactatggcaagtactgtgttagatgtgtaaaaaataagacaattttttttttttttttttgagacagagtcttgctctgtctcccaggctggagtgcagtggcgcgatctcggctcactgcaacctccgcctcctgggttcaagtgattctcctgcctcagcctcctgagtagctgggattacaggcacccatcaccatgcccggctaattttttgtagttttagtagagatgaggtttcaccatgttagccaggatggtcttgatctcctgacctcaggtgatccacccgcctcagcctcccaaagtgctgggattataggcataagccactgcgcctggccaagaaataagacaatctttatccttgagggtttatcatccagtaagaacatgtaatgataattaaatgttatcagttctatgacagcagtatatatggaggagaagagtgagcagg

SEQ ID NO: 35153 - DNA, 1045 bp, Homo sapiens
tatcctaccaggattgatttcaagttaacacagtaatgttaggaagtgatatttgagtgtttattagctttgcttttagagtaatttttaaatagtaagtttataaaatttgttttaataatcactgtgtttaacaatgggcttgcaaaatcctgaaagctgaaccatcagctctctcgagtcagcattcagcttctcacaaccactggcactgataatcccttttttagattgtgtgaattgcattattcgtcataatgttgtctccaagggacaacgctgccttggctagtattttagaatctcagtgttggagagagtgtgtttgaaagttatctagacatacattacatttgatacttgaattcccttggtgacattctggctataatagttggtgacataagtcattgaatttatgattatcatttgaaatagagctttcaattttggacaatttgttagaaaacttcacctttttgttaggttgaaattcttctctttatatagcatggatcatttgattctgtataccattcttgctctacatcataaaaaacaagttgagtacctctgtactatgataactcttcaagtatttaaaatgacctattatatttcctatcgatggctttatttttagaataaattcccttaattcattcagaggttcaagctcatctatttctttcttaaatttgtgcaactgattctcaatgaagctccagatgtggcctgacaggtgtatgcaagaatgggagagaaaaaaaacttccctagttctagaaactatactgctaactaagcagactaaaattataataactttcttgctggtctcgtaattctattggctgatactgaatttagcactgatgaaaatcctgaagtttttttttttatacatgctgttaagtcctgtcttcctcactctttattgtataggttttttttttttttcctgggtggggcatggggggacaaattcaagactacctatatatttttattaaatacttacctgtgtttataaaacctaaatccg

SEQ ID NO: 35154 - DNA, 1038 bp, Homo sapiens
taagataatatatgatatgatcataagatgaaagtgatttccacaaaccacattcaaaaaccaatgcttttactttaaagtcatgccagaaatgctggccggttctagggctcctaagtgaactttggaacactaaaaatcattttttactgaaagaattagggcacaaggtcagagcagatgatgttcaaatggaaaaatgcttcttaaataactgcttttctcaggatggttatcaacttgattgggaatcaagtgggttaagtgggtcaaggatccagtgacttttgtgggcagatcctgacacatgctaactggtaagtggtctcatggtataattctgttctactaccagtgtcacttacgggctctccaaacccccatagatatacttacagtctcttcccagataagcggtctcatggtacagctgtattactaatctcacttgtgaactccttggcaggggctctggtttgtatctatgtatctctagggctcatcgtagagctctctatagaaagttctctgtaaaacagcaagatgtttatgatgaagatctgaaaatgtgggttgaggcttttaatatggtgcatctctttccatgcattactattctcatccccatgccttttaaacattttctctgagaactttgtgagccataacatattaaaactaatacaaatctcggagattaattagtacagggattttataacatttctttaaaaggctgaaccttttttaaaaatgaaattatatgagaaaccccataatatgaaattggaagcaatgttagctacactgattgacctcagagactagagcaggcagaagccaatagcctccatgctttctttctgctgcccacctctctccccgatgctggcccctgaggcatctccaaagaaccttaggactccataggacactattagaaaattaatgcaagtccaagccccagaggacttacacttgtcaacacagaagtgatctttgaaatactgtactgtaagcatgactagatgatggtag

SEQ ID NO: 35155 - DNA, 1052 bp, Homo sapiens
gtggatggggcctttattgtagaagatgccacactttgcactgtccagtgtagaagccactggccaattcatttaaattgacaataaaatcgagttcctcagttgcattagctgcatttaaatgctcagtagacacatgtggccagtggctaccttatgagacagtgcaaatacggaacaattccaccatcacagacacttccatgacatagcactgctctagagagtagagaggaattcagtggaaggctgtccagggagtagggagtccagttgagaatggagagcagagggctccccttacagggttggaaatgcagatgtgtcatgcaggagatccaaggtccaagtctttgcccttgcccttcccttcctccacccaaacttctacctcttccaggcttacaccactgctaatccagcattaaccacaaactatatttcagttttcctgtaggacttaattctttttcagaaaatgtgcaaaaacattttctgcataacaaagcaacttcatatttcaactccgtaatcacagaactgttactctaggcatattttgcagtgaatgcatttgtgtaatattttctccatttctgtttataagattgttattttgcaggtcaagttgggggtgagaaagcatagagctgttatagtttgtttattagtaagcagtttcccttcatttccttttcttcacatactttggcttttaaactaaccaaaacagaagggtcttaagagtttgggagtcagaagggggatgggagttcctactatattttactgccataagtaaaaaataattaacaaaaatcaactttttttaataggtggggaagaaaacatgacagaaacagatgccttctataaaaggtaaagctgtgctcttttctaataaaggtctcttcctttgatggtcatgatcagcctacagaaatcaaagcaagaatgggtcctgggagctaggaagtaaaactgagtaggccaagttttagcctttggggagctcatttgtagataggcaggttgtgctgcccctggttgtc

SEQ ID NO: 35156 - DNA, 1001 bp, Homo sapiens
aaaaaatttgagttgtaggaaagttttctgtgatatttcacataaagtaaattttatttggaaggagaggccacaaacactttgagtatccaaaaatcatacttacctagcccctggagaatctttaatggacttagcctcatctttctttttttaaaacttatgttttgtgttttggacaaatggaaattttgttactgacaggtaactgtgagtgttctaacgctgcagaatagggagcagtgaggcatagctgagagagtaacatgggtgggtatgggtaagtgtaatggggagatttataacacagaaaatatttgtaggcagaaatggattttggaactatctatacagcagtcattatcatttatacctatttagtctatttgaatgcagtacttcagaggagttttgcatttcattgacagtaatccatccaaatgccttttgcagcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcagggtaaggatgatctggtggcttggggatgagtgtactttttaaagttgtatcaaatgctctatgttttagtataggatttaccaatagaaatctttcacatatattatctattgtgacacagacttcaattttctgaggtgaggagctgatgattttataatctaaaatgatttatagtcacagaagcaaaaagcattaggaaaccttgggagagtaggggtgtctaaggctgagagagagaagaattcatctaccttgtgccctaaaatatatctccagtcatcatgtaagaacctaaagtagctaaagtttgaaactctgattccagttgtcttagtccatctggactgctaccatagactgggtgacttatagacaacag

SEQ ID NO: 35157 - DNA, 1046 bp, Homo sapiens
accacgtgggcatggaggccccgcccccgtttcccgccccgcgcgcccctcccccggttccccgccccccccaaccccgcccccgccccgccccacccctgcgcgtcccgcccctcccgtgcgccgctgacgcgccgtgctccggcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggtgagggggcacccgggcccagcgagggctcgtgctttcgggggattggggtgacggagatcctggaggtgtgagtgacagatgcaaggcagaccttgacggtgtccttcggctgtggaaaaacttaaccactgctagaatcttgccgttctagtgattgagcaagctgggtacaagttcgcaccactattgttagaatgtgagaggtcacattctaacggagaggtgtaccccccgtcccatttgcattgcttctgaattaccttttccccccctcaattgcaccaagttgccgaagaacttactgacgtaggaatcatgggaatagagtggaacagactggttttagctcatttttgcttctgtaaattggatgaacatgcgaagcaaactgagaatttaaaaaccatgccgtattaactttc

SEQ ID NO: 35158 - DNA, 1032 bp, Homo sapiens
ttctgattgactttgacctctgctttccaactttgccccaaagaaagttagtcacgactttgccccaaagaaagtaagtcacgatgatgaacttcttaggcggaagcagccataaagtggaagatcactaaaggcaaccagctagttacttaagtttccactcagctgggctagatttaatccaggctcagagtcagagaatcacggaattctaatgctggaaggaactaaaatttccttttttaactacaaagtctgatttaaagctttctaagtttctaatttaaagttttccaggtttctaaggaaaccaaagaaactagttttattatatttcttgacctatttgatatcagattataaaatttctgaaggtaccatttttcctgccaagctttgatatatgtttggtagtattaccatggcacccttggccttctaaccaacaaggaagaaagagagtaattctgcatttatatgagtgtcacagctctttaacagacaatcccagaagacatctagatattcctgtgataaaactttctttttgggcctctatttctccacttccacctttctcactcttcccctacttctgtgttataggatatgggtggacatagtatggttattgattagatgctaattttgttagttttgcctgaaacagcagctttacaaattaacatttgaggacctgaaacacaaaggtgataggaaactcagaaaaccatggctcaccttgcaccagttatttagaatgtaaaataatgttcactgtgatcattgggtgcagctggtataatcaggggcagctggcagatcctacagactattctgagtaaataaagaaaatcttcatagccaatgggaacactacatctcaagttgttagtttgtaaggaagtgctgattgctcctaatataggtgattgtatctgtcagtcaagtgaacatgtaatcggtcctagctttggttacaggaggacatattttctttattactacttacacatttcgagttttaaataa

SEQ ID NO: 35159 - DNA, 1028 bp, Homo sapiens
ttaagcctagtacccaaaagtgatcttttctgctcctctccctcctcccaacctcctccatcaagtagacctcattgttgtttctttgtattcataagttcttatcatttagctcccaaggtaatgctattttatcttatttcttgccagagcatctagcagtaggaccaatcagttgatcgaggaatttattattattattattattattattattattattttcctttacctgatttctagttctgcaaaaggccacctttactttgccctgttattaaacagtccatgtcacttgacctgatcaaggaattttttacagttgaggaaattttggcaaaatgcagccataggctgagtgacatggactgtttaataacagggcaaagtaaaggtggccttttgcagaactagaatatcaggtaaaggaaaccattcttatcaggtctaatacaattttagatgatagtctgaatctttcagaatgtatgagacctggatgttctaggatgagaatggctggttgtgggtatcactagtgacataaacagaacttggaacagttattgccatcctgggactagcactcagagaacacattggtctgctgggatcacatctcacctgcttcccattactgcctacttctgtgccttgacagcctgagttcatatttctctctgtttgttctcatgcttgactaagtcacacccaataatttgttctgtctgggcggagaagcaggtcataggtgctatttgaatacacagataggcagatcaagtcagtggatgaaatagtacactattatggcaataaatggcatgctttttgtctttattacacaaacctgtgggtttacttagcacaagacaaatgggaaggtgtcactggaacataagcatatgagaatccacataggcatatgcagtgtgtctctccttttgcattctttgttgtgcttaggacttgaagacaagaaggtttgggaggtccagggagtattgttggttttcctttttcccctg

SEQ ID NO: 35160 - DNA, 1060 bp, Homo sapiens
caggcatgagccactgtgactggccgatacttatgtcttgattgtatatgagcccaacagtgatttgatttttttttttagttttttaaattataaattatatttatagtataaacaaattataacatacatggaatttacacattcttagattatttggtccgtaaaattagattaagaagaagcgaaaggaatgattagttaatacataggatactaacaagtatcctatgagttaattgcactctataagaataattaggttgttcatttagtgcattatattcttgggatggttttaggtgcatctaaatctaaatatgccaactttgaagcaaaagtaaaaatgtaggtaaaggtcatgttatatagtgtgacaatttcttgtgctttacatgtattctatagttgtagaatttccatctgtgactaataggtcttatagcagaaaagcaaattcattttagtgaacgtgtgttgacattataggaatgtcaacctagcacatcaggaattctaaggtcaatagaaaacttggtaagtctagtctgattcagtagggccacaggcaaaaagagataccatttgacctttttaaaaaatgtatgttcaaaagtaaaagcattcattattatgagaatatatatttaaaatgcctgaaggccaggcgcagtggctcacacctgtaatttcagcacttggggaggccaaggcaggcagatcacttgaggccgggggttcaagaccagcctggccaacatggtgaaaccccatctctactgaaaatacaaaaatcagccgggcatatggtgggatgggcctgtaatctcaggtactcaggaggctgaggcaggagaatctcttgagttgcggaggtggaggttgcagtgagccgagattacgccactgcagtccagcctgaacaacagagtaagactctgtctcaaaaaaaaaaaaaaaaagactgtctttctttacatcctgatattttaaaatctttttctttctttttaaaaaaagtttttaaatttctaatttttgtgggttaatcttttttaaa

SEQ ID NO: 35161 - DNA, 1030 bp, Homo sapiens
gccgtgaggccaggagaattgcttgattccaggagtttgagaccaacctgggcaacatggtgagaactcatcttgctttattaaaaaaataaaaataaaaagagaaaataataattagccaggtttgatagctgcttgtagtctcaactatttgggaggctgaagcaggaggattgcttgagcccggagtttgaggcagcagttaaccatgattgtactactccactccagtagcctgggcaacaaaatgagaccctgttcctataaatacatacatacatatataagtaaataaataaagctttcttaatgatttggcttattctttttaaatccagcaaatgttaattctaaactttagttctgctgttagagtgagacgagattagcacattatatctgctatctgggcttagattgtgggtgttatttcacacagataattcaggcaaacccgagatttttagggggtgaacttgcattatatggatacaataagcacactcacaatagaaaactatgtggcatatactaaaagaaaaaactctaccgtgtttttgagaattataccatggataagtaacagaaggctcatcctcagagacctaagagtttgtcttctgactaaacattttatggctgatatttcttccccacagagcattcagtgtccagagactcctttttccccagcaatgctggagggatgaggaatagggagtgtgaagctgatgacatgttctaccttttcatgatggagtacagaaaataactaaaattaggtgctaatggttgtccttcttcaggattaaattttactcagtggaaagaatataggttcttttatgtttatagtttatcatatctagatgtgctataatagatttaaactgttttctctaggtagttacaacataacagctccgtatgtcttgtttatatgcaatatctaggacatttggaatgaagtagttttccaaagcattatataaattaagttttcattgaccttaggccagaccatcaatag

SEQ ID NO: 35162 - DNA, 1035 bp, Homo sapiens
agggggacggaggttttgaaatacttagggggatatacaataaccatctaatcaattttctttttcttttcttttttttgagcctggtcttggctcactgcaacctctgcttcctgggttcaagcctcagcctcctgagtaggtgggattacaggtgcccggccccccatctaatcagtctttagacaacaaagtaaaatgagtgtggcaccattctggcaattcaggaatttatcttggcttaagtgatctgaaatatttcaggtccaagtattttattttctgaaatgagttaaccaaacattgtcttaatgattaacttaatttttcacatatggacacaggtgagccaaactgtcctttattaataggaaccagacatcattctacaaagtttgcctcagccctccctttactctttatgtagctcacatccacccgctcccatttacttctcatttatcttttttaggagggtttagggaaagttacctgtaccacatatgtcatttctgttgataaccctaggtaatctgagtgaaactatgacttggctatattgtaatgttaaaactcataacttcattcctttatccagattctgattgtacatgtattcaggcaggtacaaatgttggcatagttattgaggtttctgagaactttaaaaaaacccagcatctctaattatatttaccctccaataatttattttagagatacatgggtccttttttaaaaagtattgtatgggtcgggtatggtggctcacacctgtaatcccagcactttgggaggccgaggcaggcggatcacttgatgtcaggagttcgagaccagcctggtcaaagtggcgaaaccctgtctctacaaaaaatacaaaaattagctggtcatggtggtacgcacctgtagtcccagctactctggatgctgagacacaagaatggcatgaacctggaggcggaggttgcagtgagctgagattatgccactgcaatgcagcttgggcaacagagcaaaactgtgtctcaa

SEQ ID NO: 35163 - DNA, 1047 bp, Homo sapiens
ttcagtagctttctcctaaatatgaacaactagatcttacatttcccaggggaaacaagcaaggtttagttttccctcatatcctccctattattgctaacagtagacactctccattcttcaaccaggaagtcactttcctaaaagtcttcacagttcttggttgcccaccaggatttaataacatgatctcacagcttttctaaagatgtgatgagtcaaaatagaatgaaattttatcttgtagctcagcagctacagagaaacaaattggcatggcaaccaaaatttaatgacggcctttagggacatcatataatgatttagccttggttgagcttcgtagcctctcaaaactggtccacttatgtacaaagttggaatttggtcatgtcttcttgatgatgcaacaacttagctagttagatgagaaacatcccccttccagttaaagaaatcagggccaccacatgggtattgcattcagatactttctctcaaattagttgaatagtagacgtcaaatgtgcagaataaaataggtaacgtttgttaaatgcttaacacatgccacacttagttccaagtgccttacatgaattaggtattttaattcttacagaacactaatagtaagatccaattatccccattatatagatggggcatctggaggaaaggaaagccctgtagatctctgaaggccatacagctagttagtgacagagcaaggactcacatctaaagagcttggctttagagtctgctctaaaccacagcactgtcctgggtgctgaataaaagaagcgacttatagtatgctcagagaagagctctcagactgccaggtctggagtcatggagccatgttactggagagtaaacagtggctggcattttaaaaaaagaatatattggagtgaacaagccccagaaggtatctaccaaaaataattgcactagaaatgaacactgatcaactttgtaagtagagaactggtttatggtcctcatattaaaaaccagctttttggtgttctcacatgg

SEQ ID NO: 35164 - DNA, 1057 bp, Homo sapiens
ggttccttctcagaaggctgaggtgagcagatcacctgagtcaggagttcaagaccagcgtggccaatatggcaaaaccctgtctctactaaaaatccgaaaaaaaaaaaaaattagttgggcatggtggtgcgtgcctgtagtcccacctactcgggatgctgaggcaggagaatcacttgaacctgggagatggtggttgcagtaagctgagattgcaccactgcactccagcctgggcaacagagtgagactccatctcaaaaaaaaaaattgatgtgtcagaaattgaactgatcttccccttctaactacttttcttgggaaagtatacatagtgccacaactgttctccatatcacaaagtccagaatctcggaaccatctttgattcaatcttcttgcttatcatctatttttaatcaattgccaagtcctattggtttcctttccaaatatcactcttagacattctttcgtagtttggtctctcatttgcaccattgtaatgactttcttacagacctccccatgtataatttctgaccccttcaatccatctttcacattgtcacagaagaaaacattgtaccagtgtactgtacagcagagaatctactagctgtatgtcactatttaaatttaaataaactataattaaatacaataaaaaattttgttcctcagttacactagccacattttaagtactcctgtggctaattagcgactatattggacagtgcaaatataggacattgctatctttccagaaagttctattctgtttagaatataggcagataatagtgcctttactgttttaataatttgttatctttctctctagcttgtatcagaaagtgcaagtttcttgatgtggaatttaaagcccaaattatttttctagcattgacttcttttttttgagacaaagtctttctctgtcacccaggctggagtgcaactgggcaaactcagctcactgcaacctctgcttcctgggtccaagtgactctcctgactcagcttcctgagtagctgggactacagatgc

SEQ ID NO: 35165 - DNA, 1031 bp, Homo sapiens
aatcacctcctaaagactgtacctcctaatcacctcctacaggctgtattatcacactgggggttaatttccaacataggaattttaagggacacccacatgcataccagagcaatgggcaaactacaatatacttttagaagaggatttaagagatacaatcaatgaacatatccattcatttacaaatatttgtcaaacaccaaatatattccaggatctgtgtaatacactgagggtaaaatgctgttctaaaagaatatgatgcctgctctctgaaaccttaaagagtaatggaaagaaaagttaataaatgaatcatgttaatgtatgtataattaaaattagaacaattctctgaagagagggaatacagttcattgcaagtgtttgacaatggaagttgatcaggcttgggcagtcaggataatttccccaaggtttgatacgtgtcctaatatccaaaagaagagttggatttaactaggtgaagagaggtagcatgagggcaaggtagggaaaataagatgtgaaatgtaagccctgtgtgtgttagagaaaccggtcaggtattgtgggatcagaaggtgtcttttcttgcattgttttaagtgaaccaagttgagcgtgcttataatgtgaaaaatggacccagtaaggggaagaggttgaacacacaggaaaggggaagagaaatagttggggaagctctcgaaggagagggaagggaaagttgtgggatgcctgagatgatgagtaaagtagataattaatggggaagagacatacctcttactctgagcatggatgacaaaaagatggttgagacttcactaagtattcagtggtatctaaggcaagaccatctgctgagaaggaggagattagggttagattgggagcttgcagtgaacggtaagtgaatacataagaaagaaggacaaagaaattgagaaattgtttattagggcctatgaaatcaaacacatgctctagagaattgaacttgttagagagaaatgatatgccaa

SEQ ID NO: 35166 - DNA, 1066 bp, Homo sapiens
ctcctgacgtcaggtgatctgcccacctcagcctcccaaagtgctgggattacaggcatgagccaccacgcctgggtcctttttaaacaggaacacattgaaatctttaaaagaacttcccattcaacaatattcctcttgtttagaacataagaagttagtataaatgttatggtgtagaaagtggcaaagagattgataatatactattgataatatacgatgctactattttttgctaagggattagctctatcttatacatagctattatttccctttttctaatttatagcatattgtaacagaaaactaaaactcaattaatagaaaatgttgatttttgcagaaccattctttccattctttctagcccacctgcatagctgactagattaaacactcttttacaccaggcactttagaaaataaaaagtaatggtggtgcaggggaagaaatggaaatggtttagtctctgtttccatgctgcccccattctcttggtttaggacggagattcccacctgggcaagaagatggagaggctttctttcactctgggtggaccttactccacagtggatatggtattaatagttttgtctctggttttaatctttaccatcctggattgggtcacagaatgtcatcccaaagagtaatgtcagctgcagcaggcctggtttatatctaggagtcagattttagtgctcttgccccagcccctgtccattagagcacagtcttcactctttcctttttcccaagacttttacaacagaaatggggtgagaagcagctctcacttttttatttccttcaaacacccagtaagggagtgggagatcgatgagctcatctactttatctttcttaaagagaataataaaacattcttctgattgggtggtgttgaccattgaggagttgtctttggctccatcatatattttgagtgaaaacatactatctgaaccctgaatattaatatggtctttatatttattttcagtaagaaaaagataacaatatttgacattaaaaaaaaaaatccccaaagcccag

SEQ ID NO: 35167 - DNA, 1031 bp, Homo sapiens
caagaccagcttggccaacatggggaaaccccgtctctacaaaaatacaaaaattagccatgcatgatggtgggtgcctgtaatcccagctactcgggaggctgaggcagaagaatcacttgaaaccaggaggtggaggttgcagtgagccgagatcatgccattgcaatccagcctgggcgacagggtgactccatctcaaaaaaaaaaaaaacaaaacaaaaaaccataatgttaggagtcaaacttactagataagtctaaggttgacgtcttttatattttctaatttttctaaattaatatgaacatatttttagtaatttaaaaaatatttttatttatagtctattctatcatggttgtaattcatctcctaagaccataatatagcgatatttttaattttaaaaatataattttctttccctagaagaacaaaaaaattatgttttatttttcttcatttaaatttcttagggtcacaagccaattctattgagaactcaataccgttgtcatcctgcaatcagtgctattgctaatgatctgttttacaaaggagccctcatgaatggtgtaacagaaatagagcggagccctttattggaatggctaccaaccctgtgtttttataatgttaaaggactagaacaggtaaatgacattaatgttgatgagagtcaacatggtttaggttcctggtttaattttgttgttgtttgtatgattttacttggtttttccatagcctttctgggaaatataatttaggatctatttcttactccagatagaaagagataacagctttcataatgtggcagaagctacgtttacactcaagctgattcaatcactgattgcaagtggaatagcaggctctatgattggtgtgataacattatacaaatcccagatgtacaaggttggtattatgtattacagtatttgccatatattaaatattacaattacatattaccatatttgatattacatttatagtagttggtttggtgcctgaaaaa

SEQ ID NO: 35168 - DNA, 1025 bp, Homo sapiens
agccaccgcgcccggaagacctgactcatttctaaagtggcatgtcttcacaataaaactaatttttaaaaatgcttcatagttaattaatacttgctaggtcagtaacaaaatcttttctgctgttagaatctcagcaacataataataaataaaaagataacataattttttaaagaaaacttaatactttaggtttttgtattagatatttctttaaatttaaaaaatgcttcttgacacataactttagagttctcattctaagattgttttgtagatatagttgccagaaattaaataaaatgaataatatttcagagtggcaccaaagcttgatcatttttaaagaactcaatatttaaatactgtggaatttctgatataaatgtggctttaagatttttgtttttgtttttaacaaaagaagaaaacctaactgatacagggctattgtgtgtggtgaatattatttattattaaaataaggcagttgtaatgttttcttattttgtaggatctgtggaggcagtatttaatttgtaaagcatattttttgttagtttgttgaaaaaaggtatggtcagttggtatgaactgcccttgctatcaagaagtgtaattttatagatcttcagattgttagaagagaataagtacagtcatatatcattctgagaaatgtattgttttacaattttgtcattgtgtgaacgtcatagtgtacttacacaaacctagatggtatagcctactacacactaggctacatagtatagcctattgctcctcagctacaaatctatacagcatgtactgaatactgtaggcatttaattgtaacatggtggtatttctgtatctaaacagaaaatgtactgtgaaaatatggtataaaatatttaaaatggtacacctgtatagggagggagggaaggagaaattggaaataataaccacaaagttttggttgtagaagtcctcagaaaactatatatactatagctttttaatagttaacttta

SEQ ID NO: 35169 - DNA, 1027 bp, Homo sapiens
gtcttgaagtttagatcaactatggacttgaggacataagagaaaactgttcagtccttgagtttgcagggatttagaccttcacagctgtaaacatgaggtctaatttggcctgagccccttagaatggcagttgatcttcaggaccaaagcctaataacccagaccagtccaaatcaaaatctgacccacttcaagtaaatctgaaagattttatgctctgtattttactgttattcttgttgattttagtaagtttattctgtcctttttggaagaagttttatagttgttgcccccaccatagctctacataatgtgctttaaatcattatttttataatatagattactagaattcattcaaactaaagaaaaaaatcagaagattttggtctgtagttttgattcttctttctgtataggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggagggtagtcgttaccacattgctctaatatctgtctattcatttaagatgaagttttttatttgagagattattacactaaatatatcttagaaccagattcagtgtcatatcccttgaagcctttccataacctttcttcctttgaactttttctatcatagatagctattccaggtacaatattcccttctagctatctagttccttcttgtttctcctcccaactttgtcaacacagacccctgaaagtatcttctaccattgtcagttcttctcacagctgtaactccagcatctgacccctttacagccctttcctgttccagaggaatgactcattgcaagtgtctcatcaacaccattggttgaccttagcataaccttttagtgtctctttttgctttgggatcctgaactcttcaactgctgctaccacccttgcattcctagga

SEQ ID NO: 35170 - DNA, 1047 bp, Homo sapiens
ctcctgacctcaaatgatccactcacctcagcctccaaaagtgctgggattacaggagtgaaccactgtgcccacttctttgtaatttaaatttagcagtgccttctctctctagaattattattactattactattattattattattagagacaaggtctcactctcttccttaggctggagtgcagtggcacaattataactcactgtagcctcaaactcctgggcccaagccaacctcctgcctcagcctcctgggtagctgggattacagatgcacaccaccacacctggctaatttttaaaaactttttctagagatggggtcttcctatgttttctgggtctcaaactcctgccctcaagtgttcctgctgcctcagcctcccaaagtgctgggattataggtgtgagcacagtgcctgaccctccctctagaattttttttttttttttttttagatggagtttggctctgtcacccaggctggagtgcagtggtgtgatctcggctcactgcaacctccgcctcttgggttcaagtgattattctgcctcagcctcccaagaagctgggactacaggcgtgcaccaccacacctggctaatttttgtatttttaatggagacagggtttcactatgttgaccagaatggcctcaaacttctgaccttaagtgatccgcctgtctcagcctcccaaagtgctaggattacaggcatgaactgctgtgcccggcacagaaacttttaatgactttaaaaaaattcctggccatgcacagtggcctcccaaagtgctagataatcccagcacttggggaggtcgaggtgggcagatcacctgagctcaggagttcgagaccatcctgggcaacggggcaaaaccctgtctctacacaaaattaaaaattagccaggcgtggtggcatgtgcctgtaatcccagctacttgggaggctaaggcaggagaatcccttgagcctgggaggtagaggttgcaatgagctgagattgtgccagtgccctccagcttgggcaacaga

SEQ ID NO: 35171 - DNA, 1061 bp, Homo sapiens
aagtcttgcgattacgggtgtgagctaccacgcctagctctaatatgtgttgttgaataaacaaatcagagaaattttaaaattatattattgtccttttttgtgcttattgatagttaatgagtacataataataaataattgaagactttagttactgatttattcgttcaacacctatttattgaacacccattgtgtcttagtgctagtgagcatcctggaatacatagataatcaaataattagatgtatgtgattttgacatttattctttcaggtgaaacctggagatgacttagaaagtgatcgatacttaatcacagttgaagaggttaaagttgctggagccataggtattgttaagcagaatgtcaataaagaagcaccagagttaaattcaaggacatttatatcctctggccgatctcttggatgtcagccctctggcttaaaaaggaagtttactgtaagttttgctatggaaaataatatatcaaaatatatttataaaattgtctcgaaaagtagtgaattttgaagttattgtactctgtcattcaaagggcacttcatagtatacttaggtagaaaggaagtaaaccctactttgaaaaatcttattacaaatgaatgtactttgacaaactttaaatctgaattattactttaccttaggcaaaccagaaacaatccttctcctttttttttcttagccagttcatttcacattttcttaatgggtaatggtacacctaacagttattttaatattttcagggttttcaaggaccacgtcaggttccaaagaaaatggttattatggaaagtggtgaatcagctgcatcacatgaggctaagaaaactggccctactattttttctccattctgcagcatgcctcctttgtttcctactgttggcaagaaagatgtaaataatatactggcagaccctgagaacattgtgacttacaagaacagggagagaaatgccatggatttttcttcggttttttctccatccttccagattaacccagaagtgctgtgtgaagaaaa

SEQ ID NO: 35172 - DNA, 1107 bp, Homo sapiens
cattttccaatatccaacccacttcccatgtatagttccaaaaatataacctctccccaagcctgtcttgtcttctgactttcggtgtgttgaggttagataattgttttaatgcccttcatttctgatttattttcctctgagcaacaacaacaaatagaggactaaaaacatgctatttctttgttttatatgcaaatacttttctgagtccctaatgtacacatctcccaagatgtacatatggctcccaggattcaccacatctcccttttctgccccagctgttactgggagtggagggtgtgccaagcctccctggcagcctaatgcaggacctcagttcctgctgcctgtcctttttcagtagtacctgacagttattcttggttgaagtctctctcatgtttaatattatcttttacattatctttttaccctccaatcctagatgaatttaatacctccaaacttgtcattctgtttataatattttaactttttaataagcttgtacccattaactgcaaactgaacgaaggtagggcctagattaggtctgtaaattagagattcagatgatctctgtatcctggaaaagagtacaattaacacagaaagaatatattgtaacaggagttaagggttgaacaggaagtagtggggctatcacagagatgggcaaagcaaatactagagatacataaattaagtaggaagtcctgaccctggaggagctaaggcttttgtatctataactatttaccattcagggtggaagtatcttaacataggaatgtatgaggtgctgtgggaacacaagacaggaagtacaaaaacctgcctctggagagaggttcaataattgccttaacacttatggttgcctaaaggatgaatgggactttgctcactgtcatgcaagaagattaaggcattccagacagagggatctgcacatggaaaggctcagaggcatgaaactattttttctattacagtaaaacaagaagtttgataaagctaaagtatactcgagtgagtagtagttaatgaggcaggaaatgattttatgtttttttgaaggatttggatttcaccttagag

SEQ ID NO: 35173 - DNA, 1081 bp, Homo sapiens
cctctaatatgcacatacacgtgtgtgcacgcatgtatgtacgcatatgcatatctctattaattgctatgttacgttaaattaggggaaaatgcttctgatatgacatggtgcccataatttcatgtaaaatgacaaatacaattaacttaattatttacatatagcacgtgatcccacttttgtgggaaaagcatctatttttatgtgtgtgttttcaaggggaaaaatacatgtttaaggatgcacacatgcaaaaatagcaaaaggatacatggaaactcatactcaatagctatgatgtgtatcatctccttttgttcagaaagtgtttctaaactgtgccaaaattttgtcagatatcattaatatttgaaaaattgaaatgaaaaccattttctgcgaaagatattgcctactatatttatggcatacagaaaattgtgacctcatgtgtctaatgatagacaaataaaaaagataaaaatgtttagtgtagtatagatttgacttacgaacactgtctcatgttttaaaaagttttgattttttttaaatcatctaagaaaaacagctatatgaacacatttgcaaatctattgatgcttatttttttttgcttctttttaaaagtgattatgttttttatcttcccagagttactggaggtgaactgtttgaagacatagtggcaagagaatactacagtgaagctgatgccaggtaagtgacttgccctgggcaagatacaagactcaacattcaaataatactttttcagcatatttctttacaaatgcatgtttgtacaaacaaatgttttaaggatctccgggatgattcttagagaaaaaaaactccatgaatctggtctatatttttatctagcatctgtagttagattacatattttatcaaaaacaacaaggaaaaacaaaccaaaacaccccacctaattggaatgacttctgctaaagcaatatattttttagtgaaagtcagagatcaaagattgaaatcctctaatccctagatagattctaggttgcccagtggtagccagtagtcacatgtggctatt

SEQ ID NO: 35174 - DNA, 1086 bp, Homo sapiens
gaagaaatggttgatgattttttaaaaactttcatgtcatgttcgttcccaaaaggagagcatcagtactaaaatgctcaggaaaatcaaaacataattgtagcttctgaataagttaatttttaaaagattacctcaaacaacaaacaacccagctcttgatataaaatctggtgacttagagattgtatgtgtgtgtatgtgcatgtatgtgtgtacacacaaaacacatgttttgttgtttggagtttttctttccatttttattttaggtttgggggtacatttgaaggtttgttacatagataaacacgtgtcactgggattcgttgtacacgctattacatcactaatgtattaagtccagtcctcaatagttatttttcttctccgcttcctcctcccaccctccttcctcaagtagaccccagtatctgttgtttccttctttgtgttcataagttcatatcttttagctctcacttataagtgagaatatgtggtgttgagttttctgttcctgtgttagtttgctaaggatggtaacctccagccccatccatgttcccacaaaagacatgatcttgtccttttttatggctgcataatatttcgtggtgtatatgtaccacattttctttatccagtctgtcattgatgggcatttaggttgattccatgtatttgcttttgctgggtcgaatggtagttctgcttttagctctttgagaaaacaccatactgctttccacaatgattgaactaatttacactgccaccaacaacgcataagggtttctctttctccccaatctccccagcatctgttattttttgactttttaataatagccattctgactggtgtgagatggtatctcattgtggttttgatttgcatttctctattgatcagtgatattgagctttttttcatataattgttggctgcatgtatgtcttcttttgagaagtgtctgttcatgtcctttgtgtttggtttttttttttaaataaaaatttcattccagtgtaccaaattaaaattgccaccagtaaatactttaagcatcctttcctgtgtat

SEQ ID NO: 35175 - DNA, 1032 bp, Homo sapiens
ttgcacatttaatagaccatggtatagtgcaaacataacttcatatgcactgtgaaataaagctgtgactcattttattgtaatatttgctttattgtggtggtgtggaactgaacccacaatatctcctatactacttcatgggtagtatcggtatcttataataacaaaatgttagtcttctctcctgtcccttgtatcactgctgttatttatttcacttatacataagtacacacacacacacacacacacacacacacacacaagcatacataattgaataaattgttgctattattactttggacaaactgttacctattagatcaatttagaatatgaaaaatagtttttattgtcttcacttattccttctttgattctctttctggctgtagatctgagtttccaatctttgtaatttttcttctcctgaaaactttgttttaaacatttcttgcaagacaggtctacagtttctttttgtttgtctgagaaagtatttattttctcacatttgaaggataatctcacagaatatagaattctagggttttttggttttgttttcttcttaacactttgtttcattccacactcttcttcttgcctagtttctgagaatctttgtaaagattttttctttgttttttctttttctttgtttttctgatgtttgaatgtggtatgcctagggattgttttttagtatttatcataccttgtgttctctgagtttcctggatctgaggaaactgtcaaactgttattgctgtctcacaataattattcaggaagttatcagtcattattgcttcaaatgttgttactatttctttctctctttcttctccttccactattcccattacacaaattacacatatttacactttttgtcatcgtcccacaatctaagttgtcttggatattctttgctttcttttttatcagtctttttcttcctttgctcttcagttttagaagttttttctattgtcatatcttcaggcttagagattcttttct

SEQ ID NO: 35176 - DNA, 1032 bp, Homo sapiens
ataatgttatctgtcttaggaggcaatggggtcaatctggttacttggttgaaatttggttgaaagtaaactgcaagaaaggaagggagataaattaggaggctattgaagtgatccaggtaagacagtgctggcttggacccaggtggttgtaggggaggtggtgagaagtagttgtattctggttatattttgaaagcagaccccataggagctgctgacaaattgaaaatggggtgtgagggaatgaattgcctcaaagataaggtttatggcctgagcaatttagcaggctggaattgtcatttactgagatggggaaaactgcaggaacaataggtttggtgggaaggaacaagagctaagtttggtcatgttaaatttgatatgccttttagacattcaaatggagatagagagttgacccttggatatggtccagaattcaggggaggagtagagaggtcaaatttggagataaaaattcaggcttgtcaatatacagtatttgaatcactgagactgaataggaaattatttcaaaatttcttctgtcattccttttccccccttagtttatttttctttattttacttactcttcttacctatcttcccatcccacaaattccaaggcagaagttagtattgacagttatcatccagcttgggagatgtggaggaacattgtacttttcttttctcacttcgtgatgtaatcagagtaagtgcttattgtagtgaggtgacagcatcttcttggtgactattaggttgtgatcaaatcatgttctaaatagaaagtgcgaaacttattttcatgttccttttattagcagtatttatttttccatcaaccatatgctaataattcatgaatcaatctataaacacttaaagaacactgtgtacctgtactgagaatgaaataagagaaatattactaaaagtttctggcctcaaaaaatttgctaattagtagaaagcctggtctcacgtagtaaaccaattagagcacaatgtatgatagca

SEQ ID NO: 35177 - DNA, 1040 bp, Homo sapiens
aaagaaatacatctttaaaagtccaaacattttaacttaaaaaattttgattttaaagaatcaacagtgcattgaagaagttcttataggtttggtgaccagttaaaacctaatccctggccaggcgtggtggctcacgtcagactttgggaggccaaggctggaggattgcttgagcccaggagttcaagaccagcctgggcaacatagcaataccgcatctctacaaataaaaaagtcagttgggcatagtggctcacgcgtgtgatcccatctactcgggaggctgaggtggaaaaattgtttgagtttgggccagtcaaagcttcagtgaattgtgattgtaccactgtactccatccagcctggacatcagagcaagaccctgtcttaagacaaaagccacaaaaaacacaaaacagacctaacctatttttaaaattttactgtagcattttctctacaccactaatataccacattgttattatatcatctatctgtatcactcactgaaccctcgactacttgagggtgaaaattcaatcctattaaatctgtattctcatatttagcacaaatcaatctgtattctcaacagctagaactcagtgagtactgtttaaatgaacaaattcacatttatcaaaacatgctcccctattttctttagctgtgccgtccagtatagcagctactggctgtatgtagctagtgagcacttaaaatgaaatgtgtctagtctgaattaagatttgatgtaaatatgaaatacacactagatttccaagattttgaatgtaaaatcacttatgtatatatatatattttaagataagagtctcgttctgtcacccaggatggtattcagttgcacaatcacagctcactgtagcctctgcctcctgggttctcatgactcagcttcctgagtagctgggattacaggtgcataccaccatgcctagctaattttgtatgtttagtagagatgagatttcgccatgttggccaagctgatcttgaactcctgatctcaa

SEQ ID NO: 35178 - DNA, 1015 bp, Homo sapiens
ctagggtaataggctaaggaaagatgtaagaactgtggaactagttaggagactattgaaataatgcaggaaagagacgatgatgatgacttaggcgggaggttgtttgttaatatataatccactgttattgtggctgcaaatgcaatcctgtgtctttccattgtccatttaaaagcaattttacaaatatcacttttttaaaacagtaactacaatgccataagagcctttttttgttgtaaactactgtggcaagaaattagttttaggtagagaattgcatgtgtacttagctgtgattgtattaggactgttctttggaagacttttattaataatgaattaataatagtgaaggttttctaagcagactctcttgcactgtagtaagtgtttcctatccattatctcatttgatcttcactaaaatcctgtgacatatgtgctgttattatttccatgttgaaaataagaaaactaggggactgagaaggtaaggaacttcccagggtaacaaagataaaaaattatgcatcacaatttgaacctagttctttctgataccacagctcaaaccttaaaaaaatctaaaataccttttattgagaaactacttacttataataaaatgcacagatcttaaatgtattcagtggattttcacagttgcatacacatatgtagctacctccccaaactgaatacaaaatgtttctagcactacagaatgttccttcatgctccttctggtcagttttcccccaacatcctcccactctacagactactatctggttttgatcaccatatgttagttttgccttttcttggacttcatgtgaatggaatagaacaatcataatttttggagtctcatctgtgttgttacttattgtttgttctttcttatggctgaggagtagtagtattttattatatcaatataggtccatttcacctgttgagggacatttagattgtttccagttcttagcaattttatgaataaacc

SEQ ID NO: 35179 - DNA, 1034 bp, Homo sapiens
tcaatagaaaggcaaattaatttctgataatttcaacgttattggtatttaatttggagccatacttatacctgataacttgacttttccctttgtttgaggatatttaactcacttaactcacaggctgaaaagaagtagagaaaaaacccagatgttcagtttagcaattaaaaaaggatttgcacttgctgagtacagttttttaaattagacagcatctagttactctttgatctttcatttgtggtgttcatgcctaggcattttaaaactaactaaagtaaaaatgcttactcaggagaaaagacactgaggaccaaggctcctttaataaatggaaggcaactgttattacaggaacataggaaagtattcaaaagatttcttttgaaatcatttcagaagctgcattaaatggttctttcattcctgattctggtttgccgaatatcaccattagtcattaagcacattgctttatcatttcagtctctgtctctgcacatacaactctcacccctcaagctctccactagtctacctcacctttctcttcaaaacttctccaggggccaactttttgttaaagctgtcctatgcaaactcttttactttatatccattacttatttaaattaatttttaccctgtgtttatttgaaatcatttggaaattatgaaataactgaccttaagtctttttcatttatattgtacagtgcttctagtagagaagcactaatatatctatattcctaatatatatatattttgataggatgcgctgcatagatgaagatgagatagctattaactctaaatgaataggcatgaacttttcagggagtcagaggagctatagaaaattcacgtttagctccttttatttaaataatatgtaaaaagtcacatttctttgatgacttaaacctgctgtagttataaagtgcctaaattgtgagtgcaggactcttatcattgaattactcctagaggtcttgaattcatgcacgctgattaaaatatgtaaa

SEQ ID NO: 35180 - DNA, 1050 bp, Homo sapiens
agaaaataaaggacgggaggataattagaatttgtttttaaaaatcggctagtactttaaaaggtagttcctatagttgcaatatggattaatgactgtttaaaaaagttcataagtttctgctcaaatccaaaactaagatatctaaaaatggtactgacattattaactgcttgaatgcctattgtcaagagtagtgtttggcacccaccacaggtatttattgaaaacataaaggaataaaatgattcccaaatgatatcatcttatgattaatgaatacacatttgaggacctagaacttttagcagtaagatttgcatacgcttttcctattgaatttaaaaaaaaaaaaaagttcaaaattctgttagattaattctgtgatatagtttataatttggcataagctggtagtagggaaatagtcacttctttatgcccatgatttatataatgaaacaatcttccattcacttagaagacaacttcgatttaaatatttagcctccctagcaaggcccagccatgcaattttttccctgttagaagaattttagcaacagtaaaaaaaattaatatgtaagattttgctatttttattagttttgaggactgcttgccttgtagtttaaagggggtaaaaaggatcattgttttactcaatgtatatatatatatatattattaatggtagattttttttttttttggttgatgtaggaactttgggagtagagcagaaagcctattgacttcaaaaatagtgactcagggttggtataatcattagtaagcaggttgggaaaaatcctaattccagacctcaagtagaattttagtatcagagtcactcctgttccttaaatgtagatctcctgatttcaggccatttttcattctaatagaattagagaagaaaaataaaacctgtcaacgaggactatttacctcctatagataggattgagacctacttttctgtaacttttgaagttatttttgggaaaaatttccttgggttgactttgcccccttcacccaatgcat

SEQ ID NO: 35181 - DNA, 1112 bp, Homo sapiens
tatgagcaatagcatgaataactatattttaaagcaaataaatgtcaggtgcattttgcttatagtttaagtataaaacaacttttagaccatggaatggaaaaatataagtctcacaactgtcataattcccttttgcttttgagagggaagtaggtcatagctcagttgaatcatacatttcaattgtagttacacttgaacttaattcatcaaggtatatttaacagtaatagctttggtaagaaaatttatgattgctatattctaggaagtttagttttattttgatgtttctgtgtgcagctcagaccttggtcttcgcattaaggcttcacacagactcatgtaatgtattttacacatgtagtttataggtacagagataattcatactcgtaaaatagctgttgacataaccaaaaaacttggagggctctcactgcattctttttatttagtagaactcatgcaaaagtacttacgctgaaatgttaggcattccaattattgtgggcacgtgtctgaggtatttccatgggaatttatggtataaaaatgaaatgaaaatgaacaaaataccatagtgtacgctcatctcagtgacctggtttattttaagtaatgagagaagaaattccattaggtttagttttcctcatttaatatgtcttttcaaaagtgcttcttaccaaaatcctggcatcattgctttcggtctctgccatgattagtttttccatatttattgcaaattctacttttaacatgcattttaggtttaggttggtattttagtttatccattcacatgggttgttgttttaatttccttcatctgattttgacatgattctgagaaagatctataaagtaaccagcaccatagaatcatggtatgaaaactaatgagaagaatattatgttaattatgttctcttagtctctactccacagaaaggttttaacaatgaaaaggaattgctaaactataagtgacattttaatttaaaaaaatgaaaatgtgtagttagaatctttcagtgcttctcttattttcttctgtgtgctagatacttttggctgtggtgggggtatcatttcttttgaaa

SEQ ID NO: 35182 - DNA, 1051 bp, Homo sapiens
gtctgtttttgtaccagcaccatgccgttttggttactgtatcctcatagtatagtttgaagttgagtagcatgatgcttccaggtttattctttttacttaggattattctgggtataccagctcttttttggttccatatgaattttaaagtagtttttttctaattctctgaagaatgtaaacagtaatttaatgggaatagcattgaatctgcaaattactttcatcagtatggccattttcatattgattcttcctatccatgagcatagaatgtttttctatttgtttttgtcctctccaatttccttgagcagtggtttgtagttctccttgaagaggtccttcccttcccttattagctgtattcctagatattttattccctttttagcaattgtgaatgggagttcattcatgatttggctctctgcttctctgctgttggtgtataggaatgcctgtgatttttgcacattgattttgtatccagagactttgcttaagttacttatcagcttaagtagcttttaggctgagacgatggggttttctagatataggatcatgtcattgcaaacacagacaatttgacctcctctgtttctatacgaatacactttatttctttctcttgcctgattgccctggccagaacttccaatactatgttgaataggagtggtgagaaagggcatccttttcttgtggccgttttcaaggagaatgcttccagcttttgccaattcagtatgatattgactgtgggtttgtcataaatggctcttattattttgagttatgctccatcaatacctactttattatccatattttctactcatctggagctttcctgtggctttgatccagcaggatctaattcttcctaagggttcgtgttcttacgtgtcactacaggattattagcatgatttgaacaattattcgtggtcagaagtggtggaaaaagtataacctaaataatgtgtgagcactgagaatctctggcccttgcatagagcagatattgaaggaaatgaatctt

SEQ ID NO: 35183 - DNA, 1067 bp, Homo sapiens
tgagagatcatgggacagagggaggggtgatggaaagtgatggattctgagtatattctgcagatagagcagacaagattttttgatgaactacaaatgcaacaggaagaaaaggaggagtcaaggacaaattcaagtttattcattcaactattagaaaaaaaaaaaaaaaaggtgcctgctccagcagacatgtatcacaagttacaggaatctctttgacaattatatttcacatttcaaagcctaccaataaataatagtctttgtttctcccttctttttctgactcccttaggttttatattttgaaggattgcagttatagatttttttttcttttatcatagtaagtggtgtcagaaggtctgcatctgagttctggctcagccactcactaatatttcaaaagaaagaaaaagcagcacaggtgaatgttggggcagggtgctacattagggcaagcatgcttgtctggcctcacggctgtcccagagttgaatgaactgggtgaattcaccattctcccttacttcactacgttggacttgtagccaaaactctgcatgttattagtccatccatatggtcagatggttgatgattaaaagaaatcaacagaaagagccaatgtatgcactcaacatccctattttcatcaaaatgaaaatgttgctacttcagactattgattgcatcaaatatcaagtgtttacacacacacacacacacacacacacacacacacacacacacacagagagagagagagagacaaacacaggcacacatacatgtttttccctttctcttggattaatgtcaaggcaaaagagtctgagcagtagttggtggtcctgcacttacatttttagaattataatttttaaggatttacatctggcaagatttttgttaaaacttgaagtccacctattttgcttcttattttaaaatagctaaaaataggtcatttgctttaatttatagaacattgtcatttattacaacttttccacattggtgatctcttctttttgttctccaaaagcaaagtactcactaaa

SEQ ID NO: 35184 - DNA, 1029 bp, Homo sapiens
gggttaaaattaaaccccatgtgttttaattttaatatattttatctggcatggtgttctgcatgatattgttagttctgagatgtccaaaaaggtgactggggtgtattttttaaggtctctgcacttgcaaactgttttagttgttgttggttgtcatgtttggcagaatctattggaaccctgctaagcctgtgacaagtgagaggaaatgtgtatttaaacagtgatgttaaaagtataacactaaatgagaaattggaaatagggtaatggaaaggccagtgattaattacttcaaattccttcaatcaaaaatctcaagacatgttattgaatattattaatatatcttatccagctttgaattccaactcacccctggggctacaacttagaaggtacataatagttttgaattaatatattgttttagggttcataggtattgagacatctgtgctctattatcactatttcaataacctcctaaatgattatattgcttacaggttctgaatccacctctacaataagacctgagtaaaattcctacaatagtcgaaatcatgacacttccctgcttaaaatttttagaagtttccactacttggagactaaagcataattcctaagcattccatataagggccttcaaaatctggcctctgccaaagttctgttgcaatctcccaacaattttccatttataccttctttggattatcactgccagagtacttgtactttcccactaggcccgcatcctcattttcctgtttccttctaagcagggcttcctttggtagagtgttcttcattcatctctgggaagacatcattgcatctttctagactctctaccaccctcatctcctcaccaatgcttttctggtcattttctcaccccacctcaggcagagtcaagtgcattctgctctgttcctaccgtcttttctgcatacttctgtttcagtttttatacttacttacttctttcctcttaatccctgagtgtacaagaataca

SEQ ID NO: 35185 - DNA, 1033 bp, Homo sapiens
gcttcttcactctcctcaacagtgttttggttttttagtgtatgttttttagtggttttggtgtgtttggttttttttagcgatttttcattttttttattaacgggaggttttaattttcttgtaatccatgttataatctttttctttttatgtcctatttaagagattctccctaccccaagatcatgaccatggtcttttatccctaagagttttattgttttgtttttgtatttagattacgattcatctgaaattagtttttagtatggtgtaaatgagagttcaagattattttttccatgtgtatacccatttgacccacactgtttattaaaaagaccataccgtctccattgcactgcagcatcaccttttcataaatcagatgaatgcacatgtttgatctgtttctgcacttttccattccaattctcattgttttcgctatcgatttgttgtgtcaatgctatgttctcttaactactataggtttataataaatattaatatcttgaatgtaaaacctcctgcttgttcttcaaaattgccttggatattttttaccagttcattaattttcctaggaaagaagagagagtatagatgtacagatgcaaatagcttggaagatttggttttgggactctgaagtaattctcttctgaattatcctacaggtaattagctgagaaggaagatctgaaggtttaacgagagagggcgagagatacaaaatatctgctaggagagtaagaaagtgaattgggtaaagaaatgcagtaaaaatactgggatgtaacgagagcccacttgagatttgtggtcataaattttaacagacaccaggcattttttgtttgtttttctcccaccctgcttggtgcttgtgtgcagaagtacagttgaagaggtggaattaactagtttttgagatttgccaaataattagcatggtggatcatggaccctttgcaaagaaagggggaatactatgggggcttatgttctcttaaaaagtgctgaggtc

SEQ ID NO: 35186 - DNA, 1047 bp, Homo sapiens
ttttgtatttttagtagagacaggatttcaccatgttggccaggctgatctcaaattcctgacctcatgatccacctgccgcagcctcacaaaggctgggattacaggcattagccactgcgcctgacctagtcaacctagtcttattggaaacttctgtggtttgaatgtgtcccccaaaagttcatgtgttcaaaacctaatccacagtgcaacagtgttaagaggtgaggcctaataggaggtgattgagtcatgagggcagaacttttatggatggattaatgttgttgtctcaggagtgggggagttataaagtgattttggctcctggtgtctctttagcatgtactcacttgcccttttatccttctgccatgagataatgaagcaaggagcccttcatctgatgcagcttcccaatcttagacttctcatcttccagaactttgagctaagtaaatgtctcttctttctaaattacccagtctttggtattctgttatagcaacagaaaatggactaaggaaggttacagaagacttcaaaatccactattatttttagggcaataccctctgctttttaacataaaaaccacttgtattagttttaagaaagaagtaaggggcttgccctggcaaatcggtataagcaatattttgtgtccatgatttcacttggttatcttaaaataatgatgcttaagtagtgactttctcaggtcaggctttagctcccagatgaaactactaagtatatgtttgtttgtacatgtcagtcccaagcctgaccctcccttggtccgcaaagaaagtagtttctgtatccatgagaaaaaataagcactaaggactttgcccctagtgttcagacttattatgttacctgtgtgtattttactttatgattggaatctcattgtgagtatctccattgccttgtttctcattcattgcctcccttagtttctgtaataaaggactatggcatagtaaacaaactgtctaaaggaatattccacataaaagggcaagctaggtagaa

SEQ ID NO: 35187 - DNA, 1042 bp, Homo sapiens
cccgaatatctcctttcataacaaaaaaaaatgccgctagagaagataacatgatagaaaaattagagtgcaaacataaaactagaagggacttttatcatccaactccagatatatgattaaatctgtttcttcctaactcaagcttttctgcacaatttttctttctaaatatgactaagtctatctttcttttcaatctttctcccttgtttttttaatatagaattcctaaatgaggcaaaatatcagtctactgagaataatacttttcagcttcgtattttatagttaattatgttatgactcatagaaaaattgatcccaaggttcatcatttttctttttctaatttctcctgttctgaagctgccgttccaccacttcctcgttaatgtaaaccaatagtggtccttgtttgaaagcacttcatcagaattagcctcaagtgagtcagctgatggaagaaatagtaataaatgaacatgtgtcaaagagagggctgttgagcaaaaaaaattcagttaccttccagcacagactacagaacaatttattaaagtgtcagaaacaaacctttaaggtaaaaaacagctgatacaaaattctctgattacctaaaatgaatctttaatgaagtaaatgaaaaagaacagtattccaactgtgctgtttatcattcaaaattaattggataatggttaatttgaaaatataataatctctactgaactgactgaatagtgaataaaatgaattttaaggtttatttacacatagtaagacttcaaaatagatgttaattaattatcatttgcaagtagtttttaaaatgttgctattgaaatcagcttgacaaaaacaaagtcatgaaaagcaaataacttatatttttatatttcaaattcactagtttttataactaaatttttttaaaaacagaactctgtttttactctatatcaaataaaaccctttatctacacttaaaattgtgtggattaaaaaatcagattgtcctctctgtgtgtagcttataaat

SEQ ID NO: 35188 - DNA, 1031 bp, Homo sapiens
caaggaatatttagagttttctatataaaagagcatgttatctgcaaacagaaacaatttaacttttttcttttccaatttggatgtcttttttttctttctcttgcccagtttctctggctagaacttttaatattatattgaatagaagcagttagggtgaacatccttctcttgcttctaatcttagaagaaaagctttcaactttgcaccactaaagatgatattagctgtgagtttgtaatatatggcactaattgtgttgtgatgaatattttatacctaatttgttgagctttttatcatgaatggatgttgaattttgttacatgctttttctgcttctattgagatgatcatatgatttttgtcatttattcatcttattaatatggtttatcacacttatggatttgcatatgttgaaccatttttacatcctaggaataaatcccacatgattgtggtgtattaatgttttgatttggtattgaatttggcttgttaggatttcattgagaacttttgtctctatgtttgtcagaaatattaccctgtaattttcttttcctatagggcccttaactggctttgatatcagggtaatgctaacctcataaaatgagtttggaagtgtactctcctcttaaattttttgcaagagtttgagaaggatttgatgttaattctctaatttttttttttataaaatacatcagtgacaccattaagtcccgagcttttccttgctaagagacctttaattacaattcattctctttactcgttattggtctgttcagatttcctatttcttcatgactcaatcttggtaaattgtatctttctgggaatttatctgtttcttctaggttaacctgttaggtttatcattgttcatagtagtctgtttttatccctttttgcatttctgtggtattagttgtctatctcctctttctcattttatttgagccttctctccttttcccttagtctagctatatgcatgctaattttatttatcttt

SEQ ID NO: 35189 - DNA, 1047 bp, Homo sapiens
atgaatgaggatttagcttttaccctgaagcttctcaaatgagtctagttacatagagtaacctcttaatataattttatgtaattaagctatcagagaaagtattcaaataaacaaaaatggagattagttcttacataaaaatcatgattccactgaaaaactaaattaaaagagagataataaaagtacaaatgtagtcaatgttattgctgactattaccgtttttcggattgtttcttggggtcattttaatttttatttagagaattagaatttttcctgaagactaggaagcagcttatatagcttcacatcagcaccttgtggttctacagaacatcatgtgtgcttaaatgtgatttgtttctgcaaagtcattaattagttccaaaatcaattttaaagtttccagagaagaagagctcataattttatgatagatagaactctcattttatattgccagttggagggggcggtgggtcttgattctgctttctgtaattaggaaaaaatatgtttctgatgccctggtcttcagtaacctctagccacagtaaacattaagctttattcagaataacaaatataacagaatgttccatgggacttttccttttttgttgaagaccatggcattagatgctgacacatcccaaaaagagtaggtgttggatggcagatagactcttagcccctttcttaattctagtttataaaagggaagaaaaaaatctaaggaagctccagagtaaagattcatttttgcatataattactaggacaacttttcactctcttctgtttggagagaaaggtgatttctactttaagcttgcatactttaaactacatgagggagtttagtgagtcccagagctagcatggaacctgagtgtgggtagagaaagatttcttaggagaacttgaacagagttccctggagttcagagagaagaagactggtggcttactcttacttggaataatcccaggggatgaggttggtcaggcagtactctacaccagagtgaagagagggc

SEQ ID NO: 35190 - DNA, 1044 bp, Homo sapiens
ttttccagtctcaggtgtttttttagagcaatacaagaacaaaataatacaaatgcattctacattcattttttttgaactaaaggaagtgatagagaaatagaacatctgattcttggataaaaattgacaatgagtaagagttttaattcttattacaagagtaggcaaaattaggaaatatgctttgagactaacatgtcattgttcttttcacctaagcgttctgtcctctgtttcattagcgagatctgagaatgcctgttcctgcaagaagaaggagcagtcctatgtatctgggctgtaatgctgaagagggccaagtggctccctgtgagtccagataaaggatatattattcaagagaaaaacttgtaactactctaaacttaagacagatttatttagtcagctgggaattccagagactcaggcagatacctaagagcatgtttaattgctctaagcccctgattcctgatttcctaattttatatgtatataatggttatcagttctgtagaatagttttatggtaactgacatactttgttaaagcttactttcttacttcttttcttttttggtgggattagttagaaaatgatctcaatacatgtttctatatacatatggatgtttaggccaaaataaaattgggttctgtgttctggaggttatcaaaaaatctactatactctaggtagttaagtctagactgtaaacatcaggttgttaatattttagcatattaacactaaaattatcattgctatatatgtttcttgagcatcagcatttatatagaaataaatatttatatttctatttttatcttagttattacatctctcctctctttcagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcat

SEQ ID NO: 35191 - DNA, 1034 bp, Homo sapiens
agtagctgggactacaggcgcctgccaccacgcccagctaattttttgtatttttagtagagatggggtttcaccatgttagccaggatggtctcgatctcctgacctcgtgatccaccctcctaggcctcccagagtgctgggattacaggcgtgagccaccgcgcccagcctagtttgccatctcatatggtcatgaattatggcaccccaaaacatttacaatagtaaaatcaaagatcactgattgcagatcaccataatatatataataaaaataaaaatgtttaaaatattgtgagaattaccaaaatgtgacacagagtcatgaagtaaacacgtgctgttgaaaagcgggccgttgaaaagcatgtgctgacttcagacggtggggccaagatggctgactagaagcagcgcggttgggaggctctcttcagaaaaaaggataataaacgtgtgaatccttcaccagcaaccaaggtatccagattctctcaccaaaactgactagaacgctggcgtgacccatgcagaaaaggaagagcagtgtggtgctgcggcccacttgagaaccacacagggaaggggaaccccatccccccagccaagggaggcagtgactgagcatgctatccagccggggaaactgtgctttttccatgaaactgtgcaacccatggatcagagtatccctcttacgaatccatgcgactggggcttagcgtcccaaccccagaacacacagatttttagagcctctcagctggagtctgcttaagcttactgaactcccacggggaggggcaaccagcacaggctgtggctgcctcctgtctaagccatttgagctccttgggggaggggcagcaaccagcactgagactcacaactgcctaacatgctaatcttcctgggcaggagaagggtggcacccatttccagagctccagtctgtgcttttcccctgctggagccagggaagctgggtggcttggccccaagaattgtccccacagcccaacacactggct

SEQ ID NO: 35192 - DNA, 1034 bp, Homo sapiens
aacaaaatattagcaaatttaattctacaatgtattaaaagagcaatataccaccagtaagtggagtctgttgtaggaatgtaagagtgattcaaactgagacattcaattaatgtaattcagtgtgtcacccataaatatacaataattttaataaatgattaaacaaatatcttaataatgttgaaaagttatatgataaaatcaacattccttcttaggaagctgagaacaaaattaaactgctttaattttatatcacaaataagcatcaaataggaacaaaagagtgcctgccattactgcaatgatagcattgtctggaggttgcactaaagccttaagaattgaggtatcagtattgaaaaggaagggtcagaatatttatatgaataatatgattgttcacctagaaaacccaagagaatcaactggaaagagactagaactagtgtttattaatgtaacaagataaaacataaatacttaaaaggcaatcgtctgcctgtgggataagtagaaaataaaaagaaaaacagatctgtagaagttacaaaaactaacaacaaaacaaaaactaggaatacactttgtaagaattgagacctatgtgaaaaacctaagtctttactaaagctagaagaccttatcaatgaagagatgtaccgcaatcctgaatgtgaagacaaaatagaaataaatttatacattaaatactatgctagtaaaaatctttcatttttcttggtgtgcatatggggtggggagggggatttgacttccaaattcatctgaaatccagtccatgtggtactggcacaggaatagtcaaagaggtcagtgacactgcagcagtggctttcaaccttggttttagattgaaatcattttggaacttgaaaaaacactacccattctactttaattcatgtgagatgaggttcaggttgtgctatactttaagtgttttcaaaggcaattctgatgggtagccaaggttgtgaattactgaactataaagaccaagaaatggc

SEQ ID NO: 35193 - DNA, 1029 bp, Homo sapiens
aagtgcagaaaggttgtggtgtgacttagagagaaaatgcatgcattagataagcttccctcaggcgtgagttacaataagaacatggcactaaatagaatgtgaaaaggacacttgtttacagtgtgagaggagcaaaaaagaaggcagatcatctcctgttggttagacctcagctgggtaatttaaaattttactggctctgcatatgtcatgaatgactgtgaaagcaccctaagtaatgattttgaagtaacaaaaatatggaaaatgttacaattcagagggttataaatttaagataatatgtatataaattgcctagctcagagtagattactaatagtaatttggatttaaaaatatatccttaattatatatctgtgttcattttaaatattgaacacttcatatggttattttctataaagaatacatgtttattttaaaaagcatttctgttttaataaaagttcacatgttgggggtaaacttcaaaatcaaagttgtttctggttactcgatactacttcaatttatggctcagttttggacccagttgcaattccagttgtcctacagccaattaatccttcatttgtgatataaattttcaattttcaaaatatggggcagtaaagtagggagagtctacattagatgtgaaagtgaatttggtcagtggttaattttaaacttcttttgctcactgtgtttctatcactcctttttccatttgaaaaaaaaattattcttgttcttgcattacattcccagtacatttcctcacccaaaatcagccattaaaagatattgctctttgagactggtttcttggccatattttaattttattgtcttggtggaagtgatccaggaaacctagtattacctttggaaatacaaaggggaagattggcaccaaagttgaccttcaaattgtgtgtctcagctaagtttaaggagagaaaaattttctaggcatattcatcaagcatcatcaacacacatgtagtcgtgtgttatta

SEQ ID NO: 35194 - DNA, 1958 bp, Homo sapiens
tggaaaactggtcctctgtctaatttctctataccgttatgtcctgatctgtaaaatggagataatagttgtaaaagataatgcacatcaataccaagcagaatgcttggtacctatttaagtcttaaatattagaagcagatgctagagatgtactgtcatcagatgtctgctcattgactgagtttgagagtgagacactatccgttaggacaagtgtcaggctcctttaagagccatacttaagtggcatttgagatgacaaatgagaggataaaggtgacatcacttttcatcaaatgtttgagccactgtgatatttttattttcttacaggaatttagttgaaaggtctacattttaagtgcaagatctcttactactgagcattttttaagtacacaagtgattcaactaatgggcagatctctcaaggaaattccagatgtctgatatctagagggaatttcagaaagctctctaatcacattcttcttatctaaataaatggaaaacttcatgtagaaagaattgtagtgatgtaacaaccatgtcctctgctgacctttgatgggaaaagatagcaagctcttgcctgagtatcagagtctggctgtttcctcttgaaaaatctcatgttttggagaactgactgggtgacatgtcctttgtcccctgtgctttgtcatgtgattgcaatcctgagcctcacacagacacagaataattatgaaaggggacactgatatgaaaagatgtatagtacagagtcaagccacatagtacgcctctccacagtcagcacaaccaaaagatcagaataagcatgtgctacactgaacataatattattagtatgtgtattattagtgtatggattgctctaagatgctatattgccctgctttagagtgaaaaaaaaaacactcaactattttttcctttgtttatttaaaaataattaccccaaaaacatctggagaaacgtcatcttctccaaaaaaaaaaaagaaagaaaaagaaaaagaaaacatcctgggaaaaagtcattgactgcagaatcttgctttcacacacacaccacaaagcagacttcaactttaaaaaaaaaaaaaaagttaaagcagtttcaaagatttttatttcttcctacatccctgtggtttcagtagaggaaaccaagaattttccagggatttttctttttttttctttccttgttggtaaatgagtgatacttaaagtagaattttcttagccaggagacccaggaaactatgagtaccataaatattcccatgtaaagtactatcttctaaaaaggtatactgtgtccagccctcatcagatattcaaactaatatttagagaaaatcaaaaaataaaacaatgcacagagatgaaagtaatttatcaaaaagagaaaaatggtcatgtggtggcaaaattagaaactgagattttcctcattcattcttgaacatcttttcagaaaattaccctgaaattaccttggaagaagatatttctccaatagaaagttgccccttgagtcatcatttgattatttgatgccttctttgattaggaaactaccctcgtagaggagttctacaggtatgccagtggcatatatgagagaagagttcactgctcatgcttacttctcccacttgggtgaatcaagaagagaatgagggctgggcgcggtggctcacgcctgtaatcccagcactttgggaggccgagacaggtggatcacgaggtcaggagttcgagaccaggctggccaatatggtgaaaccccatctctactaaaaatacaaaaaacattagccgggtgtggtggcgggtgcctgtagtcccagctacttggaaggctgaggcaggagaatcacttgaacccaggaggcagaggttgcagtgagctgtgatctcgccactgatgccagcctggg

SEQ ID NO: 35195 - DNA, 1072 bp, Homo sapiens
tgaaaatttattttaaaaaaagatacttagaacatctccactttaaatagcttactttttcatctccttgttaataaataaaagcataaaaataaaaattacagtgctgtaccacacattgtttgacagagaaatatgagaaagaaatatgtatttgtcaactggttactatcttaatcccttctcatgtacactgtaagaatgttctgttttttacttccacaatgaattttctaagtctcttacactttcaaacttgttctgttagcctgtttgaactggctaaacacctacatcattccaatgctccaaatggcaccttattttagttcctttctatcaataaaatttgggagacctgcatgcctgcagagtttttttgagtaggccttaatgaatttttgaatcattgattgtcactaccacgtcatcttatcttactctgttaatttattttggctttatttaataaattactcgggtggacctttaaataggtgaatacatggagagataagctgctcatctgtgtgttgcagtagaattccaaggcataaataagtattctaatgttatatcgcttaagtttgactactacttcattgtacttttcatattaaattttatcacttggcaatatcactattcatttgtttataattgtacattgtcttccatggtatacattgcttgtattacttaaagtatccaggttttttcccagttagagaattgtaaattatgcttagttataatgagcacaaggaaataagactgtagggtgtaagggcagtaataggtggaagaaaactagaaaaaaatagaattaagatattatagtttagaattatggaagtgaagatctatataataaaaacaatgtaaagattacagatttaataattgactgaagaaagacaaaaataaggaaaactttttagtagcactagaaaacagagaagtagtctttagtggatcagaaacactaaggaattcctggaacctgtgaagtatacgtcatttgtaaagacacattttatacaacatgggcaaaaattgaatagggataaca

SEQ ID NO: 35196 - DNA, 1104 bp, Homo sapiens
tctctcttgaacatacttcaccaaagctttcaccttcttcatgttcccctgtctctctccttctcctttggcctccctattccctgagagacaacagtattataattaagccagttgataaccctatagtgttctctaagtgttcaagtgttcactttaaatcaaaagctagaaatgaataagcttagtgaggaaggcatgttgaaagccaagataggccaaaaactaggattcttgggccagttagccaagttgtggacacaaaggaaaagttattgaaggagactgtaagtgccactccaatgaatacatgagtgctaagaaagtcaaatagccttattgctgatacaaagtttgaatggtctggatagatcaagccagtcacaacattctcttaagccaaagcccaatccagagtgagaccctaacttctttaatactgtgaaggctgagagaggtaaggaagcttcagaagaaaagttagaagctagcagaggttgtctcgtgaggtttacggaaagaagccatctgcataacacaaaagtgcaaggtgaagaagcaagtactgatggagaagctttagcaagttatccagatctagtgaagatcattgatgaaggtggctatgctaaacaacagattgtcaatgtagactaaacagactactattagaagaagatgccatttcagactttcatagccagagaggagaagtcaatgtctggcttcaaagcatcaaaggataggccgactctgatgttatgggctaatgcagctggtgaatttaagcagaagccagtgctcacttaccattctaaaaatcctagggcccttaagaattatgctaattcaactcagcctgtcctctgcaaatggaacaacaaagcctagatgacagcacctttgtttacagcatgatttactgaatattttaagcctactattgagacctagtgctcagggaaaatgatttctttcaaaatattactgctctgtgacagtacacctagtcacccaggagctcagatggagatgcacaaggaaatcaatgtcgttttcatgcctgctgatacaacatccattctgcagcccattggatcaagg

SEQ ID NO: 35197 - DNA, 1027 bp, Homo sapiens
gaaataatgcgtgtttccttatctttttagtggtaattttcagtagtttaccattttaccttgagcatcatcagtgccttaaatgtaatcacaaactttgataggcatttccttatcctggtagatgggaattaagttctgacagcatagtgatttcatagactttaaatgtcattttcattttttagatgaattttattaatggttcgaacagaagtttttgtgggattgtgtaaggtactggaaagggaactggaatgggagcccagacccccagattttgtttccagctttgctattagctaactttgtgactggctcaagttaatgaacctcaaactttaagacgggaggtgaaagagggtgaagactcaaggcggagagattcataagtgagcttaaaaatctctttcagctgtaagagttcttttttctcaccaggagagccgagtatcagtttctcagattgaatagtttcattcttttaagtatttttccaaatttgagtagtggatccaggtcaaattatgcaaacaacgtaactgaaactgtataaaataaggatccaagagcaggaaaagtagccaacataattttttatgtgagttattttgtgttttccctaattttagcagatttccatataagttatcaatcatactttccagtcagaaaatttagtatactctttgcaatgctggtattagtgattaattcacatgactaatgaaaaaggcattgaaaagagaaaagaggatggcattttagtagctgacttataaacacaaaaatacaccctgcaaatctcccccaaaagttactgctcaatggacttgctatatggacatttttgaggtccaaggattggtatcaccctacttttaggatttacccaagtaagtacccatggataagaactaaaacagccaatttaatccataaattacctatagcagagtgttaaagcgttgttttatcagatattaaaactgtgctccagtttagaattatgaagtattgctatggt

SEQ ID NO: 35198 - DNA, 1034 bp, Homo sapiens
tattaccctaggccactgttcagaagagtttttcctaggtcttcttttaggatttttataatttcaggtcttacaattaagtctttaatctatcttgagttaatatttatatatagagtgggacagatgtccagtttcattcttctgcatgtgagtagcgagttttctcagcactattttttgaatagggtgttcttttcacattgtttatttgtgtcaattttgttgaagatcagttggttgtaggtaaatggctttgcttctgggttcctattctgttccagtgatctatgtgtttatttttatatcagtactatgctgttttggttacagtagccttgtagtatagtttgaagtcagataatgtgatgactctagctttgtttgggttattcagggtcttttttggctccacatgaatttttgaattatttattctaattctgtgaaaagtgattttggtaatttgatagaaacagcattcagtctgtagattactatgggcagtgtagtcattttaatgatattgattcttcctatccatgagcatggaatattttttcatttgtttgtgtcatctacaatttatttcatcagtgttttttagtttttcttgtagagatctttcacatccttagttgaatgtatttgtaggtattttatttttgtgtgtggctattgtaaattggattgagcttctgatttggttctcagcttgaatgttggtgtattgaaatgcaactgatttttgagcattaattttgtatcctgaaactttactgaggtcatttatcaggtctaggaatttttttggagaaatctttagagttttctaggtataagatcatgtcatcagtgaacagaggtactttgactacctcttgtccaatttggacacctttccttctttggcctgattgctgtggccaggacttccagtactatgttgaataagagtggtgagagtaaacattctcatcttgttcgagttcttaggggaaaatgctcttaattttccccattaaacatagtgc

SEQ ID NO: 35199 - DNA, 1029 bp, Homo sapiens
tagaatgaaacgaggaatacaaaatatatgttctataagccaaaacaatcctgagaaagaacaaagctggaagcttcacacatcctgatttcaaaacgtattacaaaattactgtcatcaaaacagtatttatgccagtttttactggcataaaaacagatatgtacaggccaatggaacagaatagacagcatagaagtaaaccttcatgtatacagctaaatgatctttaacaagagagctaagactacacagtgggaaaagatagtctcttcaataaatggtattaggaaaactagatatccacatgtaaaaaaagaagttggagccttacaccatatacaaaaattaactcaaaatggattgaagatctaaatgtaaaacccaaaactttaaaactagaaagaaatatgggggaaaatgctttatggcatcatatctggcaatgatttcttggataggacaccaaaagcaaagacaacaaaagcaaaaatagacaaatggaactacatcaaacttaaaaacttctgcacaacaaatgaaataatcagagtgagaagcaacctatgcaatgggagaaaacatttgcaaaccatgtatctgttaacaagttaatatccaaaatatgttaaaaattcctacaactcaacaacaataaaaaacaacccaattgaaaaatggacaaaggacttgagtagacatttatccaaagaagataaatggccaaaaaaaaaagcatacaaaaacatgttcaacattactaatcaccagtgaaatgcaaatcaaaaccactatgaagtgtcacctcacaccaattagaatggccacttcaagaaaaagaaaatataacaaccattgatgaggatgtaaagaaatggaaagcactgtgcactataggtgggaatgtaaaatggtacagccactatgggaaacaatatggacatttctgaaaaaaataaaaagaccgtatgatccagcaaacccacttcttgttactaatctgtattagtccattttgtgctgctatat

SEQ ID NO: 35200 - DNA, 1155 bp, Homo sapiens
ggccaggagttcaaggctgcagtgagctatgactgtgccactgcacttcagcctaaatgacagggtaagaccctgtaagactcagttcaaaacagatactattacacttgggccataacacatttcagtttcaaatttgcatttaaaaataaataaatagatagataagaaaataaatagtttctgtatttctgttgaaattgcccattttttcatctgtgtggcccacctttttcactagattctttgacatattaattgtaattattttaaattctttctttggtatttccaccatcagggccatctgtgaatctcattgttttgactattctatctcttgataatgagtgggaaggttgcaggagtttgcttttcaagtgtaacataatttttgattgaatgtctgttttgtgtgcgcgtgtgtgtgtgtgtgtgtgtgtgtgtgtgtgtaaaagaaactaagtctctaagtctaggagactaaagtaaatactgcttatgcctggaaataggtatacttcttctgctaggccgttaatgtgattgagggcttgagtcagtttggtcaatggctaagctaggtttggggtttgttgttgctgtaagcttctccagggggtgggctgctgctgctgtgttcttcatgcgaggcctggacgctcagcaggcttttcttaaggatccttcctcaccatcaggttttggcagatcctgtgtacctttgccacagaacatgtttctctctctctgcctttgtcccgccactggcagtagcccgctggtgcttgttactaggcacaagacttaagtaggccagagggctttcctggggcccctgctctagcattagttgggcaggtgctctgcacttgagtctcagggttgtgggtttatcagcatttctgcctctaccctagtgttaggtggcccctgcttctgacaccactcagggtcagcggcagtgtcctaaccactagctacatgtggctatcaaaatttaaattttaattaaatccaattaaatgcaattaaaaatttactttttcagtcatattagccactttcaggtgctctataggcacatgtgtctggtgactactgtattctgtagcacagatacaggacattatggtcaccacagaaagctctgtt

SEQ ID NO: 35201 - DNA, 1042 bp, Homo sapiens
ggctgtaaatacagatgaagcttcactcacttgcccgccactcacctcctgctgtgtggcctggtttctaacaggctacgggctgatattgtggggttggataatcctgctgtagcagggttggggaccccctgctgtagtatacatctctagaacttacttatcctgtgtaactgaaactttgtatcccttgaccaacatcttcccattcctcccttcccctgcccctttacctctacccctagttcctggcaaccaccgttctaccctctgcttctgtgtgttcagcctttttagattccacatgtaagtgagatcatgcagtatttgtctttctgtgcctggtttatttcacttatcataatgtcctccatgttcattaatgttgccaaaaatgacaggatttctttcttttttaaggctgaatagtattacattgtgtctatataccacattttctttatccattcatctgtcaatggcttcttaggttgtttttatatcctggcttttacgcaatgaacctgagagtgtaggtgtctctttgacaaactgatttcactttctttgaagatgtacccggaagtgggactgctggatcatatggtagtcctatttttaactttttcagaaacttccatactgttttctacaatggatatgctaatttacatttcaaccaacagtatacaggggttccaatagttcttgctgttttagtagatatcttatgaaaataactttaaaatcgtacatgcatgtctggtagtcagttttggagctcgagttgtgaaccttcccaacagctaccttctcctgcctgtcatggtttcagtctccgcaccagtggagtgactttcttcaatatagtaaaaactgtactcattatttgtacaaattatttgttaattattaccacatgtgccaatatatatgaaggccaatgatcctaactggaggatattttgtagactgaggaaaacacaatttttatctttattataatgcctttgacatactttcggtcacagtttgtaatggg

SEQ ID NO: 35202 - DNA, 1054 bp, Homo sapiens
tttgattgcactgtgatctgatagatagtttgttataatttctgttcttttacatttgctgaggagtgctttacttccaactatgtggtcaattttggaataagtgcaatgtggtgctgagaagaatgtatgttctgttgatttggggtggagagttctgtagatgtctattaggtctgcttggtgcagagctgagttcaattcctggatatcctttttaacttctgtctcattgatctgtctaatgttgtcagttgggtgttaaagtctccaattattattgtgtgggagtctaaatctctttgtaggtctctaagaacttgctttatgaaactgggtgctcctgtattgggtgcatatatatttaggatagttagctcttcttgttgaattgatccctttatcgttatgtaatggctttctttttctcttttgatctttgttggtttaaagtctgttttatcagagactaggattgcaaccctgcctttttgttttccatttgcttggtagatcttcctccatccctttattttgagcctatttgtgactctgcacgtgagatgggtctcctgaatactgcacactgatgggtgttgactctctatccaatttgccagtctgtgtcttttaattggagcatttagcccatttacatttaaggttaatattgttatgtgtgaatttgatcctatcattatgatgttagcttgctattttgctcgttagttgatgcagtttcttcctagcatcgatggtctttacaatttggcatgtttttgcagtggctggtactggttgttcctttccatgttcagtgcttccttcaggagctcttgtagggcaggcctggtggtgacaaaatctcagcattttcttgtctgtaaagtattttatttctccttcacctatgaagcttagtttggctggatatgaaatgctgggttgaaaattcttttctttaaaatgttggatattggccctcactctcttctggcttgtggagtttctgccaagagatccactgttagtctgatgggctttcctttctggg

SEQ ID NO: 35203 - DNA, 1050 bp, Homo sapiens
agcaggtagcagccgcaccctcccagatgcggcttcagctacccaagttggcgctgtggacccaggcctccctgtgctgcttgcaggctctgaaatgcctgctcccgctccctggcttctcccagctgtcagcgcctactctgatctcagagcaatgtggggctgagcccggttgctgtcacagcctggctgggggtgcatacacctggggcagtgctgacacaccagctgcctgctgcctcagctccccgctgcctcagctcccccgctgcagacttgggcaccaatgagtgtgggggggttggaaaccgatgcagagctgagggcagctcagtgtggcctgcaggtgccccttggcacaagcacctgggctccatggagggtggcaggaggcagataggctcctgggcaaaagggggcaggtacccggtgaggccccaccttcaggctagggattgcctgaaggctgggggccaggctgacagtccggtcgaccagaatgggaacttgtggtgccttttctgggcctgcccatgactgcctgtgaaccaaagaatgcacacttcctcccctccgaggcctgtaaaagcctcaggctcagccagagcagagcagatgatggaatgaccagctgcagagaggagctaccctctctgctgagaactgaatgcttattgtgatgacttgcctagagagaggagttaccttctctgctagcagcctgaatgctcattggtataccctgcctgtggaaagaaaacctgcaggtttcctctgagctgttctgttgctcaatgaagttcctcttcatcttgcttaccttctacttgtttgtatacctcatttttcctggtcacaggacaagaatttgggacccgccgaatggcgaggctaaaagagctgtaacacagacaagactgagacctgctccttgcttgccacattgcgagtgaagagaaggagagaagagctgcagcctttcagggatcccagacctgggagctccccaagccagggctgtgactccttctttggggtgctgcagttcct

SEQ ID NO: 35204 - DNA, 1028 bp, Homo sapiens
ttgcaagtaggttttttattttttggctttaggtgagtcatattacatgagacaccacccagttaatactttccatacagttattttcaaaggttttcaagatgtacaaagaaatgtcaattcatggcctaaataaatgaacttgtggtgtagagttttaaaaaattctttatatggttagttttctcatagagaatggtgctctggctatggtaagtcaaaaaatccagacacaaaatttttaaagtgtgagactaatgtttcccatactggttaattctacttcatgacacataatgaaaatatttgcatttagttttttgaagtagactctgtgaaaaatgtcatggatttaattgttaaattcattcgtttatttgccagcgattttacttattgccaatttgtggaactattaaaaggaatagaagacaaggaatttaatggatttgtgccgtttgccaatactctatgattgagttgcagaagagttttacaaggatttatcatactgctgactctgaagattttcttgagaaataaatacttgacaaataatcaaagacaaaaaaatctttgtgtgatttgtgttttctcaccaatatcacattgcacataaatgagctaaattgaagctccagggaagggaaaaacattttataacctagctggttgttgaaactttcaatacaaatcaataattatgtttttacacataaaaaaaattcagttgattttaattatagtacagtgttatgtaaacttgatgtgaaaaaccaggagaacaatttgatgaatgctatgttgataatggtaagcttagtgttgtttttcaatttatacaatatttcgttgaacttaatttcattaatacttcattgacacccagagttgataaatttacttatcttggattgatgcaattttgaaattgatgagcgttttcatcaaagtcaaatcaattctaaaaaaagacgaaccagctttgtcaatgtagatgtaaatgtattaaaggacaatgatttttt

SEQ ID NO: 35205 - DNA, 1058 bp, Homo sapiens
agcaaaaactgagactttatcactagctgacttgcgccagaagaaatattaaagtaaagggagctcttcatggagaaggaaaaggaatcctgatggaaacatggaaatgcagaaaggagtgaagagcagtgaagggtaaccatattggtgaataacatattgttggtgttggacaataataatgttggtttaaaaatatatgcaatttatataataagaacaatttgaatggctggagggaagtaactgtaattaaagcattgcgggtttctagtaagtaaatttattaagtaaatttaactagattatctaactaaaatgatactaaaatatggttttaactaaaaagttaatacaagggaaaaataggatgataaaatcattttattaatccaaaaagaaggcaaggaatgaggagaaagacaactgtgtcatatagaaaatagtaacatggtaagtataaacccaattagatcaatcattgtgctaaatttaaatggactaagtatttcaatttaaagacttatactattaatgaattggaccaaagaacaaagcaaagctgatgcctctttagagacaattttaaaacttaaagactcagaaagcctgaaaataaaagaatgaaacaaatatattatgcaaagacaaatgaaattaggtttaaccttattaatatttgataaaatgcactttaaggaagaaacattactagaaataaagagggtcaatacattcgaaaatagatatgttccgaatgtgaatgcgaaaactaaaataattagcagtagaaataggcgaatgaataatcctaatggtagacttaagcacaactttctcaattgctgatagaataaacaggaacaaataacctggaaaggacatatagataattcaatcaatacaattaatacaaaagacctaattgacagatacagaatactgtgtccagtgacagttggtcaagtaacgcacatggaacacttaccaaattaactatatgctgagtcatagagtgcaagtcaactgcatcaaaagatgcagtcttgggggatggg

SEQ ID NO: 35206 - DNA, 1058 bp, Homo sapiens
gagagatggccttagaggtaccagggaagccaccctgctcccagggcctctcagggtaccaaaacactacctgaaaaaatatgcttttttttaacttttaaattaattttatttttaacttttacattaattaatttatatttaacttttaaattaattttatttttcagtgtcctctataaatatgaaaatatctctgcaatgggaaatgggtaaactgataccagctaacattttacaaagatattttaataactagataaagccagatcacttaagacaacattttagaaggggttattttatacatatatatgtataaaacatatgtaaaatatatgtgtgtgtgtgtgtgtgtgtgtatttcattctttacacataaaagtgaatataaatagatcttttggtatttccttcttacaccataatgggcaatttgtgccccacaatgaagcaaagaggacacccccttttagagacctctgctttacaaggttgacactatcagaagctgtccaggaattagaaaaggacatttgaaattatctttgcaaggttagacccagtgaatatttgcatttaaaagcttgtcttttaattacagtaaagtggaggatacaagatactcttttaaacaatcgaaggttgcccattgcctctaaaatcgtactgaacagatattcagcttctgttagtgtcaaccttgtaaagcagaggtctttaaaagggggtgccctccttgcctcattgtggggcaaagattgcctcattatggtgtaagaaggaaataccagaagatctatttatagtcacttttatctgtaaagaatgaaatcaagttttgtgaatattacttaatactatatcaattaacgaaagcactcttactcaggatatcagatggtcatggaacaacaaagaacggcagaggtgacagcatgtatgaagcaaaattaatgcaagataaaaataatgacattctgctaggtgcagtggcacagttataatcccagctgctaaggaggctgaggctggaggaccacttgagcccaagagtt

SEQ ID NO: 35207 - DNA, 1039 bp, Homo sapiens
attaactgtcgtcaccatgcagtgcaatagatcataaaaacttattccttttgtgtaactgagattttctatcctttgattaacattttcctttccgcatcattctccctcttcaccagcctttggtaaccccctttcgctctctgtttctatgacatcaactttttagattccacatataagtaaaatcatgcagtattaatctttctgtgcctggcttatttcactcagcataatgttctccagtcccatctctgttgttgtgaaggacaaattgtcctttttaagggttgtatagtattccattgcacatatacacaccatttttattttatccatttctctgttgatagacacttaggttgcttccatatcttgactattgtgaatataatgctgaaatgaatttggaagtgcagatgtctcatccacatactggacatattccattcccagtagtgagattgctggattatatggtagttcttttaattttcttaggaacctccatactattttccaaaatggctgtactaatttacattcccaccaacagtgtacaagggttcccttttctccacatcctcaccaatgcttttgtcttttgataatagccattctgacattctcactgtagttttcatttgcatttccctgatgattaaagatgttgagaatttttaaatatatctgctgaccatttgtatcctatcttttgaaaaatgtctgttcagattctttgaccatttttaatccagttatttgttttcttactattgagttttatccaatatatatttgtttctagcctcttatcaaatgtatggtttataaatgtattctcccaatctgtgggttgtctcttcactgttaattgtttcctttactctgcagaagcttcttagcttgatgcagtcccatttgtccatatttgcttttgctgcctgtgcttttagagtcctatccaaggaatcattgcctcttcagcagagctaagcccaggaaaaaaaaagaaaaaaagaaaaaagaaatattgccc

SEQ ID NO: 35208 - DNA, 1387 bp, Homo sapiens
agcaggtaaggttgtaatcaaagcaactctgtcatttgaaccatatgaattagagattcaataattcaggttgtagtaggagaaaagtctgttacttggatcatatgatccataaaattccatagtactaaggcatcgatattagataaagatgcaatgtggagcctctgacaggtactagtcaagaagttatagtgcttatcgctgtatttctgaagcaagcccatgctatttgcagcaaataatttatcatcaaaaggtagtgcctgaaatgctactggcccctaaagagaccaagtgagctactatgaagtgactatgtagccaaaacttcttatcgtgtgttgggtactgtcttattgtcttacccaacaagtgttaagcatgggcagtctcagaaataattaattcataatgaaatggaaatggtacatccagaatcccacagatcaggagggcacagatgaactgcacagacaggtagcacatagctccacatcactcctgcacctgtggtcccatgattgcctagattgtcagttactgagagaggtgtgttagagtcttccactatgccttatattggcttatttctccttttaaagataccagcttttgctagtgtgttaaggctatgttatcaggtacatgtacacataggattctcagatcttcctttatgattggccattttatcattatgaattgttctttcttatcttttagcaatggggaagttttcaaagagtgcattatcaaaagtcctctaaatgtattgaataaattgttgaaaactatgtgttctgttgttcataatagaaacaataattcaacaataggaaaaaattctgagtgcctgccagtagaggagtaaccaaataaatgatattacattctcatatgatctatattttcaaagaatgtttatcgccacgtgtggcaggtgaagtcatgctaataaaatgtgaaaactacacattcagaaagttacccctaatgcttaacctggcctactccatatagtctgcaaaaataaaattcctttatttatcactccataaagagttatttttacattctcagcttgccgaagtaggcttatgatgattttctgctttactgccctgaagtttaacctgaagccgtttaattcaattatctgtaagactagcatgctctttaaatacaatatttaaaaagttattgctattagtagagtaaaaaaagcagttcacctacttttcaaatgccatatttgtaggttttatggagagtacaggagtccttcacatgttaaaaaacaaacaccatacccatccattaagaagtgtaaactgacagtatgttgttctcattgacttattcaacagatattttttggagctcc

SEQ ID NO: 35209 - DNA, 1032 bp, Homo sapiens
aactaaaataacaatggttttgataaatattctcgtttttattcctattacccaaaaaagtgacttctgaatatgctttaaatatttagtttgttcttgaactagcccttaaagcactctctattatttattattgttgttaataatacttttgagcttataagatgagtctaccagaaatagtacgaataaaccagcaggtacaatctgaatatttgtatattggcaatagtttgaatcccaatttctcattcatctcaggataaaagctgccagttgcctctttaatatctttctaagcaatctgatcattgcaatatatgaagtagcagtaacaaaacgcagctttcagtacttttcaattgaaagatgtctcatgccttgtcaaaaatctgtctcaacaattgaagaagcaaaataatttaatattagactacctagcatgtattgcaaaatatttttcagtatatactttggcaaatatagtgctctttcagtcgattgaaaacttgtgactagtggaaatagaagttgagaaagacaataaatgaaagtaaacaggctatggacctgaattccatttagaatagaaaagctggtataaaactcttaagaacttaagcagtgaagtggaaaaactatgcttcacaacaaaagaacaattaaaaatgtatctcatttgaaatacgtgctggggacaaatttgaaagaacttaaaaaatgttgtgttgcaataatacttggctgatttctgttttttgatgctgactactggttcttttaatgaattattcttattatgaagatcaaatatgacttcctatatgaaaaggaacacatctgctgcttagaagagtggaccagccctgtgcaccagaagatctacaccaccttcatccttgtcatcctcttcctcctgcctcttatggtgatgcttattctgtacagtaaaattggttatgaactttggataaagaaaagagttggggatggttcagtgcttcgaactattcatggaaaagaaatgtccaa

SEQ ID NO: 35210 - DNA, 1050 bp, Homo sapiens
cacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaatgttctctctttttaagctaataattgacagtggtgttagttgagaactgaatttacagttggtcttttgggcagtaagaaatgcaaaccatagactgaatttccttcatagtacatgatttttcctaaatataggaaagatcgaaggggtctctggtttatttgcaccatgtttatttaggcatctattaaagcaatgcttgtggtgctacttgcttagtagaaaagctaattataaaacttaatgcaaaaattcagagtactacctttctctttcctctttcctattgtgaacttgcctcccatttactgtctgtcactttctttgagataaataaaaaagacaataa

SEQ ID NO: 35211 - DNA, 1049 bp, Homo sapiens
tccatggttgatttggcaggacctgagatctttctggtttttctttttgctccattatccctagtgttttggttttctttcttcattatcataagatgtctgctctagctccaaacttaaccatttcacagcaggaaggaaagaaaagggtaaactagtcctatctgtgtatcactttttgtaagtgaggagatttctcagcatcccctccagtagatttacctttaggtctcattggctataactcgtaagggggctggcaatcagtgaacaaagtatatttacaatccattgcttagggcttggcacattgaggctttgagcacaaggttctgtcagcaaggaagaaggggagatttgtgttcagtaagacactacctaatcaaagtaaataccatctttctggaaagagtgatccctacatgattagggaatcatttttattttttctagtgtttgacaagtacatgactatatcaggatttcaaattgaggaaaccattgaccgcgagacttctggcaatttagagcaactactccttgctgttggtaggtgatttacaatgtattgatatttttggtggtaagagctaaagcattttattcaattgaggctgcatctgaaaataaccacctaggtgtgaaggaagagcttgatatgatatttaggggaagcaaactcccaaatttccaattcagaaatttattttgatgttggaaatacaggattgtctggttagttcatctaaatcctatggaaatactaagataattgtttaaaaatcattttgaagctgcattaaaaatattatttattgataaacctgaaatgtcgtggacattatctcagaggcttgtaaacattatttctgatacctgtggaattttagaatttttttgaatactgttctctcagctttgaggcagactaagaaattgtcatctggtttagaaaagaagaatatctttgatgtaatagaagatgtgatgatggttgttttcaaattaaataatttagttttattttaattaaatattcagaataatct

SEQ ID NO: 35212 - DNA, 1048 bp, Homo sapiens
tcagcaaattgcattcatcttgctttaatatgtagacttagtttgaaatgaataaaaggatagtacagtcattgtaaaggttgattctttgggttttaataaattattctcacgtcaataagtggattcagagttaacgttgatgtttgtatataagcttatttttttaggcagctatacgtgcacaagaaagcatattttttccccatgtcaaaaaggaagtatgggcactcaaactattcaaccactacttattgagtgcttctatatgccaggcactgtgctatacccacaatcttttaaaaatttattgtgatctttggaaatatgaaaacattttatagctagccttggttaaatctcagttgtaaagagaaaatatgaagtgtacttttactcatgtgctattgaacagctatagaacaagcaaaacagaaaaggcagacaacttagcttccagttaaatcctttcccagtctatacatggatgtatcaacagtgaggtagtcataactttctcctgacccatactgttgcttctgaaagattggaggttatggcagacattttgggaacatgtaaccttgcaccattgccgtgctttgttgcttggacccatgaatcttctgtggcacagttcagtggcaagctccaaaggtgctccaaactcagtgagctgagtttcagagtaggacacattagaaatgaaaactattaatacaagatgatgaatcaagtgagttaaaattcagggagtaaaaaacaagtgtgtttaagaacctggaaatgagatggaggaacaatttattaattgagtttgaaatttttgcaggctttatttcaggctggagaacttaaatgggggacagatgaagaaaagtttatcaccatctttggaacacgaagtgtgtctcatttgagaaagggtgagtgaaaaaaatctgtatggggcagatacattggtaaatttggaaagtgcatgagccagtgtgacagaatacctgctacatagcagggacttagagaatgaatcagtttttgtatttct

SEQ ID NO: 35213 - DNA, 1032 bp, Homo sapiens
aagggatagaacttttcaagtgttattcatggaatgcccaatggaacaatttggtaaaagagcatactctcctctgaccttcaatgtgaactcatgggaggccaatgccacctgctcactttaactcactcaagacatcactggagttattcttgggcaacttgagcacacaatttaactttccattttattggtgtttgtcaagggaagtcattcttacactggtaaagagacacaacattaaacacagagcattaaagaaatacacaacaaaaatttaaatcattttacaaatcttcactttgttatcaaaaccttcttttctaccacgatgcaaacaacttagtctgttctccagtgatgttttttttcccttgcatttgattttaagaaacaggtcaaaggtggtaggatggatagacaaatggaaagaagcaaaaacaagtaagatggagcatgaaaaggaaaggaaattacacaaaagtaagcaataggccagttcgagtttaacgctttgaactatatcattcactttttctgagttgggattagagcaagggttaggattgggggttgagagcatgtctctgacctctgatgtgtttgtactcctcagtcttcttggaggtcctaattttttccctgataattattttgctttacagctcaaagcataatcaggtcacactgacatttccctcttttatgcccttcttatttttttcttagtacagtgataaataatttattttctcattagcgggaaccattattgcaggaaatattaacgggcctctaatacgtacataaggtagggccctagtgtatgtacatggagtggggaggcaattgtcttcccagcttactgttttttggagtggctccaaggtctttggaaacctgcctcagaagaaccacccttaaaaatcactgcatagcggcttagcagttgctcagcttgtggtttgcttcatgatttccagctcctagttaatattacgtggaatgctggaggtggggggagggtgcggt

SEQ ID NO: 35214 - DNA, 1029 bp, Homo sapiens
tgtttccatagcattttttcttacttgtctgtgatatttattgttatctgcttaaagtatataataattttttattttttattttattctttttttgagacagagtcttgctttgttgccattctggagtgcagtggcacgatcttggctcactgcaaccgccacctcctgggttcaagtgattctcctgcctcaacctcccgagtagttgggactacaggcatgtgccaccacgcccagctaatttttgtatttttagtagagactagtttcaccgtgttggccaggatggtcttgatctcttgacctcgtgatctgcctgcctcagcctcccaaagtactggtattacaggcatgagccaccaagcccggcctctaataatttttatacaaacttatttctctaagttaaactttattttcatggacagtctaattttaaatatctttgtatgtagcctgcaaggacctaaaacatagttttgcacataataggtactcaacagatgtttttcggatgcctgaataaaatatatgtgtatggaggtagtgtagaagtatgtgctttggaggcagatgtactaatgtttcaatcctggctctgtgacttaccagctgtgtgaccctagctggttgcttaactctctgaacttcagttttcttttctgaggaatgaaaataatagcacttactttattgaattgttatgatgattaaaagaagataaccatttgagtcattctatagtacctggcactatgtgtttactaaatatcatctgttaagattaaagactaatagaaatgtcatgatttctaaaacataattgagatcaaagtagtaagggtgtattatttatctttctagaaaaaaaaattatctttttttttatttgttttgagacagggtctcactcatcagcccaggctggagtgcagtgtctcaatctcagctcactgcaacctcctcctcccaggcccaagtgattctaatgccttagcctcctgagtagctggaattttaggagtg

SEQ ID NO: 35215 - DNA, 1021 bp, Homo sapiens
tgacatctttgtttcttatcaaaggattccagttccactttctatataaaatatattgtgatatatctacatatgccttattacataattgtgctgaatgctggtaatatccgcaatgcctcttgactttaatgggaaaaggcatgcagaccagtaagttccccagtcacttcagagactataaaacactcaaagcattttttaaccagctaggtttaaatctctcatagagttatgtttaacatcctgagtctgcagtcagttgctgtcaagtcgtataggaatacgaattgtgatcatagatcaaagattttcagaggtccttaaaaccaactaaatacatgctactttaaaatcattgctatcatgcagaaaagctctttagacatgaagacagaaataagtgttaaatggaactacataaagctctttaaagattatttcttaatttctactttttgggagttaaattaagaaaggaactttataaatgttttgctaccattgtagaacacttcattaacttttgtgccatgctaagagtattcgtcttaaacatttttcaaactttatgtactttatgttgtgtctcagaactgaataaaatattgaatttttccattgttatatgttaccatatgttaagatagtaaagatacaaagtttctataatagatgtttctgatagttttatagtatggtccaggattccaagtgtgaaaagtttttgcttatagctatggaactgaatattttgtaattttcttctttgcggttggaaaaaatgttgaatgaaaaagtggcagattcagctggggacattcagcctaagattcttggaatctgaagatcagagaagtatgaagataagcctcatggtatccacaccatgtggataaaaagctgacttttttttttttttttttttgtccatgcccctcacaactgtagagctcttaacaggcattttttctttatttactatgtacaaactggtatagttttaatatttcatcttttt

SEQ ID NO: 35216 - DNA, 1023 bp, Homo sapiens
actataaaaattttttaccaaagtctaggatgtagagctaaacacaggcccagagttggaaagaaatcaaccagggagaaataagttgccctaaaaatggaaactgtaccttccaacaccaatgagatgccactaaatctatctacactgataaaagaggaaaggactaaacttaataaaattgttcataggctttgaagccattacttgattaatacaaggaatgcattttaaatgtaaatcaatccaatagtgtatgtatgtagaagagaaacctgtgaatttataatcgataactagcaaaaatctaatcatggtgacctaatcaatctgtctcaggagaaaggattggaatgaggttgtagtttagaaagcagaagtctgatgagttgtaccgtaatctccatggggggtggagagggaggaacaaagtgggaagaactgtatggctaaaacggcataaaaaacaagaagcatttcccaagcccttgcacaaaaggggaaaatcaatgagaatttggagttttgaacaaagttcttactaagaaaatgtgtcatataatctcctcatttaattaatgaggaaactaaaatctgaagagtttgagtaacttgtgtttcctgaattggcagattaaatatttaatacaacacataggttgtagtctccccatgagtcggggacaaggaagaaaggatagtagaaggtgaagtagggcagggggtctcctgcggtactgaatggtgtgagaatccactccttccactgaagtctgcctcatgatttcaaataagatcagtttattccttttatattgccatatgccaaaggaagcacttttttttttttttgccacaaaagggctcctcaaatgttttgtgtgtattcctgagttagaattcttttcaaataaaaatgctctgacttttatataatagaagaatattgaaattatactttaaagcatattaaagataccaggaaatatcatcaaaggtgtgttttaaatgccattttattat

SEQ ID NO: 35217 - DNA, 1033 bp, Homo sapiens
tttaggtcaacagaactgggaaacctacaagagaagatattttaaagtcaatcaataggtttgcaggtccctcttcaaaaaaaacaaaaaacaaaaaaatgcagaaaaaagtaacaggtaaaagtcaatcaagtagaataaaaaacaaatttattctctgttaccccaaagaacagaatttggaccgatagttattttggcttcaaaacaaaggagttgttttctaacagctatagttgtccaaaaatagattaaaccagctgtctggaaaaatagcaggccctcaatcacagaagtttatacagaagctgtgtaatggtaatctttcacaaagtttcgtgagtggtataaaaacatgaaaaacaatgattcccaaggtccttttcctttctaaaattttactctgtacttctgagttttttttctatttgtctacatcagtcttattacccttcattcacactttttagattgttaaaattcatagtacaaaatctactaataagagtcaaatttggcttctctgtagaattaagtgagagaatgaatgtaaaagtacctgatagagtgcttaacaattattagttgaatttgaatcagtaaaaataccaagtgagaagaaaaactttcactcctttcaggaaggaagatatctaaccaccccgcagctacccaaccacccacatcttatttcttctcccagtcttaacggagggttgaaaaatgaacttgggtttgtttgcaggaaggactgtttgaagtaagtaccgcctggaatctttacctggttaccactcaatttcagttttggaacctctctctaggatttccataccctggacagagaaaatcaatagtctttatagagttagaatgtcttccttaaagagtgactcacaggcttgtaccaagaaagctatataatttctggaggtttgtggaatgtggaagttaatctatagacttcttttgtgttagttagttagcaatttgagcaagagggaaaaaagatgaatctgttattggtcagttt

SEQ ID NO: 35218 - DNA, 1020 bp, Homo sapiens
acatttggggacatatggtaaacacagaaatgccgaaaagcaattcatctgagaatcatttttccccttgcccttgaaatataatatgctgtgtctacagcctggcttggataggtataggtgaggaaggaggatgggaaataggcaactattgtcaaacatgcagaattgactgggtgggggacagagggaggaattaatcattttatccttccttggcactctatttttcttgtcttttttgccttgtttttggatgttagacaggaagttctggttaaatttcagtgggtacaggtagaggcatatgaaaaagaatgagtatcttatatttgaaaaatgagaatattgtgtaggtctatagaatatatgtagataaatgtgtataagttacctatttcaaaaacgtaacttagattcattgtaaaaaacctattagcaacagtcactagaatatttagcatttaaaattagtttttttttctatttttgtgacacaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccagggtaggtatcgaaaacttaccaagaccttaaaataaatgttctgtcttttttttcttgtcttctgatgtttgttcaataatttttatgtgtgaacttagaagatgttaaaagtaactgtctagtccacagtctttcacagactaatactaaatattttcatgatgtttcaagaagtcactgagtcgaggccctgcttttgatcagaacatcatataaactgccagattaaaaacaaacaaaaaagcctttaacttgttaaaagtaaccagaaaagtcactgttagaaaacactttgtttttgtatgttcca

SEQ ID NO: 35219 - DNA, 1030 bp, Homo sapiens
catacaaaatcaaacagcaaattcccatttttgtaggagaaaggaatggttattgtgacttgacttcagctttctcctgtggagttcagagaattttcacttgatgataacttcagaaaagctaggcattggcaccatttaatcatcagttcctgaaaacctgaaagaataatttttctatgaaatgtcataacaaagtaatcctgctcttggagtatattatggtggcattttacatctgtacagtagttaaaccctaacttgttttttacttttcactcttagatattgaaaactgttaacttacttactttgtatcttattttttcaacagtgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggtaaatcggttttctatccatagtatctatccttgtcatcctattctgatagtacacatctgcttctgtaccctgtggctgagctccagctcatgtaacaaagaggcttatatccacacagagcctgagcctttccctgtgttttctacctggatagatagctctacacattctgctgtcttctaggtgcacagcaggggtccccatgaatttactgctgctccgccttctctcagggtatatttcagaagttttgaaattagtggctagaagaagtattggccctaaggaaattactctctcttcaattagccagcccacaattctacctggtagaatgaccagatgtttggcaaacactaatggtattctttatccagtcaaaattttgagtattctagaaatcacttgattcttggttttggattgggctgggtttggtacctctcttcactgttgtatatatgttttcttatgtccttcagttcagttttcagtat

SEQ ID NO: 35220 - DNA, 1033 bp, Homo sapiens
attttcagaaatatctcggatggttgggctggttgcagcagaaggaaacctggctaaagggttgggtgggtgcaaatccagcctgtattcagctcaacaagccttgcatccaggtgggctgcagctttctacccccaaaagaagggatacctttttctaattcacccaaatactttccactgaataaaagcaaattatttgtgttaaaacactaaacctcttgttcttagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaaggtgagtgggcctactttcatctagtgccatattagaataaacatgtgatacaaactatgccataatcctaggaaaattattaaaataataagactagacgctagtaggctgggcaacataatgagactgtgtctgtacaaaaaagaaacaaaattagctgggcatgatggcatgtgcctgtaatcccagcactttggggcctgtaatcccagcgctttgggaggctgaagcaggaggatcacttgaggccaggcgttcaagaccagctgggcaacatagcgagaccctgtctctactaaaaatttaaaaattagccaggcatggtggcacgtgcctgtagttccagctactcaggaggctgaggcaggaagatcacttgagcccaggagatttgaagctgcagtgagcaatgatagcaccactgcattccagcctgggcaacagagcaagcaagaccttgtctcaaaaaataaaataaaaaaatagatgctattgataaaagagttttttgtggggggtaaagttgcaagttaaatgtgtagcttctgatcctttctactttttacccatggtgggaccttgaataagtcataaatttttaaatttcagttccc

SEQ ID NO: 35221 - DNA, 1057 bp, Homo sapiens
tgtcctctctagttaattttcaactcctgactccacgaatacagttttttcaatggtaggaggtatttctggaatatatattctagaaataaagcattttcttttctagccgttcacttttaactttgacttatttgcttcaaaagtcagtaatgtggaagctttatctggtactttttggtacaattcatcccaccaaaaatcacagatttttaaaaggaagttatcttgaacattggaagtgggtaaggtaagatacagatttatacaatatttgtgcaacattttaatagccaccaaaatattgtacagattattgaaagattatagatagtcacgatgttaaaagtgtttatttagcattgtttttcagagactctgaatttccgaaaaagctttttattcatgaggaaaatctgagaacttcataaaattcgattttctacctggcgtaaggatgcacaaggaaatgaaattatttacctaacatcacagaaattaagatgtgaactcaaatcactgtacacatcaattgacataactttgataatgcagctaaataaatctcaactaatgtggttgtgttaggatttcagtgcgcattgatctggatgtacaattagtgcccagttgctttactcacaaagtaattctagtgatttttaaaccataatcaaaccttgtcgtttcagttccaagaggcaaatatataatactagtaattaaataattcttattacaaaggcacggttgttttcaataaaatcaatctaggttgatgctcaaattttataattgctaaatcttgtctgcatctttgaaaagataaatcctataacttggggatgggtgaatccccttaagagaaacgcataaggtggagggtgtgggggcaagtggcatgtgcctgtagtcctagctacttgggaggctgaggtggaggattgcttgagcctaagggttcagggctgcacctgtgatcttgccactgcactctagcttgggccacagagaccctgtctctaaaaaagtatttaaataaacaaaaattttaaaa

SEQ ID NO: 35222 - DNA, 1078 bp, Homo sapiens
atctgagggtaggaaattcctggcaaaataattttagtgttaacattactagagctaaacattctcccccattcacccacattccttccttatttttcatgctagaagagatacattgtcaaggccagctgagattatgtttatgcattgtggatgatgtgaatattgactcgttccatcagttcagattaatgaaatttatcttagtactataaggaaagttaacaaaaagacacttccatttgtgaatttatcataagatgagtgatattaagtcagctcttttattttgaaacaacagtataatttgttctaattgagatatctcacttctcagtgtcagaagtttttaaagacaaaataaaaatgacatgtgacttgttctaaaatcagacatttcagttcaaatatatagtatggaggtatagcttttgaaggaataagaagtattaaggaaaaccgtaaaatactaagaaatacaaaggaaatattgatgaaagaatgatgtcctaatgttctcaacctggtgtcttttgggagaaatagtaagatttttataagtgatttttccctgtagatagcaatcattaaattaaaagcctttccaccaagatgtgacactttaataagagtttattttcccaaaggtaacccctctgagtattgaaattctgacatatatactccacatatatttcctctcatcaatatataatattttatacaacatggaatttctagccatttgaagaatatcagttcatagattaataataaaaatattaacccaatgaagtcagtaccactaatagtcataaaacatacttattactataatatttacaagatttgtttaaaatccttgtcatagagtttggtcttgaaacaaagttctcttctatgcagttcttgtccacctaaaagtcattattataccaacacacacacacacacacacacacacacaccccacacatgtcccccaactcagacttgcacccttcccttgtctcccacacataccacacatacactctactccacactctcccctacacatcataccctactcataaca

SEQ ID NO: 35223 - DNA, 1030 bp, Homo sapiens
cggatggtggcgggcggcgcagaccggctgagccggggaggtggttctccaggatggggaccgaggttctgcagcgccccctgctgccggcgagaggcccaccgcccgaggccgagacctccgggatgacccctgcatccccaggatcgcgcgctgctccgcgcgcgcagagtctgcgcctggtcaggctggacctgccggtagaacacaggaacacaatcagtggctgggagtagatcccatagggaagagttctgattttaaatgagcgacgcatcccgatgtggttcagttattgctgaagataagcgtggaatggaaacggcccaggaaatggagggaaggtatatcctttgggatgaaagcgccaccagctcacttccccgtctccctaaggttttaaaacattgtccatttttccttttgccaaattggtttttataacgtagctgtttttttattccttttaaaattcttcttttttaaaaaccttaaatcctgactacatgaaacaccggaactcttatctgagaaagtagggcggagcagagattattcactttgccttccgaaatttgaggtcaattacacaaaaccctagggcaaattctattgtaggcttgctgtctcactgctaatagaacatcttttgtatatgtttgctaactttacgtaattcagcaagtaaatgttgtggtatacttattttgtagaggtcgagaagaagacccagtcatttttaaggagatatacattaaaaacgtttcttctagaggcagggcagcaagctcttcatgtttatttcaggcctgtcacttggtaacatcggagactagcttgatctctgtaacagagattagctgtttattccacctttgaggagaatccggccactgtttcataaacagtgtttatttattgttgtttaaaagtgaacacgacagccctaggatggactccgagaaggatacccagggtcatttcaggagacggaacagcatagctgaatttaaaattgagcaggatgctg

SEQ ID NO: 35224 - DNA, 1075 bp, Homo sapiens
tgagccaccatgctctgcctcatattaatattgatacagatggccaaatatagaaatatttataaatacatgtatatacccaggctagtatgtaccaccatttcttgctctgtcagcttaagcttagagggcttagaagcaaagatacttcagtagcaacaagcacacccagcattccagtttgtggtttctaataccattctctaataaaagaaaccaatgctctttggagaaatggctcattctagggtggagtagggaatatacaaaatgagcctggagcatcttgtaggccaaaaagtaatgaagtacttaaaataaatgcattgttgagagtatgtcaaagaggagggcacaggagccaactgaaagagctcccaatggccaaagctggaactatttgagcaacaaaataaataatgtagtattggattgtaactcaaagtataaaataaatatctgtgaatacatattgatataaatgattgaataaataaataaatggaggaaaatgaacacatttcccaggcaaaagaatgacgatttatgtagatactacccctcaaggaggtggagcataaccatcatctccatctcttaagtgtggactatgcatggtgacttccttccaaacagtatagtatggaaaggaagtgaaagagtaactttacagtggacacaaatactacctcagccaggtaagcaaggattatatcatgagttatcagtcatgaagataacatataccattatatgccacaaaaatggtactttacttctatagtcttcctctcaaacactcaaatccctatctggccatgaaaaaaacatcaggtcaggtgcaatggctcacacttgtcatcccagcactttgggaggccaaggcaggaggattcttgagcccaggagttcgagaccaatttgggcaatatagtgagacctcatctctactaaaaataaaaacaaattagtagagtatggtggcatgcatctgtagtcccacctacttgggaggccaaggtaggaggatcgcttgagcccaagaattcaagattgtggtgatctatgatcacac

SEQ ID NO: 35225 - DNA, 1102 bp, Homo sapiens
ccgtgtggctctcaggtgggccaccacactgcactgttctttcttcattctgtgggtcatgccagcctcctagtcagttctggtgagacaacttggataccttggttgccagtgaaggattcacatgcttattatgtttttttttttccaatgggagcctcctaacgctgctgtttctagtcagccttctgggccctgccacctattgtaagtttcttgaggcctcccagccatgtttcctgtacagcctgtggaactaagagtcaattaaagcttttttcataaattacccagtctcagctagttctttatagcagtgtgagaaaggactaatacagataattgctaccaaaaaagtgaggcactgttataaagatatctgaaattgtagaagcaactttggaaatgggtattgggcagagattgaaacagtttggagggatcagaggaagacaggaagatgagggaaagtttagaacttcctaaagacttgttgaatgattgtgaccaaaatgctaatagtgatatggacagtgaactccaggctgaggtagtctcacatggagatgaggaacttactggaaattgcagtaaaggccactcttgctatgctttagcagagattggtggcattgtgctcctgctctagagatctatggaaatttgaacttaatagagatgatttaggttatctggcagaagaattttctaagcatcaaagcattcaagacatagcccagctgcttctaaaagcctatgctcatttgcataaacaaaggaatgacctgaaactagaacttatatttaaaagagaagcagagaaaaaaagtttggaaaatttgcagcctgaccatgtggtagaagagaaaaatctattttctgggaggaattcaaggctgaagaaatttgcataagtaaagaaaagctgaattttaatagccaagacaatggggaaaatgtctccagagcagtttagagaccttcgtggcagctcctccaatcacaggcctggaggcctatgagggaaaaatggttttgtgggctaggcccagggtcctgatgctctgtgcagcctcaggatatggcgccctgtgtttcagcc

SEQ ID NO: 35226 - DNA, 1051 bp, Homo sapiens
ttccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaacttgcgtcacttcttcatgacctctttccccaccagaacacagcatacacatgctgtatgtatacatacacacaaatggctttttgaatttgtgggttccacatccctggatgcaaccaatctcagataaa

SEQ ID NO: 35227 - DNA, 1056 bp, Homo sapiens
gattaatagatattcttagttctgttttaatgaacagataactattataaccatcattggtaaagaacatggtaatttcttctatctaaaatccatattattaagtatttagattggggggagatttattctctaaattataaattctctgtaagttttctttatgaaattctatactttcttatagaattaatcctatgtccctactccctcctcttcattcccctgtcaaacacttgagttttctttcacagctttctattcttgttcctatcttaatgaaaagagcaaacttcaaagtcaaacaaaacaatcaaaatttatcactttctagctgtgttactgtgagcaatttatttagcctttctgagctttaggttcctcattttttaaaatagaaatatttatctcccaggcttaacagacaaggaagttttataaataatgaatacttaaactactaccttagttgactctcaataaatgtagctctcctttattcctttctgtagaaccctacctgttactgtggagtttctgtcttaataatctcaagttccaatcatgacatcttagttaattaggtttaaattttagatatttattcataatgtattatctttcatgtaaatcaagtagtgtaatataaagtcttacattaaagtaatgtaaagtattacattgcttcagaaactttaaaacactatataatgtaaaataatattatttcttaagtaacttattttattagcaatgtactaggtatttcccttatctaacttaaattttaaagtgaattgataaagtcaaaagcaaatggacacacagaaaaagatttggaggcaaatcatctcacatcattggtaaatatagattgctgtaaatttctaggtatgttttaaaccctccttaggtgagcagtgactttttcacaattgaaatttatcttttgaaattatttctgttgaggatttaataatcaattgtgtgtgtatacatatatatgtaaaattagattctatttttatatagatttagggctatataaatctatat

SEQ ID NO: 35228 - DNA, 1038 bp, Homo sapiens
gttatagatgaaaaggatttcttttaaaccctattttggttattgtatttgtatcttttgaaatttacattgaaattaatttttatcaaatagaaaatcttttgaatagcattagatttatgttatttgatgagagtcatatgaggtcaccttttgcctcttttccataaatccatagtttgatctgtggaatagctgtcattctttctgagactgtcacttaaaattaatatttatttggaaaggagaaaaaacttgaattcaatctcaattgatatgttggttaaattgctgcttagagtgacacaggtcacaaagtcacaggaattcaaagggaaaaattaatggccccagaggataagaaatccttataagaaagcaatttgttggggaaataatagattgttttcatcccctgaagcatttcagtgatacgggaaagtaaacaggaaagcaaacatacatgtacctacccaatttttttttttttttatcatatctgcttctaaatctgaattttctgtcttgttttaaagaacaaacaatccacacttaaagtccctgggtatcctttctaattcagatctactctactcacacacactccatagatgacccttcttgtgaatttactttttataaaagtaaatgtagtttgaccataaggggagatatataggtatacacacgtaattgttacaaactctagttttgtacattttttattctatagcaacagttttcaaacttcttttaattcatttacagacaattgttttttacaataacacaaaacaagctgaatacttggtgataaatctaatcacagatgtgttcagtctgtacactggaaaccaaaacattaagaaaaattgaaaaaaattaagtaaatggaggagtatatcatttttatggattagaggattcaatattgtaaacaggccaattcccacaaaataacctatagattcaatacaatcctaacaaaaatcccaattggatggtttgtgcattcagtctcttacaatacctcacatc

SEQ ID NO: 35229 - DNA, 1048 bp, Homo sapiens
tgtgtactaagtattagggctaaagtattgagccaagcagaacactaagttaagtgaggtaaaatacattgaacaaatagtcacaagaatacatgtttagaacacacctttgataagtgctaagaaggaagaaacaggatgataaagcatataataggaagcttgattattatctacaagtctgggaaaactgactccttatctaggttctataattattcttagttcataggccgttttctactaaaccatgtgatcttaggatcatcaatattagcatcacctgggagcttgttagaaatgcagactctcaggtctagggaatcagaatctgccctttaaagagatccctaagtgaatcctgtgtgcattagagtactttgagaagcactgtcctaggctggattctagagttttctttgactgtcttctgtcataatattctggtctaaaatatttaatatttttcttgggatagtccttgaattcatttaccctaatctacaatttttattcacccattccagttgatttacttacttcattcatttttctcacagttgcctaattaaccatagtaaaacagtgttttctttaggacattcctctgagcctgtgataacccacataacaaattcaaatttctctgcttagctttggaaacttttaataatttggttatgcctcatctaacatgtgtttctataacctcacagagcgcattatgctcattcattctttcaagaattatttttaagtctatgagacatattaaagcttctagggaatatggacaagtgagaacattctttttcttagcatttaataaaacctttatatgaacagtagacatatgaagcttttgtttgatacatgttgagggtttgatttttttgcagtttgcttttaggtctcgtttttagaaattttgccttttttaattttaattttgtgaagtaaaatggtttgatttttatgaaataaggtaactagatactttttttttttgtttttaaaaatctctttggctgggtgtggttgctcacac

SEQ ID NO: 35230 - DNA, 1050 bp, Homo sapiens
ctgttatatttattttaaagtactaccttaagactgatgttattttgtagtctgtgtatgttaaatcctagtttctatattaaaaatattgggttggaaatgaaaagcaaaagtaagacgagtagctacttctcacccattacagtggctacaattaaaaaatataaaataataagtgttagttgaggatgtggggaaactgcaacccctcatacattgtttgcaggattgtaaaatgttgcagccattctggaaaacagttgggaagttcctcaaaatgttcaagatgacaatcttaacaaaacaatgttaacaaaaatgttaaacaattatgacccagcaattccattcctaggtatatgcccaagaaaaatgaaaatacacacccccgcaaaacttatacatgattgttcataacaatcataagagtaaaaaagtgaaaataacccaaatgtctatcaactgatagatggataaataaaatgtggtatgtattcatacaatgccgtattattcggccataaaaaggaatactgatatattctacaacctggatgaaccttgaaaacattatgtttggtgaaagccagtcacaaataagtacatactgtataactgtacgtatatgaaatgttcacaataggcaaatctattgcctgttccctgtggctggcagggagagggctgaagggaaatgggaagtcaccgctaatagataacaaggcttctctttgggatgatgaaaatattctaaaattgtgatgatggttgcacaactgaatatactaaaaactgtacaactaattggatgatttgaatgacatgtaaactatatctcaataaagctgttcaacaattaaaattttgaaaaagtcagaaaaaaagtttccaggttttaaataactttagaatctacaatttaaaactaaatctttacaatctctgagaaatgaatctatttggctaacctgcatagaatttaatctatgcaggttagaaaaatctgttgaagatgatagctttaagagttataaccacattcatctgggt

SEQ ID NO: 35231 - DNA, 1029 bp, Homo sapiens
ttctttcgggtcaaaatccttggagtaattttcagcttctttgtgatagatttacatcaaatctatcaggaaatcttaaaagcgtctaccttcaaaataaatgcaaaaatctaaccaattcttggctccccaaccctaccatctgggttcaagcctccatcatttcttgctgtattattctaataatgtcttattccatctctctgcctccagatccttaaaaaaaaaagccaaatgttattactcctgtgctcaaaaacctccaacagcttcctatctcagagtaaaacccaaacttttacaagggccaactagacccatttatgatctctcaactgctacacttacccctattttcaaccacagtgaccttgctgttcctctaacatgttctccccttggtgttttgcaactgctattctttgtctagagcatttctcttccagttatcacacatctttgagttttcacttcttcatttctctcctaacatgtgtatcaccttattagtacacctttctgacaaacctcttccaaccctggcagtcctttactttttctgcagctttttattactatctgacataacttacagtaatttattgtccacctttcactattgaagcatattaaaaacaagttcaatgttttgtttgacaatatagttcagtcatctagaaaatagcctagcacataataaaaactcaaatgtttgagcaaaagtgaagtcttgccttgtgtgggataatatcttaaatgtgcatattgaagaagatagctaaagcctggggagcactgtgacactagtaattataccagatttaaaatattcttggtgttttcattgggttgtttcttccttcttactttttcattatccttacaacattctatctgtgcctataagaacaatttgaacactgatattagcaggcatatttacaatcaatatctgaatttttcctttaggttttctgaactgcagtttttgtttcacaaaactaaaaaatctcttatttctaaaataag

SEQ ID NO: 35232 - DNA, 1048 bp, Homo sapiens
caaggccagaatacaaaaaaagaatctactccagaatgctactattaaattacacaaagaaataacatagcttatcaagtacgaatttatagccaaaaaacccttaacgggaagaataaatattaaaaaggaaacaaaaagtaataaaattaactatccaagtgattggattatcagtaaaactatttttaaagagccatgaacaaaaagatctaaaggataataaaaaataacaaatacttgagaaaaatacagtgattatttaagagtctagaattggataagaggataaagcaagataaaggaaagacaaagatcattttcatttatagtttatatgctataatgcaattaaattatttaaaacatgttgaatttcaccagtctttttacaggataggtaattttcaggtgtcaatgacatttccctaataatcatcctgtgacttagggcatgaccgtaaattagagattccaaagcaaagagcatactattaattttttttgttatggatttgtacttgcctgacagactgaaccaaatgtacattatttcaattagctttgtttctttgactggagagctccaagtcatttagtaatgtttttcagcaaacctactttttcttttaatacttactctaacaatatgttggaagtatctttagggataaggaagatgaaagagccatcacccacttaatactgatcacttccacagacatttaggtttcttcttttcttctaagtggtttcagttttttaatgttctgaaaattccaggtgcccttttattgtttagaataattacctttgaatttagaaaaaaaattgtaatgacatctggcagcattataaatccaaagctgttttgttagaaaacatgagtatataaaagaacattggccaggtgcggtggctcacgcctgtaatctcagcactctggcaggtggatgtgggtggatcatttgaagtcaggagttcaaaaccagcctggccaacatgatgaaaccccatctactaaaaatacaaaaattagctgggcgtg

SEQ ID NO: 35233 - DNA, 1046 bp, Homo sapiens
ttttggcatgattttgcagcggctggtaccggttgttcctttccatgtttagtgcttccttcgggagctcttttagggcaggcctggtggtgacaaaatctctcagcatttgcttgtctgtaaagtattttattcctccttcacttgtgaagcttagtttggctggatatgaaattctgggttgaaaattcttttctttaagaatgttgaatattggcccccaccctctcctggcttgtagagtttctgccgagagatccaccgttagtctgatgggcttccctttgtgagtaacccgacctttctctctggctgcccttaacattttttccttcatttccactttggtgaatctgacaattatgtgtcttggagttgctcttctcgaggagtatctttgtggcattctctgtattacctgaatgttgacctgccttgctagattggggaagttctcctggataatatcctgcagagtgttttccagcttggttccattctctccatcactttcaggtacaccaatcagacgtagatttggtctgttcacatagtcccatatttcttggaggctttgttcgtttccttttattcttttttctctaaacttcccttcttgcttcatttcattcatttcatcttccatcactgataccctttcttccagttgatcgcattggctcctgaggcttctgcattcttcacgtagttctcgagccttggctttgagctccaacagctcctttaagcacttctctgtattggttattctagttatacattcatctaaatttttttcaaagttttcaatttctttgcctttggtttgaatttcctcctgtagctcggagtagtttgatcgtctgaagccttcttctctcaactcgtcaaagtcattctctgtccagctttgttccgttgctggagaggaactgtgttcctttggaggaggagaggcgctctgctttttagagtttccagtttttctgctctgttttttctccatcattgtggctttatctacttttggtctttgatgatggtga

SEQ ID NO: 35234 - DNA, 1472 bp, Homo sapiens
tcaacagcactttaaggaatagtgatgtgtaattctgaggaagctgtgttaagactatctcatctcatatctttacttgaaataatgttttcctctgagatagtctgagtcaagagattattctttactaagatagtctattggctatatataggggctatgtatagatgaagggattgcagggaactttcattttctacctcccatagccttaatttttaaaatatttatattgagcatggaattttttattataaaaaattttcaggcaaaatgataggtagagagaacagtgcaataatgaatttcaaagttcaataatttttagaaatgtgtcatagggtgagtttaacttttttatgactctttgagtgagaagttccaggtggtgccatgtctgtgcagtcttaaccaactgaggaatcagaccagaatttgggctgaccacagcagctaaaagtgagtagaaaagcatacagggtgagagagggaaaccataaattctatgcaaaagctctgcccaaatatttggctgtgccctgaattacacatgtgctgtgcagattttaatgttaattgcacagattttttttagctgctgcccactccaaggaagatagtttggaatttgagtttagctcatttagatgtctataaaaacaacataatggtactttttaagacaaatataataaaatctattgtatctaacatgaagttttcaaaatgcccaggctaaaatctaaaattagtagatattaacaaaataagaaaatgtgacatgaaattaaaagagacaaaacagaatcaatagagaccaaccacaaagttgaccaagatgaaagaattagtacttaaggatttaaaagtagctattataactattatgctccagaatgcaaaggaatttatgctagtaatgaatgagcaagtaggaatttcaacacagaaataggaactagaaaaagaaccaaatggaaatcatagacctgaaaaaagggcaaatgaagactttgctgaatgggcttaatagtagagtggggatgacagatgaaggaatcaggcaacttgatgatagataaatagtacttaaaaaatcttatgagccaccgcctcaaaaaaaataatgaatacagcttcagtgatctgtagaacgatatttttaaaagaccaatatacgttattggacccccacaagaaaaaagagaaaaagatgggggcaaaaaatatttaagaaagaatagccaatgaaaaacataaatatacatattcaagaggctcagtcaatcctaagcaagataaattcaatgaaaaccacaccaaggtacataataatcaagtgacagtcataatttgaccatcaaagtcaaatgattatcaaagataatgagaaaaatcttgaaaacaaccagacaaaaatcaatatattacacacacaaaaaagtaacataaatgatgttgacttctcacaa

SEQ ID NO: 35235 - DNA, 1034 bp, Homo sapiens
gtgtgattatcttcttaccaaggtttatatgaaccaaaaatttccagtcattcttaaaaatgagcctcccaagcatttttcccttgtgtacagtctattgttagcacatttaattgtattgtcagaagtttgaatcccttactataagtaatagtgttataaaacttatacgttagaattgtttttattttttgataggaaatcttacatggtatgacaaatgtatttagttttaaacttttcttggataacaattcttaaagcactgtacctttttctgcagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggtaaggttgtatgtatatgtttggttgtgtcatattcacattcattctgacatttatggctcacttttaactggtctcatccccttttaaactcatatttcacagttcaacatacatgtttctcattgtaaacaaatatttttcttatcattttgcctttgctcatgatgttctcattacctatagtttctcttctgttctcatcattcttcatccttcaagattcagtttaaaccaggtgtggtggcacgtgcctataataccagctactcaggagactgaggtagcagaatctcttgagcccaggagttcgaggccagcctgggtaacatagggagacctccatctaaaaaaaaaaaaacccaaaacaaaaatagatccaattcaagctccacattttccacaaagccatcttgggctaccctgccccttgagagatttttttcttctctgacatgtctctggcacttgcttatagtattgtactgtttctatcctttctcactaacc

SEQ ID NO: 35236 - DNA, 1050 bp, Homo sapiens
ccctttcttatgccctcataacatcagtttttaccacttgtgtgatgctgtcccagctgtttatctgacccctgggtcccttggaacagctgttctggtttagctgggtactgagatgggtcctggacttactcatttttaaaaaagatctccaagtgattctgatgcagtatccaactaagaatcactggtacagaacaccctcttgcaaagaattcccaagccttataagttccctaatcctgttttcttttgttcaggctttacatgtgtataaagaccagccatggtgaagcaattttagaatatttagataatattctaataatcatattttatatgattctaaaacagacaaatgccttttctctgtataatggaatagtgaaacaaatttgatcaccactgattttcttttgatgtatctttcagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaa

SEQ ID NO: 35237 - DNA, 1049 bp, Homo sapiens
tgagtctttacataatacatgatgttctgttgattatttttatttttttgatgccactattaacagcaaccagtaaacattatttcccctcaagcagactggcttctaaacctaaccacttaagtttcttcttctccctcattacctcacagtcttcattttgaatattaagtttggggatatctgaagtaattgaaattgagggttttaagatctaagtgaaaagctttacttgggtcaaaaggcagatttccaacaaatttcttttcttattccatctagtatctgtacatgttttgaaattaagggtatatacaaatgtgaattatgaggggtttttttctttgttgtgtttttttttttttttttttactttttcctttgagacattctaaaatattgttaggtgatctaaataatttattttcttttttccagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaaggtatttttattttgttggattctttggaaaattaaatatttgttcaaagaaaatatatactattttacatgctttaagagcctaaggatgtcatccgttttcattgccatcattatttgataatatttttaaagatagctaaagctgggtgaagtggcacatgcctgtggtcctagctgctgatgggaatcccttgagctcaggagttcaaggactaacctgggcaacatagtgagacttgtccaaaaaaagaaattgcaaaaaatagctaaataaaaatatgattgttacatgtgataattattttgaaaatcaatatttaaaaaaatgacttgttacaaattctaagcctcaaaaattgtgatacttacagtcagcttcttcattaaggtttagttttttaaaaatacaggcttatatttaaaactgagttgattactgatttcaatactata

SEQ ID NO: 35238 - DNA, 1022 bp, Homo sapiens
caaacctctgtgggaaaaaaatgagattttccctaccagatatcaaaatacataaaacagtattggcacaaggatagataatttgaacagaatgcagaaaaagaaaaaaaaatataaaatcagaaattttggttatgataatggtggtatttcaaatcattggtgaaaagatgatgttaaaaagatagaaaatcatttagaatattctttatttcatatataaaataaattccagacgtattaaagagctaagtgtaaaaaagagtgtattagaagaaataaaattatttttattctcttggaatagagaagactttctaatcaaaacacaaaacccagaatccaaaaaagaaaaagtgattaatcgatctaaccataaaaattaaaatttttatgaagaaagatactaaacaaagataaatgacaaatgggatactggaaaaattttaaaagggttaatgtgcaaaattcatcaagttccacattaaaaggttaacaacctaatagaaagatggacaaagtatgtgaactcagtggttcaaacaaagctcacaaaagtatcgatgcaaatctcctttaaacatagcaaagcaagttcagcctcacttttcattaaagagatgcaaatttaagcaataatttttacccagcaaattggcaaaatgtagaagatggttaacatccagcatctacaaatacatggggaaacaggagttgtcatacagtataggtgggaatgtaaactggcaaatactttttataaggtaatgtagcaaaatctaactaaatttaaactgtacagatccttttgcagttcctggtacaggagtctgtcctatagaaatacttgcatgtgtataagcatgcggtgacatacgtgtccctgcagttggtcagggccctcacatctttaactatggctcctaaagtggccgccttcactctggtttctctgccatcaaatttttccccactctattccatctttcatactgctgttacagttattttactaaaaagta

SEQ ID NO: 35239 - DNA, 1027 bp, Homo sapiens
ttttctcttgcttttccagttctttaagatatatccttaggttgtttatttgaagtttttctactttttgatggaggtatctattgctataaacttcacttttagtactgcttttgctgtatctataggttgtgatacattgtgtttctatttttatttgtctcaacaaatttttaaatttccttctaaattggttaattgacccaatggtcatttaggagcgtattgtttaatttccttgtttgtgtggttttcaagttcctcttgttactgaattttagttttattcctttgtagtcagaaaagatactttatatgatttcagcttgtttgaattttggggacttgttttatggcctaatatatgttctgtccttgagactgtttaatatactgagaagaaaaacatatatttttcacctgttggatgaaatattctgtaaatgtttattaggtcaatgtagtctatagtacaaatttaatctgatgtttctttgttggtattctatgtagattatctgtccaattctgaaagaggggtgttgaagttctcagctgttattttattggtgtctaactttatctttagttctaatatttgctttatattatctggatgttccagcattgagtacatatatatctacaattcttatatcctcttgtgggattgacccctttatcattatataataacatttttgactctctttacaatttttgtcttgaaatctattttatctggtgtaagtatagctactcttgctcttttggggtttctgtttgcatggactgtctttttccattcctgtattttcagtctttgggtgtctttatagatgaaatgagtttctcgtaggcagcatatgattaggtcttattttttatccattcagctactcttttttttattggagaatttagtccagttacatttaatgttattagtaataggaaaggactcactactgccattttgttactttttttctggggttgtattgttggtcctctcttccttcctttc

SEQ ID NO: 35240 - DNA, 1034 bp, Homo sapiens
taaattttaggattttttttctatttctgtaaagaatgtcattggtattttgattgcatttaatctatagatttgattgctttgggtactatggatattttaacaatgttgattcttctgattcatgaacatggaatatctttccattgttttgtgtcatcttcaatttctttcatcagagttttatagttttcttttagagttattttacttctttggttttttgttcctgagtattttgttttatttgtagctattgtaaatgggattactttcttgttttttttttcagactgttcagttggcatatggaaataatactgatttttgttcgttgatcttgtatgtggcaacttaatttatccaatctaatagttttgttggttgaatctttaggtttttctaaatataagatcatgtcatctgcaaacaaggataatttgacttcttcctttccaatttgggctcccttcatttctttcccttgtctgactgttttggctaggactcctcatactgtgttgaataacagtggtgaaagtaggtatccttgtcttgttccagatattagcagaaaggctttcagtttttccccattcagtatgatattacccgtgggtttgtcatacatgacttttactttgttgagatatgtttctcctatacccaggttttctttagagtttttatcacaaagagatgttgaattttatcaaatactttttcagcatcaattgaaattatcatatggtttttgtcttttgttgatacatcacatttattgattttcacatgttgaaccatccatgcatccctgggatgaatcccacttgatcatgaagaatgatctctttaatgtgttgttgaattgagtttcctaatattttgttgaggatttttgcatctgtgttcatcagagatgttggcctatagctttccttattttgttgtgtctttgtctggttttggtagcagggtgatactgacttcatagaataagtttggaagtattcctttcacaattttttggaata

SEQ ID NO: 35241 - DNA, 1872 bp, Homo sapiens
agaaatcaaagattacacaaacaaatgaaaaaatgttccatgctcatggatagaaagcatcaatattgtaaaaatggtcatactgcccagagcaatttatacatctaatgctattcctattaaactaccattgagattcttcacagaactagaaaaaactattttaaaattcatgtggaacgaaaaaagagtccagatagccaaggtaatcctaagcaaaaataagaaagctggagacatcatgctgcctgacttcaaactatactgcagggctacagtaaccaaaacagcatgctactggtacaaaaacgggcacatagaccattgcaacagaatagagaacccagaaataaagccacacacctacaactatctgattctcgacaaacctaactcaagcaatggggaaaggactcctattcaataaatggtgctgagataactggctagccatgtgcagaagattaacaaacattaacttaagatggattaaaaacttaaatgtaaaaccccaaagtataaaaaccctggaagacaacttaggcaataccattctggacataggagtgggcaaagattttattaagaagataccaaaagcaattgcaataaaagcaaacattgacaaatgggatctaattaaactaaagagctcctgcacagcaaaagaaactatcaacagagtgcacagacaacatacaaagtgggggaacatttttgcaaactgcatctgacaaaggtcaaatatccagcatctataaggaacttaaatttacaataaaaatcaaaccttattgaaaaatgggcaaagcacttgaacacctttcaaaagaagacatacatgtggccaataaccatatgaaaaaaagctcaacttaattagagaaatgcaaatcaaaaccacaatgagataccatctcacgccagtcagaatggctgttaaaacatcaaaaaataacagatgctgttatggttgcagagaaaagggaatgcttttacactgctggtagaaacagaaactagttcagccactagtggaaagcagtttggattcttttttttttttttttctttttgagacagagtctcactctgtcgcccaggctggagtgcagtggcgcgatctcagctcactgcaagctccgcctcctgggttcacaccattctcctgcctcagcctcccaagtagctgggactacaggtgcccaccaccatgcctggctaatttttttttatttatttagtagagatgggatttcaccatgttagccaggatggtctctatctgcctcatgatctgcctgccttggcctcccaaagtgctgggattataggcgtgagccaccgcgcccggcttggatctcaaagaactcaaaacagaagtgccatttaacccagcaatcccatcactggatatataacgaagtaatagaaatcattctaccataaagacacatgcactcacatgttcatcggaacagttattcacaatgacaaagacatagatcaacctagatgcccatcaacagtggactggataaagaaaatatggtacatatatacaatggaatactatgcatccataaaaaagaacaagatcacgtcctttgcaggaacatagatggagctggaggtgattatccttagcaaactaacagagaaacagaaaagcaaatacttcatgttctcacttataagtgggagctaaatgatgagaacacatggacatgtagagagaaactacacacactggggcctatcaatgggtggaggctgggaggagggagaggatcaggaaaaagaataatgagtactaggcttaatacttgggttgaaaataatctgtacaacaaacctcagtgacacaagctt

SEQ ID NO: 35242 - DNA, 1032 bp, Homo sapiens
caaagattgaaggtggataaacccacaaagatgagaaagaatcagtgcaagaatcctgacaactcaaaaagccacagtgccttttttcctctaatctaccccattgcctatacagaaagggttcagaactggactaagatggctacaaatgacagaaatagaaatcagaatatgcatgaaacgaagatcattgagctacaggagtatgttgaaacccatccaaggaagctaagaacgatgataaaacaatgcaggagctgcccagcaaaaatagccagtatagaaaaaaaccaactgacctgatagaactgaaaaagacactacaataattttataatgcaatcacaagtattaaaagcagaatagatcaagtggaggaaagaatctcagagtttgaagactggatttctgaaacaagacaatcagacaagaatagaaataaaagaatgaaaaggagtgaacaaaacctccaagaaatatgggattatgtaaagagaccaaatctatgactcataggcatccctgaaagacatggggagaagggaagcaacttggaaaacacatttcagaataccatccattagaacttacccaacctagcttgagagggtaacattcaaattcaggaaatgtagagaaccctagttagataagttagaagaagatcatccgcaagacacataatcatcagattttacaaggtcaaaatgaaacaaaaaattttaaagacatcttagagagaaagatgaggtcacctacaaagggaagatcattagactaagagcagacctctcagcagaaaccctacaagccagaagcaattgggggccaatggtcaacattctcaaaagaaattccaagccagaatttaatatccagccaaaccaaacttcataagcgaaggagaaataagatcattttcaggcaagcaaatgctgaggaatttcattactaccagacctgccttacaagagcacctgaaggtagcactaaatacagaaaggaaagatcattatcacccactacaaaaat

SEQ ID NO: 35243 - DNA, 1049 bp, Homo sapiens
ttttttgagcagtttttcatgtctctgtctccttcagttctgctctgatcttagttattcattgtcttctgctagcttttccatttgtttgctcttgcttctctagttattttaattgtaatgttagggtgttgattttagatctttcccactttctgatgtgggcatttagtgctataaatttccctcttaacactgctttagctgtgtcccagagattatggtacattgtgtctttgttctcattggtttcaaagaacttcttgatttctgtctcagttttgttatttacgcagtagtcattcaggaacaggttgtttaatttccatgtagttgtgcagttttgagtgagtttcttaatcccgagttctaatttgattgcactgtgatctgagagactgtttgttatgaactccattctttttcatttgtggaagagttttctacttccaattatgtagcctattttagaatacatggtatgtggtgctgagaataatgtatattctgttgatgtggggtgtagagttctgtagatgtctattaggtccgcttggtccagagctgagttcaagtcttgaatatccttgttaattttctgttttattgatctaatattgacagtgggatgttaaagtctcccactagtattgtatgggagcctaagtctctttgtaggtctgtaagaacttgttttatgaatctggttgctcatgtatttggtacacatatatttagggtagttagctcttcctgttgcattgatccatttaccattatgtaatgcccttctttgtctttttggggttttttttgtttgtttattattattatacttttaagttttagggtacatgtgcacaatgtgcagattggttacgtatgtatacatgtgccatgctggtgtgctgcacccattaactcgtcatttagcattaggtatatctcctaatgctatccctcccccctccctccaccccacaacaggccctggtgtgtgatggtccccttcctgtgtccatgtgttctcattgttcaattcccaccta

SEQ ID NO: 35244 - DNA, 1036 bp, Homo sapiens
tttttttttttactttaagttctgggatacatgggcagaacatgcaggtttgttacataggtatacatgtgccatggtggtttgctgcacctatcaacccgtcatccaggttttaagccccgcatgcattaggtatttgtctaatgctctcccttcccttgccccccacccccgaataggccccaatgtgtgatgttcccctccctgtgtccatgtgttctcattgttcaactcccacctatgagtgagaacatgcagtgtttggttttctgttcctgtgttagtttgttaagaatggtggcttccagcttcatccatgtccctgcaaaggacatgaactcattcttttttatggctgcatagtattctgtggtatatatgtgtatatgtgccacattttctttatccagtctctcattgatgggcatttgggttggttccaagtctttgctattgtaaatagtgcttcagtaaacatatgtgtacatgtgtcttgatggtagaataatttacaattttttgggtatatacacagtaatgggattgctggatcaaatggaatttctggttctagatccttgaggaattgccacactgtcttccacaatggttgaactaatttacactcccaccaacagtgtaaaagcattcctatttctccacagcctcaccagcatctgttgtttcctggctttttaatgattgccattctaactggtgtgaggtggtatctcattgtagttctgattcgcatttctctaatgaccagtgatcatgagctttttttcatgtttgttggctgtataaatatcttcttttgagaagtgtctgttcatatccttcacccactttttgatggggtttttttttcttgtaaatttgtttaagttccttgcagattgtggatattagacctttgtcagatggatagcttgaaaaaattttctcccattctgtaggttgcctgttcactctgatgatagtttattttgctgtgcagaagctctttcatttaattcgatcccatttgtcaatt

SEQ ID NO: 35245 - DNA, 1032 bp, Homo sapiens
gcattttctgatactaagtaaatacaaagtaaattttattgttgtcattttttattttactgttgagggtatggaagacatcatctgttgccagtacaagagctgtttttttttccttcatacatagtcacataaccctaattttgttccagtggcaatgtgctcagggaagatgagcttattccataacctgaggtaataagtcattgacctaaaccagtttttatgtctttttgccaggaattggtttggaagtggacatgtgacctagttttagccagtgagatgaaagtcccttgtggagcttctgaaaaagtttttctctctgataagaggagagagggcaaaaagaaagccttccccttttcctgctccttgtcattttagaaagtgatgtgtgaagctgctatagccatttttaaactatgattgtagatatcagcacatgagaagattagaagaagagaaacatgaggaaacctttgcaaagtccttaagtgatattattgagctactgaagcaaatctggaactatataccttccaacttaatattaggtgaagtaagaaaatagtcattcacaaccgttgagtgattactaaatgtcaggcaccatttaaggctttgagatacattagtgaataaaatagacagaaatgactattctcacttatttgttgggtgttttattacttgtagcctaagtgtactgataaagagatttaattacatctgtcaggggttcacaaactgtagcttgtgggtcaaatctggcctgccacatctttttataaataaaatttattggatcacagccatgcttagtcatttaaatcttgttgatggctttgttttatgtgactatgaagttgaatagtcgtgacagagattgaatggctcacaaaacctaaaatatttatgtactctctggccttttacataaaaagtttactaatccctaatacatggaatgttctttcactgcagaatctcttaaactggtctttaacagtcactaaaaagtttttttga

SEQ ID NO: 35246 - DNA, 1033 bp, Homo sapiens
tggggttaggaatttatggtgctaccaccatccctggtgctaccaccatccctattactaccatggcagcattatttccataaaactggagacttgatattggaaaaagggtcataggatattgactacaagagacatttttgtctatccagttttacttaccagccaccatatcaacagaaaaaatggtctcagctcacttctaccttttatatctcccttaaatgcctctcactggtaaaattttaatcttatccacaacttcagctgcaagacatctgggcaatgtagttttggactttccgcccctgggacagaggccagaatgtggaagggaacagaaataaataatgagtgccagtggttcatacaacacattagataataggtgtttcaaatgtatattcccagactgtggtgtgtttgatgaacagaatttttttttcttttttttttttaacttaaagtaaatctctcactcttctcctgtggttattgttctttgtatctcctgtaagaagtcctttctcagcctaatgtcatagagatcttctcttatatttgctactaaaaaatgtttaaagcttttccataccaagtttcttaactttaacccataaaattcatataactggactgaaatctgatacatcattttttgttgacttttaactagactaaaaatccaaaattttttgagttctaaatttattcaaaacatgggctcttttaaagtttgacattcttttatttgtatttttctatgttatgtagtaattttattttattttgattatatttatttttattttagtgtagctatatttaaattaatacatgctgttccttaaaattacatagcacacccacggaattgtcttgcctttggctatttcatgattttctctcttccttgtattttccattagttttctttccttctaatttccaaaaacttcatatatttaagctgtcagtgtttactgaagtgcaaaataaagtacatcttttaattgggcttttagtttttctc

SEQ ID NO: 35247 - DNA, 1050 bp, Homo sapiens
aggcaataatggatgctggtgaggatgtggagaaaggggaaccctcctacactgttggtagaaatgtacattagtttagccactgtggagagcagtatggaagtcctcaaaaaattaaaactagaactattttgttttcaaaatttatatgaaaagggacaagaagagctaagacaatcttgcagaacaactgcacttggaaacagatactaccaggtcttaatatttactgtaaagctatagtaatttggttagtatggtattggccaaggaagcaagccagttaaacagaataaagtttggaaatagctctacacataccagactttcatatagaataaagaaaaataaattttgatctctacccaaactactctcatatgtaatttctgcattgattgcatatctaaatgttaaggtaaagcttttagaacaaaacttgagggaagaagttatgagcttataataggcaggatggcttaaacagcacataagcactaatcataaacgaaataactgataaactgggctacttcaaagtgaaagaacttatgtttttaagacatcattaagaaagtaaaaagacaagctatggaatggagaatatatttgtaatcttgcaaaaatctagaatatatgaagaatgtcttcaaattaataactaaaacaattacccattagagaaacaggtcacttcacaaaagagggtatttaaaatgctttgtaactgtagaaaagactgttcaacttcattatttatcaggtaaatggaaattcaaaccacaatgaaatactactatatccactggctagagtgaaaagcatagttccaagtgttgacaaagatgtggaatagctctcatatactgcctgtgggagagtaaatgggtaagattacttcagaaaattgtttgacattttcttctagatctgactgatacagaccttatgagtcatcaactctacctataggtatacccatcagaaatgcctataccaataagactttttcaagaatgtttgtagcagcactgtttataatagtcaaat

SEQ ID NO: 35248 - DNA, 1050 bp, Homo sapiens
cccatctgacagaggtctaatatccacagtctacaaggaacttaaacaaatttacaagaaaaaaatgaccccatcaaaaaatgggtgaagggtaacaacagacacttctcaaaaaagacatttatgctgccaacaaacatgaagaaaaagctcctcgtcactggtcattagagaaatgcaaatcagaaccaaatgagataccatgtgacaccagttagaatggcgatcattaaaaagtcaagaaacaatagatgctggcaagtttgtgtataaataggaatgcttttacactgctggtgggagtgtaaattagttcaaccattgtggaagacagtgtggcaattcctcaaggatctagaaccagaaattccatttgacccagcaatccaattactgtgtatatacctaaagtattataaattattctataaagacacatgcacacgtatgtttattgaagcactatttacaatagcaaagacttggaaccaacccaaatgcctatcaatgatagactggataaagaaaatggggcacatatacaccacggaatactatgcagccataaaaaagaatgagttcatgtgctttgcagggacatggatgaagttggaaagcattctcctcagcaaactaacacaggaacagaaaagcaaatactgcatgttttcactcataagtgggagttgaacaatgacaacacagggacacaaggaggggaacatcacacaccagggcctgtctgtgggtggcatgtaaggggaaggagagcattaggacaaatacctaatgcatgcagggttaaaacctagatgatgggttgataggtgcagcaaaccaccatggcacatgtatacctatgtaacaaacctgaacgttctgcacatgtatcccagaacttaaaataaaaataaaaattaaaaaactgccaactgcaaataaaaaaaaaagaaatagtgctggaaaaactgtatatccatatgccaaaaataaatcaccccgtctcttttttttttttttatactttaagttttagggtacatgtgcaca

SEQ ID NO: 35249 - DNA, 1043 bp, Homo sapiens
tggccagaatgcctctctagattcatgttcatagggtatctctgaaagaaaggcagcagccccagttaggggcttatagataaaactcccatccccctgggacagagcacctgagagaaggggcgaatgtggttgtagcttcagtggaattaaacgatcttgcctgatggctctgaagagtgcagcagatcctgacaagcaggatcctcccagcacagcactagagctctgttaagggactgagtgcctcctccagtgagtccctaacccccatgcctcctgactgggaaagatctcccaacaagggttgactgactcctcatacaggagagctccagctggcattaggccagtgcccctctgggatgaagcttccagaggaaggagcaggcagccatctttgctgttctgcagcctctgctaatgatacaatacccaggaaaacaaggtctggagtggacctccagcaaactgcagcagacctgtagaagaggggactgactgttagaagaaaagctaaaaaacggaaaccagtaacatcaacatcaacaaaaaggaccccaacacaaaaaccccacccaaaggtcatcagcctcaaagatcaaatccaccacgtagataaatccatgatgatgaggaaaaaccagtgcaaaaatgttgaaaaatccaaaaaccagaattcctcttcaccacataatcacaactcctctcctttctgcaagggcagagaactggacagagtatgaatctgacaaattgacagaagtaggcttcagagggtgggtaataaactcctctgagctaaaggagcatgttctaacccactgcaaggaagctcagaaccttcataaaaaggttacaggagctgctaactataataaccagtttagagaagaacgtaaatgacctgacagagctgaaaaacacaacacaagaactttgtaaagcatacgtaactatcaatagctgaatcgatcaagcggaagaaaggatatcagagattgaaaatcaacttactgaaataaggcatagagacaagatta

SEQ ID NO: 35250 - DNA, 1090 bp, Homo sapiens
ggaagccctagccagagcgatcagacaagagaaagaaataaagggcatccagattggcaaagaggaagtgaaactgtcactgtttgctgatgatatgatcatttaccttgaaaaccctaaggactcctccagaaagcttctagaactgataaaagaattcagcaaagtttccagatacaagattaatgtgcacaaatcagtagcccttctatacagcaaccaagcagagaatcaaatcaagaacttgaccccttttacaaagctgcaaaaataaataaaatgcttaggaatatacctaacaaagtagtcaaagtacaaggaaaactatgaaacactgctgaaagaaatcatagatgacacaaacagaaacacatctcatactcatggatggtagaatcaacattgtgaaaatgaccatatttccaaaagcaatctacagattccatgcaattcccatcaaaataccattattcttcacagaattagaaaaaacaattctaaaattcatatggaactaaaagagagcctgcatagccaaagcaggactaagcaaaaagaacaaatctggaggcatcatactacctgatttcaaactatactctaaggccatagctaccaaaacagcatggtactggtataaaaataggcacatagaccaatggaacggaatagagaacccaaaaataaacccaaatacttagagccaactgatatttgacaaagcaaacaaaaacatcaagtggggaaaggactcccttttcaacaaatcgtgcagggataattggctagccacatgtaggagaatgaaactagatcctcatctcccaccttaaacaaaaatcaactcaagatggattaaggacttaaatctaagacctgaaactgtaaaaatactagaagataacattggaacaacccttctagacattggcttaggcaagaatttcatgaccaagaacccaaaagcaaatgcaattaaaaacaaagataaatagctgggatctaattaaactaaagggcttttgtactgcaaaggaacagtcagcagagtaaacagacaatccacagagtgggagaaaatcttcacaat

SEQ ID NO: 35251 - DNA, 1092 bp, Homo sapiens
tccaaaaagaaccttcaaaaccatgcaaatacatggaaattaagtaagcctgctcttgactgagcattgggtcaaaaacgaaatcaagatagaaatttaaaaattcttctaactgaatgacagtaatgacacaacctaccaaacctgtgggatacagcaaaggcagtgctaagaggggaaagttcatagctctaaacacatacatcaaaaagactgaaagagcacaaactgacattccaaggtcacacctcaagggactagagacacaagaacaaactaaacccaaacccagcagaacaaaggaaataaccaagattagagcagaattaagtgaaattgaaacaaacaagcaagcaaacaaacaaaaaacccaaaagataaataaaacaaaaagctggttccttgaagggataaataaaattgatagaccattaacaagattaaccaagaaaagaagggagaaaatccaataacctcactaagaaatgaaacgcgaggtattacaactgtcaccactgaaatacaaaagatcatttaagtctactatgaacacctttatgcacataaactagaaaacctagaagagatggataaattcctgcaaaaatacaaccctcctagattaaatcagaaagaattagattacctgaacagattgataacaagcagcgagattgaagtggtaattagaaaattaccaacaaaaaaaaaagtccaggaccagatggattcacagcagaattctaccacacattcaaagaagaattggtgccaatacttttgatactattccccaagatagagaaagaaagaaccctccctaattcattctgtgaagccagcatcacactattatcaaaaccaagaaaggacatatccaaaaaagaaaactacagaccaatgtccttgataaacatagatactaaaatccttaacaaaatactagctaactgtatccaacaacgtagcgagaagataatccactatgattaagtgggttttagagcagggctgcagggatggtttaacatatgcaagtcaatacgtgtgatactcaacataaacagaattaaaaacagaagaatcacatga

SEQ ID NO: 35252 - DNA, 1050 bp, Homo sapiens
ccattgtctcttacccactcctgtttaatttggattcttcagcctgcaatttctccttaaggtggaggtttgtcctggaagagtttcaattggttttaagaattctaaaaaatatgactatagcttatcttcccaatgcttctcaattttagtagtagtaataagatgtggagaatatattttactttcattaacccgaagagcaagccagcagagactgagatttcatgtttatgaaatcagaaatggtagttctttgcagatgttatttttttcactttggcagtaattagttggcttagatatataaaagggcctattttcaagttttaaaatggtgtattgaaactgatgattcatcttattttgagaagcagtgaagactagccgttttgcatgggatacatcaaataattactgtatttctagttttaaagaattgaccattactcaatgaactgaaatctgttttcccgcttgtttcagatcgaagactaaatgaagattttaggcggtatcaaatggaaagtttttccaaatattcatctgtacaggtatgtaaattataaattctacttgggaatattctcatgtgaagttgcctacagcactttgaaacttggcttacaactttgattcctgtaatgggaaagcttgtttttgcttaatgaaagtaaatcttttgacaatagaaattgcccttttccccccaaccagagttggagcttatatattatatatgatatataaaatgtctgagttctaaaatgggaattcattcgagttctgaaacatcctaaaattgtttctcaatatacctctagttctgtgttctaattctctgcattctcataaattatgacaggagcataaactaatgcaaattgtaaataatatatggttttttaaaaatatcttttttccttggttgtcatatcttcttatttaaatattgtgtttaaaaaattatttagccagaaaggtataattattggtggaccttgcattacagaatattaaaaggaaggtaatggctcgtagattagtggt

SEQ ID NO: 35253 - DNA, 1028 bp, Homo sapiens
cctacaaggtgggcatagaaggagcccatggatcctacagtgagaagagcctacagaggtctaaacttactactgtgtctattcaaagatccctcatatgtcagcagaaacaaaaccattcagcattttaagatattgagatactctgtgtctttagtgcacggcaaaagagaaaataatttaaatcaggactaacatattgtttatactgaaatttcatttgagcaacgatcaattttcactattttttatattttaggttatgtctttgaaagcagggatagtatgtcctgtttactgccaatctccaaatcctggaagatgtgcttgtcaaatattaaggacacaaaactgtatgttttatttatgaaaagtaaaccacaaatttatatgctctcttagataattgctaaagtcacaaaaacagcctagggattagtaggtggctttaccagtaacataattggagtatttgacaattttgtggacttactgctcaacacttaaatcaagttgcatgagaagaaaactaaaatgattagtgaatttgaagacaaaatacatgtaacaaataagaacatttttaaaactcatatctgtcatttcccagcttaaatcccttcattactactcctctttgaggtataatattttttacgttataagaaaaatctttttgggaaatgcttctcatccatcctttcttcaaacttctcagcatcttccactttttatttgcatgccccaatctcgccgtcttaacttgtgttcaatttcctgcctaagcatgctgctccccctccccactaagctttctgtctaaacatgttgccctagtcttcatctgactaatttgtatatatgttttagcccttaacgttaagccttcagacttggtgtaagtccttctccaaacatgttcccgtgccatgttcccactgtcatatcacttatgacattatattaatataccttggttactcataagtttcctaatcttgacatcaaatatgagaagtatagactcc

SEQ ID NO: 35254 - DNA, 1040 bp, Homo sapiens
tccagaaccatgataaataagtttctgttcattataaattacctagactcaggtattctgttgtagcaggacaaaatggaataagataaccactaaagcttatttttcctcagatatactgtcaaatgaagtactatttttaagatttctacatatataatgccattttccaaagacatatttaggaaaaattctactaatttctaactcttgtattaggatttaagaaacataaaatcatctcagtgtagctacaaagcagtaagtactttgatgaagttaaaacaattaataaaagaaagagaaggctgaactctcagaatgcccttcttttcctattatttcttctttaaaaccagggagctggctcttttacaggaaaaggtaatttaaaaaaatcaaaacaaaactgttattgtctcattcatatggggcttgaacttgcctagaaatggcatatcaggaacacatttatttatatattaagttaaatactcttggatagttaatgccgctttgtattctatgactactttttctgaaaatctaaatagtttactgaatctttcgtgtatgattatggtaaactgtccaaaaggtcaagatgatgaaagaattacctcttattttagatattgtggtaaagctgagattagcagttagatattagatgcacacataaataataaacgtaatgtgtaaatgaaatattgcatgtattgtctttatgagatcttacacatttgtttttaacatttagctcagtagtagttatattcactccataattcatctgagattaggttttaggtgtaagcagtacctcctcctttacttaatatgtgcacaaagttgtttggagagactgtcaggcttaattttctgccaatgaaaaacggtcaagaggttagatatattcaataataatataaaattattagttttaaaaattctataggatatactttatatatttaaggccttacttttaaaaaacatgtttaatgttatttctataagaaccttatagtctttaggat

SEQ ID NO: 35255 - DNA, 1047 bp, Homo sapiens
gagaagtcttccttgtgttgtgatagaaaggatttcactgtttaaaagtaaacttaaaataaaaatgtattcccctctttaaaagaggagcatgtgcctgcttgtcccaggtggctttctataagaatgagaaacagggtagacttatttgataacatcttcagttgtttttcaaattgtttgtatttatacacatacatacataatatttatatatacatacccatacacaaacatcaccccatatatatatacatatatatacacacatacatgtacatatatatgtgtgtgtgtgtgtgtgtagtgtgtgtgtgtgtgtgtgtgtatgtgtgtatatatatgatgtttggccttagaaacaatccccatttcaatgccaattttgaattggttacaaacattacttagacttgattttcgaccaacttggaatgcaaagaaagctttttctttttcttaaattaatgcttcttttttttgacttgtaattgtgatttatgtgtctggattttaaaattatttaaaattagctgaattttgagtcagtgaatttctcttgacattacacttagtatggttttgctctactacctgagttctttttggtaggtgggattgttacctatctaatcttctgtagcagcaaatataggatcatagttaaaaaaaaaaagtcctattgattttgccactttgatgtttccctatcacttccatcccttccattcattctgtcactgccctaattcaggtcctcagttcctcatatcaaatttttgcaagtttctatttagccattttgctttccaatttatctccattctaattcattctaaacattactttcaaaagtatcatttttcaaaaatatagtcttatcacacttttttctgctacagaaccttccgtgtcttctcattgcttttggagtagtttcaaattccttaggaactgcacggttcaatacagcagccactagccatatgcagctatttaaatttaaatataaacaattaaaagtaaataaaagaaattgagttcctc

SEQ ID NO: 35256 - DNA, 1061 bp, Homo sapiens
cagttggtttcttgagcaactgtttttattggagtttatgacttgttttatcatgtgtttaatttgcatatacctaccactccaacactccagaaacactataaatcctgtcagtacaaacacatcaggtaatctcctgggtgtttttttttttccttttttgaatgccagcttctggaacagctgatctctaggtcagctacatagctgctaaccccagacttcctatcaccgacatcccagacattccttttgcctttttcatgtgttcagtcttttgcttatcctctttctattatttcttaattttagcaaacatttcctccagaaacttatgagataggaatcatgggcattacatttttgaaattctacaattatgagaaacattattgaacatggtatttgactgaagatggaattctagtttagaaattagtatttttccaaatgacgaagttgtttcttctaaatcttaggacgttccgattctaaatccagatctgtctaatgtgaactgttgtgcttgttaatctctccagaagattttgtgattatctctttatctttggtattccaaaatttcaaaatggtacatcctgtgtgccactccccataaaaacacaaacaaaaaaatacatttcactgggttgagtactcagcaggcctttgtacattctgaaagataaatatctttcaatctttgaaaatattttgatatcatttatttgatgattttattcttttcttttgttgaattttttttccttaaaatttaaatcagtgctcgaattgtattaccttttattgtctattttccatatctttgtgatttttctgctttctaaaatgtattcttaactggaccgtccaacccttctgtggatatttttatgtctgttattacatgcagtaacttctaagagttatttcttttactctcagtttacttttttaataatctcattgtgctcttatggatacattatcttctattatgtctctggaaaaattaatattttcttttgaattattatccttctatgtttcttctttttcat

SEQ ID NO: 35257 - DNA, 1054 bp, Homo sapiens
tatttaataacctttatgtttccttaacatgctaattgtcttgaagagtgcatgaaaaataacttataattgtacacaggttaaagaaaaaaacgaatagagatcacaatggaaatttagcaaactacatatcctatttatttagctttaactctctagcttttgctatgaggtctatgtgtaacacatctgttttgtagtagaccaaattatttcttatacagaattcacagatatattggaaaccataaaaacctatactttcatttctagtttaaaatgtcatctgtctaagcagcccttgaaacaacctcctccacctttttcactaaagtcattaggtagagacttgaaaagatgaaattgcacaacactatgaactgggactcactgtcaacttattgtcagaatatgagaggaatttccattaaatacaaggccaatgggagtggattaaatatataatcagtatgatgctgctggtgtgcttgcctgctggaaagtagatagatctttatttcttcccttttcctctaatctttggaccagaaacaaaatctgaaccaagaagaacattggatagccatccttctactgactgcatgctaaattttaggcagttacatggtttcccataaccccctccctgaccttgacccctaataatatatctcattctttatccattcagatattatgatttaaacaacaacaacaaaattggattaagggaaggaagggtttatttgatattatttgaattctgataatatgattcccataactagagtactaactgaggagggtgaaatcaaggaaaactctaatagagttattttctgcattaagtaatttgtttaatattctccatctcctaagagcattagacatgtttaatgtggtttcacccacatcaacaggtgaaaacatagtagataaatggcaggaaaatactggaaatcagtctgggaattatgcatactaagatctatagctttatatatttatacatacaagttgtttggatgtgatatctccccttacaacaatggac

SEQ ID NO: 35258 - DNA, 1001 bp, Homo sapiens
tctaggttttctgtctactctgttggcagtttcgtttgctgtacagaagctctttaattagatcacaccagtttttgtttttgttgcaattgttttaggggacttattcataaaattttgccaaattcatgtccagaatcatatttcctaggtgtttctcaagtattttcatagttttagggcttacattaaaatctttagtctatattcagttaacttttctatatggaaaaatttagaggtccagttttatttttctgcatatgactagctgattatctcagcaccattttttggatctgtgtatgaatctacaattatcttaactcttgattaaaaaagaaaactcatacttacctggcaggggagataccatgatcacaaaggtggttttcccaggacgaggcttatccattgcactccagatgtgctgacccctgcgatttccccaaatgtgggaaactcaactgcataatttgtggtagtgggggactgcattcgcgctttcccctgagaaaaaataaagaaaaacgaaaactctcaaataaagttaatataacaaggattaaaatacctaagaaaaactgaatacaagtttttgaaaaaacaccacacaaaagtgtttatatgggctgggagtggtgactcatgcctgtaatcccagcactttgggaggccaaggcgggcagatcatgaggtcaagagaatgagaccatcctggccaacatggtgaaaccccatctctgctaaaatacaaaaattacctgggcctggtggtgagcacctgtattcccagcctcttgggaggctgaggcaggagaattgcttgaagcagggaggcagaggttgcagtgagtgaagattgagacagagcgagactccatctcaaaaaaaaaaatagtgtttatatgtcctggaatgagagagagatggaggagggaaaaaaagatgaaaaaatgggaggaagaaaaggaggaaaggaggaataaaggaaggaaata

SEQ ID NO: 35259 - DNA, 1023 bp, Homo sapiens
cagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaaggtatctggaagtcgtgacacggtgtgtataaaacaaaagtttgcgagctgttaattgctgtgctgtgttattaagagacgctttcaagtttcaagtaccaaatgtagctttacgttgccaaaggaagttgaggcaattgctttgctgttttaacttgctctgtgagggaaatctcataaactgaccaatgcaccaaatgaatgctaaaatgcactttaggtttgtttttgcacttctgatagtatctttcaaccacgatgtactgggcaagaatttgaaatacaggatttatgaggaacagagggttggatcagtaattgcaagactatcagaggatgtggctgatgttttattgaagcttcctaatccttctactgttcgatttcgagccatgcagaggggaaattctcctctacttgtagtaaacgaggataatggggaaatcagcataggggctacaattgaccgtgaacaactgtgccagaaaaacttgaactgttccatagagtttgatgtgatcactctacccacagagcatctgcagcttttccatattgaagttgaagtgctggatattaatgacaattctccccagttttcaagatctctcatacctattgagatatctgagagtgcagcagttgggactcgcattcccctggacagtgcatttgatccagatgttggggaaaattccctccacacatactcgctctctgccaatgatttttttaatatcgaggttcggaccaggactgatggagccaagtatgcagaactcatagtggtcagagagttagatcgggagctgaagtcaagct

SEQ ID NO: 35260 - DNA, 1023 bp, Homo sapiens
gaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaa

SEQ ID NO: 35261 - DNA, 1111 bp, Homo sapiens
gaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagtcagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcga

SEQ ID NO: 35262 - DNA, 1025 bp, Homo sapiens
cttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataa

SEQ ID NO: 35263 - DNA, 1017 bp, Homo sapiens
aagacaacattctcaataacatgttacaagttagagaatgaaaattacattctgattctcctccagattcttctgaggaactgattgtaatctcataggtgcaaaaagaataaaccaattttaaactgatataaagtgtatttttaaacatttatttatatattggtcctactgtttcaaaatattttcacccttctggtccatgaataaaaatccttatttgaatgcaaaatattaatgtattcttgctgagaagccatcatgggaagttacagaagtgacaaataaattaattgagcatgatagaattctaatgaagtaaataattcttgaaagtgctctatgaagtagacagttgtgtgtttttggtattcaacccaaaataattcatattttgctatttttaatgcatttctgatttccatgcatttttaattcatttttatttctttgtagagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactatagatgtctatactgtgaaaagtgttttcaattctgaaaaaaagcatacatcatgattatggcaaagaggagagaaagaaatttattttacattgacattgcattgctt

SEQ ID NO: 35264 - DNA, 1604 bp, Homo sapiens
cacgctcatctcaaacccagcttctgttgcttgaacatgtttgaagtgacttttttgtgttctgtgttccaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcgggtaagaattttaaatactttcaggacattgtgcaacaccatgtagaaaacccataaaggtgtgcatacataatatacttaacatttaaaaatgtaagtggcacaattgatttgagaacattatggcattttaattggaactgctttttggcaggaaggacatttagggtacagccgttgaatccttttggatattagtttgggctgctgtaatcacttcttaggagaaacagctttgttttagatgaaattttatcagtagttctctaatcgacctaatctctctttgaatcctttactaacctaattattttccttctagtttgaatgcagtttagtgattttatatcataatatgtaacttgatgagtgacacgagatttgttggggagttaggcagtggcctgcaaatgccttaaacattatgactgtacgctaccttaaaaggaagggtgactcatgaaggattataataacaagaacaatggagagaacaatagcagcttccacatgtgagtgcacatgtatgacttcatttaattttttttaaattttactttaagttctggaataaacgtgcagaacgtgcaggtttgttacataggtatacatgtgctatggtgggaatgtaaattagttcaaccattgtggaaaaacagtgtggcaattcttcaagaacctagaaccagaaatatcatttgacccagtaatcccattactgggtatatacccaaaggtttataaatcattctactataaagacacatgcacacgtatgtttattgcagcactatttacaatagcaaaaacttagaaccaacccaaatgcccatcaatgatagaatggataaggaaaatgtggcacataaatatgatagaatactatgcagccataaaaaagaatgagttaatatcctttgcagggacatagatgaagctggaagccattattctcagcaaactaacacaggaacagaaaagcaaacagcacatgtcctcactcatgagtgggagtagaacaatgaggacacatggacacagggagaggaacaagactttatttaattcatataatatcctactgaggtaggaaaattattatccccagttaataggctttgaattatagcatgagagaattcaggtcacttgttccaagtcatacagatataaagtagaatagctgaaagtcaaactcaggcagttttatattttaggagaatcaccctgggggttatgaggatggattaagataggttggggctgaagacagaatattgactttggtggttactgcagcaatcctgatgagaattgagggggattctgaagacaggcagtatcagcagggtctg

SEQ ID NO: 35265 - DNA, 1043 bp, Homo sapiens
caagagccaacagaatcacctatgagtgtctgtgtttcctgggtgtggatagccaagagctcaccggagagcatttgcagagctttctgtaaatcttccaattgggcctcttttactgttcattatcggttatttactaatcatctcaatctttgagtctttcaattttgagtcattgagtaacctttcttttactctttgaagacatactatcttctctcaaatgcaaaaggaactaaaaacacaacacaacattcatatagaattccacttgaataaagtataatggccatatcactctcatactgttactggtgtgtaaatggattatgacaacagaatatagaaaagagattagtcaaatccaagttttaactatgatgataatttatcggtataaataattatttgaaaaaggtcgtaatgcatagtgaggtttttgttgttaatcatctgtgttttcactgaattcaccaagcttgcttccctttcccccctcagcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtaacctcagcaatcttgatgggtttacataaatctctctcctaatacctagtcctccctttgtcataacttgctgatggggaggttgggctgggggcagcatctgtggaataaaaatgtttaactcttgcaggcagtgctttcctgttggatttattttaagttggaaaaaaaacagtggatccaattttttatgtgatgggcttgaactttgtatgtcaaatttttgaaaaatgactgtatgaatgaatgtttggtatgttgatttttcatgaatgtgttcaatgacctgatatactcaaagtatgggctacttctgtctgtctttatgctagagttgtggacagccatggtgaggaggagtaagggagatactttgttaatgccaattc

SEQ ID NO: 35266 - DNA, 1044 bp, Homo sapiens
gtattggtaacgtggaatcaaattattagggtcagtaacttcctggctttcccagtgcattaaatgaagacataatattgcatttgtgtcgggtacttcttgatgccacataatgtcagcactgtccggtcgtccgtacttcacagcatgtcacctctaatttcatgggattatctgcgctgttgcattattagatactcacgatcttgagcttcctttgaactcacagcagggcagtgcaaagtcattattgtgaacacttctgtgctttcttgtcttatatacaaaattatggccacatttagaaaggtagatatatcccactatcatacttccaaaagtgtgcgtttatttggtgggaatgaaagctattgatggaaaaaacattgaatgtgaaaagtgttttaaaggactagtgttagaaaggtgtcaaggcagtgaattagtattagaaatgtttataggacagtggttctcaaagtgtggcctgatcagcagcctcagaatcacctaggaacatataaggaatgcagatcctactgaattggaaactgtggggtggagctcagcagtctgtgttttaacaagccctgcaggtgattctgatgcatctcaagtatgagaaacactgctgtagcatttacggagtacatgaatgacataaatccatatgttctggggtatagcaatagacaagacagacgaagtatctgcccccatggaccttattaagttacaaaggaatatgtggttttttgccctgatgaaatgtttatacatacccaacagagcctataattattgtagataccattatattcttcatttgaattagcctgttattttcttcggtatcagagaatggctaacaaaagataatgaataagtgattcctttgtgcatttcagaaccattccccttgcaatatgtatatccatggccattgtcaccattggctatgtgctgacaaatgtggcctactttacgaccattaatgctgaggagctgctgctttcaaatgcagtggcagtggtaagtccaagt

SEQ ID NO: 35267 - DNA, 1044 bp, Homo sapiens
tctatataaagatatagtccatgtatatggctgagtcttttatagtccaaaatttatttttctgtgtactatggtttattaacttgacttatttttcttctttcagatttaaaaaatgttaactaattaaagtaacttcccaagtacctaccaatgacattaatcttcctctttttgtcttttgttctttttacccccaaatcctattaatacagcaactttttaatatgattttctacttttcagaatacttcttaacaacatagcaaatgccaaaatgttaatggaagtattaatgaaaacatgcaaaaaatatttctttatgattctgataattatcgaaattgccttagattaaacatgaataaatttaattattatatatgtattcaaatagttggatatataatcctgagaaagaatccttcactacatatgttataaaaatggtaatgaacacattacctaagaagtctgcactagaaataataagataccttttcattcttgacatctttcttctttttgaaccaagtatctgtagaaaaatatttgaatcaaattttaatgaaattcttattagaggtttgctacttttctcacaaaatggcaatattgccaggcacggtggctcacgcctgtaatcctagcactttgggaggccaaggtgggcgtatcaccagaggtcaagagcttgagaccagcctggccaacatggtgaaaccctgtctctactaaaaatacaaaaataagctgagtgtggtggcagttgcctgtaatcccagctactcgggaggctgaagcagaagaattgcctgaacccaggaggtgaaggttgcagtgagccgagattgtgccattgcactcccgcccgggtgacaagagtgaggctctgtctaaaaaataataataaaataaaataataaaaattaaattaaattaaattaaaaaaaggcaacatcaatgtaagcctatttcataacaagtctttttttccccatggtgcttcatcctcacttggtatattctaaatatgcatacaca

SEQ ID NO: 35268 - DNA, 1030 bp, Homo sapiens
caagggagaaatcttcagtttgaatacataggtgcttttcaaaccattgagtttatgatgcaagtctgtgactaggcagggcaggtatttcctgttctctaaaagatagtgctagttctgctctattgctgccatttctatagcaatacctgggtggaattccctccctgcttaaccctgcctcctccactccctgcctctgatctatgcgcacttagaaacacaggatatcctgattatcctgtttcagtatttctcataatggacacatattgtttattctatttttaaatgacgggaacacaaatctctacccagtagttgtggtcgatgatccatttagtcaaatgaagaaaggaaaatttatatgtattctgtaccttattggaagtcaaagtaaaactttatgattgtggtaagtattttcagtaacagtatatagcatttcctcctttcttttaataataatagataaacaaatttaaaatgccaaaaaaatatgatgaaattaaaaatcacctgtaatatcttaatcacatcaaataaaagtactcactgttattattttgatattttgtttcccccacagtttgtgcgtgcgtgtgcatatatgtagtgcattatattgcttgagataaatgtaaatgtgcatttttcttcctaactttggtgttatataatgtatttacttgtttgtttattgtctgattcccaaggccagggctttgtctgtatcattactgctgtatccctgacagctggaaggttcttccaagtgtgccctgccatttagatttgctgcatctcaagctcaactccagctctttctacttatgtgctatagatctgtctcaccgtcttcatttcatgtcattttattatattttcgtatatcacctagatgttagttaagaacatttttaatgctagtataatatttctttgtggggatgtgccaatattcttgtgctcattttcttgttggacattgaaaacattcctaatgtttcttaatgtattaggttggtgc

SEQ ID NO: 35269 - DNA, 1030 bp, Homo sapiens
gctcactgcaactccacctcccaggttcaagtgattctcatgcctcagcctcccaagtagctggaattacaagcatgtgccactatgcccagctaatttttgtatttttagtagaaatggggtttcaccatgttgatcaggctgttcttgaactcctgatctcaagtgatccacctgcctcagcctcccaaagtgctgggattacaggtgtgagccaccacacctagccaagaatgcatctttccatgagagacaaatattcctctttatatgcatttagttttctaacttaatagtcgctagaaaataacatataatattgtaactgtatatgtgcagattacagcaatattgtattttgtaatctttttattacaagtcaatgttatctacattcttagacaacattaaatattactttaaagaatatttccaaagtttctactacaaatactcaagttatatgtttttaagatatgtattaatttatttacaagtttataaagatattccctgtggcaaaatgaggcatctttttactaatgacaatatgacatcattagaattatcttaaaatgtgacactgcttttcttcaattgttgaaataattgatacctaaattagaatccctctgggggttttttttttttttttgcttttctttagaaaatatacataaagcttgattaatccatttttaaatatgtttcacagtagaaatagaattgtgctagttgagccactgaggcagacaaaagatcggtatttggccagatgtcacagagaagagatgattctgtgttcaaagaacaaggtcaccaaattgctcttccttgcttttgttcactctaaaaatttcgcactaatagaacatgtggttgatgtaccttgggatcaaaattcttgcatttctcggcatcacatatgcataaaaaatacattttgcccaaagatagtttgttcatataaggctgaagtgtcaaataagtggtgcagaaattataggattatattataatattttatcat

SEQ ID NO: 35270 - DNA, 1047 bp, Homo sapiens
aaatgaatcatctgctgaaaatacaacaccctttatggtcttcctccacctagacaataaaattttcctaaatttgtgacctaatagaaagatgataattaatttagattagtgaaaataccaatgtgtattaaaatatatagaattcagagtaagtttccatgatctcaattgactacactttaggtgtaatttcattttgagacatctttcaaattatctaccattactccaagaaataacttttgagctgctattataagtaggtggtataggacagttccttaagtgttgtatcgaatgagagacaaaggtgggcaaaatttctgtttgtgtgattacatttataatgttaagaaattttgccatgatctttcttacaatgttttcttctccaagaatagctttgaatttatggaagtagcaatctttcaaatacaacaattgctattgaacttttataataagagtattgcctttaccaattatctataacattatggctgactccacaaattaatatattggagtaaggattgtattttgagggacatgaatgtccaaagtttggaccatgaagatgatagaatcccaaggaataactgaattttaaaaggctttccccccaaaaatggcatatatatagtagtaataattgctactgtgtacatttgttttaaaaaatcctagtgcttgtgcaagtgtaatgaattttgccttatgacatgacttttgtggtgactatgcaatctgtcattgttcaaaaagttacacagtgcaaagaacatatcattgagatgtataatgtttgtaatcctgctcttagattgataaatcatatcttgtgttgatgaaagccaagaaatgaattgcttttctttgaccttgggggtctgagattagccactttgtctattagccttattccagtgttcttctcacttcatttattccttctgttttgaagagctggaaatagtagacttagaggaagtcagtaaaccttgatatcatcagtcatttttgaaaaacaggctatcaacacgc

SEQ ID NO: 35271 - DNA, 1047 bp, Homo sapiens
cgcaaagtgctgggattacaggcatgagccatcgcgcccgacctgtaattactttcttcaccttctgtagaagttcatgaattttcactgcttttatagattcaataagcattgaagtatgctcaatatttaaaatatttatctgttctgtattcctgaaattggaccctatataattatacacttgaatgtcagaatattataataaaaatattctccttaagatacgagatctagtcccagatccatccctaacaccatcaattgttggatgtcaatttccttgctagtttattttatctatataaaataaagatgagttaagaaccccatcctaattctcaaacttttgaaagtaattgggaggaacaagcaaaaataacatttgtgattgtattgtgaaaaaaattacccagttctgcaaacgtattactttatattctttttgaaatctatattttcctggcaccattaaattacataaaagaaaatctaggactatttctgtgttaacacttcaaatacagcatatgaagtggctctgtttaaatctttgaaatctggctatacctacttcttttctaccataagtaacttagcaacacaaccaattcttaggtaaataaacatagtattaaaatatacaagtactgcagaacaactatcacatactttaggaggatgacatgcaaaatgtggaaacaaagggtcctgtagctaacataaatgtgaacttttgcagagagaaagagccatcaagagtttaaaagaactaggtacaccaaggggatcatgtatgtcttttgaactacttcctcattgttgcctgggaactaatggtaaaagtgtgggctccagagttagattacctgggctccagacccatcttcactgttactacctatgcaaacatgcgcaagttaaacaatatcttgagtctcagctgctcatctgaaaaataaagccaataaaatgactatgtcatagagatatgaggattaaataacattattcatgtaaagtctttgtacaatgtctgccataaaa

SEQ ID NO: 35272 - DNA, 1109 bp, Homo sapiens
caccacgcccggcgtataaagccatttctacagaggcagaataaaggagtttccaggttccagctttctactaggacagttaatttaagtactaccgttaaaactagcctctgattaacaatgaaaactcatccttttaaggaagaaatactttgatcttgatggcctcttctaacctaggatttgtctttgtaatttataaaaccagtcttaaaaaaagagcaaggcttaacaaaatctacattcctttttctatatatcttaagaacctcaagactaggctgggcatggtggctcacacctgtaatcccagtactttgggaggctgaggcaggtggatcacttgaggtcaggagttcgagaccagcctggccaacatggagaaaccctgcctctaccaaaaacataaaaaattagccgggtgtggtggtgtgcgcctgtaatcccagctactcaggaggctgaggcaggcgaattgcttgaaccagggagatggtggttgcagtgagctgaggtgactctattgagctccagcctgggtgacacagcgagactcaaaaaaaaaaaaaaaaaaaagatcttaaagactagtttgtaaaaagtgaaatgttagaaagcccatgttaatgttaatcctgggtgagagattaggtaatagcaggctgcttgctacgctggtcatctcatctatacagatccctctgttggggaaagtaatggctagattctttcccatttctcctagatgttaagtgtaaatcaaggcttgggctttctgtagtagaactctgaacttcactgagtggtatactctataatcttgtatcaattgctggatttcttaaaatccagaaaaggggctgaggccagaagggcttagagtaagctgattttgttcagctaacttccatccagggcactaccttctcatgagttgcccacatttcctgggatcctagaaagacaaagaacaaggaaaaatgcaggaagcaccagttactttgtcttcccgagttaatttttagtgttttgctttttataattcattaaggagaacagagcataatcttcaactaattagcattatgtggcagttcacttgaaagcag

SEQ ID NO: 35273 - DNA, 1025 bp, Homo sapiens
tgcagcctgggtgacagagcaataccgtatctcaaaagaaaagaaaaaagcaacctattaagatttatatactactaaaaaattattagaaggctcacatatgactttaaaaaaattttctttttcagttcctgataatgcatcagtgaaggatccaatctcctgcagtgataactagaaaggataactcgagagtttcactggattttttccagtccccttaactcatagtaacataccaatcatatgttggtgtttccaaaactgatttcgtctggtggcatgcccatgcacccatatgcccaccctcaactcataccctgttaattttgttggtagacaacacttgaaactcagacattattttggccttcattcttatccagatttatttatttaaggctgccatggtttctcttccggttgaagtattttggggtaggtaaacaatgtacctgcaataatgagtattctaatcagtattgttctcaacaacatatgactagcaattagtcatgctaaaatctgaaccaattctacatttggtagatgttcccgtgcttgtcattctttccagtagccccaaaattctgtgcatactatgttacttctgaaaacctcatttgttttaaaagtggttctattaaagaatgagtgatccatttcagtggacgttgttgcagctacagatctatgtacgttcacttttacagtgaaggctccatgtgtgaatggatatatgtgggtcattatgataaaacagtattaaaggagaaaatctactcccagattctttttggactacaaagacattaaaagcactaggtttaaaagaccatttattaatcttatgtatttacaactcacaaattaaaatatctattaccaataagttattttgtttggaagaggctttacctgtaatttttacttttatttctgatggaagagaattccaggtttttttgagatggagtttcactcttgttgcccaggctagagcgcaatggtgcagtctgggttca

SEQ ID NO: 35274 - DNA, 1248 bp, Homo sapiens
tgtgaaagagtggagtgactactcatgatccttgccttacccagaggattaacatttttcctttaagttgattttccatgcatttattttccttatgtagtttaaatcatatcgaatattcagcaaattaacttcttcagtattaagctcttatcctgctttgattaattcttaacacacctcgcctcttctaaatattgaactgtccacataagaaacattgatgggggtgggaaattttaatttttcaacttttttttatagtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggtagagtatatttatacatttctgagaaggcaggtgaaaatttttctcttatctttttcctcatcaagggacatagaaagtagtatatgctgtagatttaagattgatgttatcttaaccagatattctcaaagaatcaacattgagattttaaatttagtattttaacgtactcatactgtttaaaggagttagtatgtaaggcttgaggataattgcctgacaatgatatttaacaggtgttcgacacacagaaggcagatcagagattccctgcaccttgtcttactccatcttctccttgttgatccttttatgggtacttggttacttaaaaaaacacacacacacacgcacaacattttattctttattttacaaagtcttgtcttcccttgctttcatggatattttttaaaaagccaggcacgcctttagtcccagctgctcaggaggtgagaggatttcgtgagcgcaggagtttgaggccaacctgggcaacatagcaagaccctatctcaaaaaacctaaataaacagtgatatatatatgatatatatcatattcatatatagtcatactaaatatatatatcatttatatcatactatatacaatattcacatttattatatatcatgctatttttaccttataccttctgctttgaaacactaagattgctgatagagacttctgattgacctaaactcaccagtgggtaaagagcatttccacttactatttgacttctgctgaaatttctgctccccccatcccactaccacattttcaacatcatgaggaaat

SEQ ID NO: 35275 - DNA, 1020 bp, Homo sapiens
tcttccatttaatgctctctgaactgtagattgagtgttctaaaatctgaaactgagcactgatgtgacactcgaagtgctcattaaagcattttggatttttagatttgggatgttccactggaaatatatagtgcagatatatatttttttaaattcgaaatctgaaacacttctggtcctaagcattttggataaggcatgcccaacctatagtagtataagcttcatgaggccagaaatctgttcacacttgtgtcaggtttatagcacagggtctgggcacatggtaaatgtcagcaacgatttgtcagttgtacgtagagtattagatcttctggctgataacttcataggtaatttatgcatattttatgttgtcatcgtaaatttaaagtatgaatgagtaaattttctaagtatgtattttactctgtaaatataaaatatttctgagatataatatgttgaattttaggggggaaggggaagttgaggtcagaaatatgtgcaagaattacaccttgaagaagtaatttccattgacataacaattttaataacacaaaatcatggttttgaaaatgtgcctcaaactatgtaagaattcagggcacgtaatatgtaactgttaggcaaatttcattttgtttataacttgaaacattaaaaaaactggtaaaattctcttgctgtattattattgaatacttgaagctctgattttaatatggtaaagttttagggtgtgtcttaatacaattacataaggaattagtttgcccaggatagtttattaatagcacctaagacaagagctaaattgcaacacaagcagactttaaagagaatgcttgctagaataaattttaaaaactggagaattgaaggttttttttttttcttagtgtatgtgagtattgtagggaggcactttgaaaacaataattgagaatgataatatgtcttatacttaataatgctaagttttcttaaagttgagctacacaggctgattga

SEQ ID NO: 35276 - DNA, 1049 bp, Homo sapiens
tgtcaccttgttattttaaatttgtaatgccagatctttttgtttattcagcaaatacttattgagcacttactctgtaggaggcactgttcctttatgtaagttttgtgtgcagacaactttagcataaccctttgtttcaaacaatttatgtattattaaattctgaaaccagggaagcattttaatgaagcgttattcgtcattatattggtttgatttcctgtgttcagtaaatttatagtcattaaattggcgatttatctcccttgtccattgtattttaatatgtatttgtaattaggttagttttcagcaagaattacttttttttgaagtaaatgacaatataaatttgtttccaagtgagccaaacagaaatgaaagggtacatgaatttcatgattagcatattgggggagtctcatctccagaggttggtgtgttctgtttactaaatacccgtttaatgtgctctttgacacttctgttaagggaaaaggacgaagttggtctcagaaagtagttggaaactccttattttccaagtaatgctttcagaatatgttctaggtatgactttgttggtgttcctgtcttaaaagtgcagatgtttcaagtgaactggttacatgttgcataaggtttgaaaaagccaaaagaagttaaatagccacctttatttacagctgcaggactaggtattagattgcttccaggaagaaaatatgattaatggctcttttccagaggggggacaattgcagacttttcttccgcagagcgtgaaatgtgcctcttcctgccgaggggctgtgtcctcgcgcggctcccggagccgtttcccagcctcaggtgtctctcgccgcaggctgcggccgctctctggagcaagcgtccgggacttcctgtttgggcgcggggcggaaggatcgcgttgccagctgcggcggccgccacagccacagccgccgccgccgccgccgccgcccctgcccctgccgcccctgcccctgccgttaggtggtggggtttctcagcccggcggc

SEQ ID NO: 35277 - DNA, 1061 bp, Homo sapiens
agaaattggttaatctaaatattccttttggaattaaatgagatttgactagtatattttcagttaaaatttttattgtaattttttttttttttttttttttagacagagtcttgttctgctcccaggctggagtgcagtggcgtgatctcagctcactgcaaccttcctctcctgggttgaaatgattctcctgcctcagtctcccaagtagctgggactacaggcatgcgccaccacacccagctaatttttgtatttttagtagagacgggctgtcaccaccttggccaggctggtctcaaattcccaacctcaggtgatccacccacctaggctccccaaagtgctgggattacaggcgtgagccactgtgaccagcctaaaatttttcataaacacgctaaacaagaattatatatgggtccttgtaaagtttcacaagaattgcaaattttttttcccagtgtattcaagatactacatattctttgatgataataaacaactcaaacccttgaaatgagttgtcataaatgtcgtttaaactatagagatcattaactattctaactcatgtacatttgggtgcttaatagatgctattttaaaaagttgtttgtggcctggcgtggtgactcacgcctgtaattccagcattttgggaggccggggagggcggatcacgaggtcaggatatcgagaccatcctggctaacacggtcaaaccccatctctactaaaaatacaaaaaattagccgggcgtggaggcgggcgcctgtagtcccagctactcgggaggctgaggcaggagaatggcatgaacccgggaggcggagcttgcagtgagccgagatcgcgccactgtactccagcctgggcaacagagcgagactctgtctcaaaacaaaaacaaaaacaaaaacaaaaaaacgtgtttgtctaacacccattagaagagactagctgcagggctgggcacagcagatcatgcctgtaatcccaacactttgggatgccaaggacggaggattgcttgaggcaaggagttgatgaccag

SEQ ID NO: 35278 - DNA, 1033 bp, Homo sapiens
gaccatcctggctaacatggtgaaaacctgtctctactagaagtacaaaaaattagccgggcatggtggcgggcatctgtagtcccagctacttgggaggctgaggcaggagaatggcgtgaacccggaaggtggagcttgcagtgagcccagattgcgccactgcactccagcctgggcgacagagtgagactccatctcaaaacaaaacaaaacaaaacaaaacaaaacaaaacaaaccatatactataagggaaaacattaatttgactacatcaaaactggatgtttttcccagcactttgggaggcaggcggatcacttgaggctgggagtttgagaccagcctggccaacgtggcaaaatcccagctccactaaaaatacaaaaattaactgggtatggtggcatgtgcttgtaatcccagctactcgggtggcagaggcacgagaatcgtttgagcctgggaggcggaggttgcattgagccaagatgataccactatactcccgcatggatgacagagccagaccctgtctcaagaataaaaaaggcaaacagcaggctggcagaagatacttgcaagataaatctgaattgttatttagaatatattaacattctatagatcaataagacaaaaaatgcctttatagaaaaatggccaaggacatgaatagtctattcacaggggaaatgttaatggccagtaagtatttgaaaaaatatttatccttaatacttaaatacatgcatattaatacaacaatgaaaaattttttgttactcaacacatggcagaaatttaaaaagtcagcttatatcttgaattgacaagcatgtgagaaaaatcgtaactctgccaaaccactggacttgcatagccactttggacagaattacatcaaattaaaattgtactgataagctgggtgtggtggtgtgtgcctatagtcttagctactcaggagacaaatgggaggatatcttgagaccaggagttcaagactaccttgggcaagatggctggacc

SEQ ID NO: 35279 - DNA, 1041 bp, Homo sapiens
aattttattttattttgagacagggtctctctttgtcacccaggctggagtgcagtggtatgatcatggctcactggagccttgactgtcccggctgtagtgctcctcccaccttagcctccctagtagctgggactacaggcaaatgccacgacactcagctaacttttttattatttgcagagacaagatctcagtatgttgcccaggctggtctcatactactgggctcaagcaattctcccaccttggcctcccacagtgctgggattataggcatgagctaccttgcctagatgaaaaggaatgattttagatgatgtttgtataccaagaaacatctgttttatgtaaaaggaaagaaaagtatatctagacgatagatcattaaaagatatttgtttgactttggaaactagtagccattcattcctttgtattcagagagacttaaaaaattttttttatttatcttttttgatacggagtcttgttccgtcactcaggctggagtgcagtggtgcaattctggctccctgaaacttccgcctcctggttcaagtgattcagagagactttttaaagaaacactagttaacttttaattttgctatacatctccgagaaacacccaagaatgatcaataaatactaaaaaaattaaaaaaaaatttttgctatacaacagtgtatctaaataatacagttttattaattcagactgaggagaaggctaactgtggattatatagaattttaaatgagtagcaaacaaggttacaagtgttgccaagtagagatagtttttaagattttcttagatgtacaaatacgaatgctttaacacatatccctaggcaaatccatacctccattcagccatctgtcagtgcttactgaggacctgcaatgtcccagcctcagagctgaatatcttgtggtaaacaagaccctctctttgccctcaccaggctttcagctatgtgtagaagatgaacaatttattaaacatgttattatgataaaatgtgatgagaatta

SEQ ID NO: 35280 - DNA, 1031 bp, Homo sapiens
tgctgagcatgctcctaaattgtgtgtgtgtgtgtgtgtgtgtgtgtgtgtgtgtgagactgaagtctcgctctgttgccaggctggagtgcagtggcgcgatctcagctcactgcaacctcccgggttcaagcgattctcctgcctcagcctcctgagtaactgagattacaggcgcgcaccaccacacctggctaatttttgtatttttagtagagatggggtttcaccatgttggccagaatggtctcgatctcctgacctcatgatctgcctgccttggcctcccaaagtgctgggattacaggcgtgagcaaccatgccccggcctctaaattctttgatgtcttttaagagaggacatttaagtaaaaaaatcatataaccatattgtttaaaattatacaaaataaccataaggtatcaaattatggagtatatagaaaaagaaaatctattttaatatgacatatttacttcaatagagtgttatcctaattgaatatcacttaattagtataactttgagatctaaaaagaaaatgaaatgaagcttctgctttttaagctgtcatttaaaaacaggatcctttaagggctcgttaaaatagcacgatttttagtgcacttgaatatatgttttacagattattaattatgtgaaggagaaaatagtggccaaaagcaaagacctactctgtcaattaataaagcagaaatgaaaaggaatgattttatttacttttaatttttttttttttttgagacatggtctttctctgttgtccaggctggagtgtagtggcgcagtcttggctcactgcaacctctgcctcccgggttcaagcgattctcctgcctcagcatcctgagtagctgggattacaggtgcccaccaccaggcctggctgatttttgtatttttagtagagacgggctttcaccatgttggccaggctggtctcaaactcctgacatcaagtgactcgatctgtcctccttggtctcccaaggtactgggattacaggca

SEQ ID NO: 35281 - DNA, 1885 bp, Homo sapiens
atcgtaaaatattatataatacaagcagactgattaatctttgctaattttaataaacattggctgtcaagtggtctggttggtagcttcctacttctgtcttctgaccactggggacaggactttgctccttaaccacgtatcaagacattaacatttagtcttattagttaattatcaagaaaacttaaaccatttttagtgatcaacaaaattgtgtttaaacattagttgaaaagatggatgatgatgagaatttttatataattcaacgagaaagcagtgctttttaaaaataaaaatgaaagtttaggtttttaaaatgcagtttaaaaaataaaaccagatttccttcatgaaaaataagataaggagccaaatttctttcttgaagaatctcaggactaatttgacttcatgatgagctgtcataacttttgtatttgttataccatcagaaatcctccctgtggcacaaaaggactcctttaattagaaaatattgttgccacagggaggtagaagatcgacatgaaaaactggggatctgaaaacgagcccctatcctaggattacctgaaggtgaaacagattgagccagaaggaagacaatgctggtaggttggtttttaatttattaagaatgtttgtaattttatatttcattaaaattatttcatctacctttaccatatttttgtttaaagggtgacaatgattcctccttaaggaaggagaagtaatacgataatatttttcctccaagatagtttgctgaattatcccttgccatattcttaatatttgtttctttttatagataaagctctggggctatttcatgcctctacttccttggaagctactattgactgaacgtctttaagtcattttttttttttgtcatttctgttggttttgcttctaatctacatcttttcctaaatttttaataagtgtttttttcccccaattatttattttcttgaggttagcctagccctaagttttctaaaatggtaaaatgtgaatcttaagttcatttagcttttactctagaattgtttgaattgtaattgtactgtgatttagatcagacagtattattagataaaagattttaatactttaataactatcagccaggtatagtggctcaagcctgtaatcccagcactttgggaagccgaggtcaggagtccaagaccagcctggccaacttggcaaaaccccatctgtactaaaaaatacaagaaattagccaggcgtggtggtggacgcctgtaatcccagcaactggggaggctgaggcaagagaatcgcttgaacccaggaggtggaggttgcagtgaactgagatggcgccactgcactccagcctggacaacagacagactccgtctcaaaaaacaaaacaaaacaaaacaaaaacaacaacaaaaaactattccatttagcctgagatgctatcaatggtaagaaacattatttttataccactaaaggaaaaaatgctgccaaatataaacttttaagagactatcaactttaagataggtactgatttcagagatgtcaaatgtgaaaaaatgtgtatcttgggattaatgaaatatgatttgcaattatgaatctttcctgaaactctcatttactgggaattaaacattaaaatatgaggcctgtgaaaaatggaggtgagttgtggtatagaaatccatgtcagggggcgcggccaggccaggcccgggggctccgcatgctgcagctgccctcgggcacccccgccgctgccctcgccgcggcgagctaaccccagccagccgggggcgtcccggaggcggtggcgcagggaggggcccgatgcgcgcacgtggccccggcg

SEQ ID NO: 35282 - DNA, 1051 bp, Homo sapiens
ggccgagtgcagtggctcatgcctgtaatcccagcactttgggaggccaaggcaggcggatcacttaaggtcagaagttcgagagcagcctgcccaatgtggtgaaaccccatctctactaaaaatacaaaaattagctgggtgtggtggtgcacgcctgtaatcccagctactcaggaggctgaggcaagagaattgcctgaaccgggaggtggaggttgcagtgagctgagatcatgccactgcactccagcctgggcaacagaaactccatctcaaaaacaaacaatcagataaacaaaaaagatgcacaaatgtgtagtcaagatcccatcacaaaagagatggcatgctaaaattaggataatttaaggaatgttttaataaagggctagttacaaacatgtaggcaaatataaggtacccgtaagagacagggcagtactgcagacctagcaataattgctgtttctgtcctttggctcatgggccaaggggaaggaagggtgaccagaatcctgaagaatagagccctgaacagggagtcaccttgggagattctgaaacctttgatcaaaggacacagctagctggagggcaatacctcttcccaataatatcctgctaaggtacgccattgaccaaactcagtctgaagccataggaatcccgttgatgaagtcagtctccagggacagagagcaaggtgaagaagggtggagaataaatctggaggggcaaatggaagatatctagtacaactaaagcttagtaaagaaaggtcagggagaaactgatttgggaatcatcctcatttaaagccgtggaaataaatttccgaggggaaacgtatttcatagatttttcccaaggaaggagatacgtaaattctatatttgtctctctgtgatggagaacaaaggacatagaattaaggaattaaccttagagaatgtttacattttaaagagtggagaagaatcaaagagtagtcaaatatgatagaaaatcctgggcgactatttctgagttttgttttgttttgtttttt

SEQ ID NO: 35283 - DNA, 1031 bp, Homo sapiens
gatgtatttcttcttatgaggtccagtagtaccccttagggctactagcctcttccagcataaaactgttcttcctctaattttattttttgtggagctaagggattgaaagttaccttgcttttcagagcactgatgattgcagtgctagcaaacctcaggtataatggaaaattcatttatcaaaataggcagccaagctgggtgtggtggtgtgcatctgtactcccagctacttgggagactggggcaggtggctcgctcaaggtcaggagctcaagttcagcctgggcaacatagcaagaccccatttctaaacaaataaacaaaaaaccaggcatccaaggacttcatatgggcttcgtgactgtagtctggagtggtatctgatttacagtatatagtgcatatctttttatgagagtttggagaattttccagtctgaagctagaagtatagtggcagagttgaattttcttcttgaggaaaaggataggtagaacagttaaaagtattttgtaggatgatgttttggattatatattgtaactgattttattacaagagcataactaaacagaacactaatagcagaagaaaaaagtatggtagcttaagttgaatggaaaaaagtagaacctgtttgaaatttctggatggtgttttggtcaaaaaataaggaaaactatgattttgatagcaagttggaaactttaaaaaagataaaaactatagcaccaaatttgcataagttagtaaattaggatgtttatcacattaaaataccagagcagattggttgaatcttattattggtataattgactgtaaatgttttattaatttagattaattcaagtaaaaccaattcagaataggaagcgaatgtaatctacttaagggattttattttcttagtcttcttgaactctgagggtaatgatatcatttgctgggcagagatattagtgattgtgaaaaggaggatatgggaagtctaggtaaaataagttacttttgtgatttgttt

SEQ ID NO: 35284 - DNA, 1052 bp, Homo sapiens
aggattttgttgttcttacctcttcttgtttgttgctctcacctcttgtccttgtgggtttaggtataaaagagtcttttactgttgttttagtcagctttcataattaagtgaaattatatgcatgtttttaatctgccaacttaatcctaaagcacagattatttaaaatgtttaatctatgtcttacctcttgagacttgaaaggattattaaagttagcccttttcatctcttgttttggcttttacattcatatttataatatttgaaactcattatgtggactgctcgagactgtattagttcaaggatttataagtgaattcagaatttgtaaatacaaaggttgattgttctttaaatttgctcttataggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtagacatctcataaaatgttcattatttataactttctcattttgtaagcttcaacaatactattgccagatgaaaaatatactgaaaaacctttttaatgctatttagtatagcttggaaaccagtgaaacatctatgtttaagggaatttgtgtagatataaaacttctattgtataattctatgaggtgtaacagtctcatatcatggactctatgcacaaaattacagcttcacataatgataaagttattttattattttttttctgagagtataaatcctagctgttatttatacaagtcaataggctagtattatgaggacagctttttaaattaaaaaaaatggtattctatcattgtctaattgattatgagtttctttgagttaatattgatggagcaataagatttcttttcattaatatcagaagcatcattgtagtgttctatcagtttcctctttgctttttgtcgtcttagagatcttagtatttcagtcta

SEQ ID NO: 35285 - DNA, 1029 bp, Homo sapiens
aatgaagaagaacaggttgcttccttgatgtggtgctgtcccccttgccctaggagtaggagtccctgagagccagactactgtgagtactgctgctcctctgggtctagctgcccagtggggttaccacattccaggctgattctggggaatgtctgcaagggatccagtgatgttatctgtcctcaagtctcccagcaatgtgtaccagcaccagctctcataggggtaacaggggaatgacatacgttgtgagattccttggttgtaaatagccgtagtgcgttggctttcttaaatgctggttgtagtattaataaactggtcatgtggacagactcaggacatcctggttagccagggtactgcagacagtgctgataactgggtcatgcataagttttctccttcttgggtgcaatgttattttacctgtagttgctgtagtaaactgtgtctgttggcctccagccaggaggtggtgcttgcaaaagagtgccagctgtggttgaagtggtgggatatgtgcttgtcttatgttacccatgggaggtattttggtttatcagatgatgggtgaggccatagggctccccaaagtttctgtcttttgtgttaacctaccagggcaggtggagggtcaaagccaggtggggggcttggtcaggcaggcctgctctttggctctgcatgtgtggtgtaagcacagatccatgttgggcttttggagccattccctggccactggggtaatgttccaggaaaaagcttagctgcctctgcttcacagaagagttcatgcagggagtggggagtagcaggtgggagtaagtctcatccagctcctacacacttggcaaggcaagtctctcactcagagtgttcactagcagcagctagctaaattccaagctgtttacatacaggaacctcagctttcaggccacgccccttttcatccactggcaatgccagagcacccaacttctgtgtctgtggttacagcttacttcccagtcatccgcccag

SEQ ID NO: 35286 - DNA, 1026 bp, Homo sapiens
gggaggctgaggcaagagaatggcttgaagccaggggaaggaggttgccgtgagccgagatcgcgccactgctctccagcctaggcgacagagtgagacactgtcttaacaaaaaaaaatctccatactgttttgcatagaggttgcactaatttacatttccactagcagtgcataagtgttcccttttcaccaagtccatgccaatatctattgtcttttgtcttaataatggccattcttgcaggagtaagatggtgtgtcattgtggttttaatttgcatttccctgaatgattagtgatattgagcactttttcatttatgtgttggccagttgtatatcttcttttgagaaatgtttgttcatgtcattttcccactttttcatgagattattttttttcttgctgatttgtttgagctccctgtggattctggacgttggtcctttgttggatgcatagttggcgaatattttctcccattctgtgggttgtctctttactctgatgatgatgctgattattattttttgctgtacagaagccttttagtttaattaggtcccatttatttatttttgttttagttgcatttgcttttggggtcttagtcatgaattctttgcctaggccaatgtccagaagaatttttttctaggttatcttctaggacttttatggttttaggtcttatatttaaatctttgatctatcttgagttgatgtttgtataagatgagagacagggatccagtttcatttttctacttgtggctagccagttttctcagcaccatttattaaataaatagggtgtcctttccccaatttatgtttttcatgctttgttgaagagagttggttgtggatatttggttttatttctggattctttaatctgttccattggtcaatgtgtctatttttataccagtaccatgctgttttgttaactatagcctggtataatttgaagtccaataatgtgatgccttcagatttgttgtttttgtttaggattg

SEQ ID NO: 35287 - DNA, 1071 bp, Homo sapiens
gtttagatacacaaatactttccattgtgttagagttgtctatagtattcagtatagtaacatgctgtacaggtttggagactgggagcaataagccatattgtgtagcctaggtgtgtaggcaggctacaccatctatgtctgtgtaagtacgctctataaggtttgcacaatgacaaaatccttatgtccaaaattgcctaaggacctaaggatgcctttcttaggatatatttctgccattaagcaatgcatcactgtatgtgtatagtacataagaatatatgtgtaagattaaggctgggtgtggtggctcatgcctgaaatcccagcgctttgggaggctgaagagggtggatcatttgaggtcaggagttcgagaccagcctggccaacatggtgaaaccccatctctactaaaaatacaaaaattagctgggcatggtatgtgcctgtaatcccagctacttgggaagctgaggcagaattgctttaacacgtgaggtggaggttgcagtgagctgagatggcaccactgcactccagcctgggtgatggagtgagactctgtctttaacaacaacagcaacaacaacaacaacaacaacaaaacaacaaatatatatatatatatctatgaatgaacatgtatgttaattggattactcagtgtcaaggccgtgaatatttaagctgttattagtcatggtatgagaccatgtgtataccacacaagaatatatgtataagtttggccgggcatggtggctaacgcctgtaatcccagcactttgggaggccaaggtgggtggatcacgaggtcaggagattgagaccatcctggctaacacggtgaaacccagtctctactaaaaatacaaaaacaaaattagccaggcatggtggcgggtgcctgtagtcccagctactcgggaggctgaggcaggagaatggcgtgaacccgggaggcggagcttgcggtgagctgagatcgcgccactgcactccagcctgagcaacagagcgagactccgtcccccgacgactcccccgccaaaaaaaaaagaatat

SEQ ID NO: 35288 - DNA, 1074 bp, Homo sapiens
atagagacctttcccacagggtctgagaaggccaccatggtcatttcttcccttctgtcagacataattcctcggtttggccttcccacctctctgcagtccgataacggaccggcctttattagtcaaatcacccaagcagtttctcaggctcttggtattcagtgaaacttttgtacctcttacggtcctcaatcttcaggaaaggtgaaacgactaattgtcttttaaaaacacacctcaccaagctcagcctccaacttaaaaaaaaggactctgtcaagaatagagcccaaagacttgccaaccaagcaagtaattacgctaaacccccttggactcccttggaaactctctaattagatgtcctgagtcctcccaattcttagtcctttaatacctgcttttttccttctcttattccgtttagtttttcaattcatacaaaaccgtatccaggccatcaccaatagttctgtacaataaatgtttccatcaccaatcattctatatgacaaatgttccctttaacaaccccacaatatcgccccttaccacaaaatcttctttcagcttaatctctcccactctaggttcccacgtcgcccctaatcccgcttgaagcagccctgagaaacattgcccactatctctccataccacctccaaaaattttcgctgccccaacactttaccactattttgttttatgttatttttcttattaatataagaagacaggaatgtcaggcctctgagtccaagctaagccatcatatctcctgtgacctgcacgtatacatccagatggcctgaagtaactgaagaatcacaaaagaagtgaaaatggcctgttcctgccttaatcgatgacattaccttgtgaagttccttcttctggctcatcctggctcaaaagctcccccactgagcacctggtgacccccacccctgcccgccagagaactaccgcctttgactgtaattttccattacctacccaaatcctataaaacgttcccacccctatctcccttctctgactctttcttcggactcagcccgcctgcaccc

SEQ ID NO: 35289 - DNA, 1719 bp, Homo sapiens
agtcttgaactcctgggcttgagcaatcctctctctttggcctctcaaagtgctgggatttcaggcttgagccactgcacctgatcctttttaattaaaaaaattttttatagtctttttttttttttttttttgagacggagtctcgctgtgttgcccaggctggagtgcagtggcacgatctcagctcattgcaacctccgcctctcgggttcaagcgattctcttgcctcagcctcccaagtagctgggactacgggcgcgtgccaccacgcccggctaattttttgtatttttagtagagatgggatttcactgtgttagccaggatggtcttgatctcctgacctcatgatccgcctgcctcggcctcccaaagtgctgggattacaggtgtgagccactgcacccaccctgtaatcattttttttattgatgagtaatattctatttatggacatattacattttatttatctgtgcatcagttgatggacatttaagtttctatttttttgggctattatgctgctatgaatattcatgtttttgtgtagatgtgttgtcatttctttgggtatgtacactttttaataaattagcttttgacttacctgataccaaaaaaattatccattttgagtatataattcaataatttttagtaaatatatagatcgtgaaactatctatcaccttgagctagttttcgaacatttccattgcctccaaaattccctccagcctgtttgcagttaacccttattcccacccccagcctcaggcaatcactgattggttttgtcttaatccatttgcttttactggatattttgtataagtggaattgtacaatatgtagtcttttgtatctggcttctttcacttagcataatgtttttgggattcattcatattgtagcgtttatcagttttttgtccctttttactttggaatagtatttctttgtataggtatatgatagcccccccccccccccccccccccgttatctgtgtgggatacattccaagacccccagtggatgcctgaaatctcaggtagtattgaaccatatattatttttttctgtatctgtatacctaggataaagtttaacttgttaatcagacataataagagattaaaaacaatacaatagaatagttacaacaatatgctattcacaatttcatagaagatttcttactgtaggtgttagcaaacagcataaagtttttttcttgttaaattgagaactttcactttttcacttaaaataagtattttacagcttctttttggcatatccagttgtcatcctcattactcttgagtgtttgagccattgttaagtaaaataagggttactagcactaagatactagttgatctgatagctgagatggccactaagtgactaatgagcaggtagtgtagacagcgtgaatatggtggataaagggatgattcatggccgaggcagaggggcatggtatgaggtttcatcatgctgctcagaatggcactcaatttaaaacgtagattatttctgaaattttccatttatcattttcagaccatgtttgactgtgggtaactgaaactgcaaagtaaagctgtaggtaaggggagattactgtaacacactttagctgttgaccagtatatataggtgtttcgattatttccagttgttgactctttaaataatactc

SEQ ID NO: 35290 - DNA, 1083 bp, Homo sapiens
ttctgtcctaagtaaacagattggtacctgtggcctgtagggtctgctaatgttagtggctttacctgctcatgttgtataccatttttggaggagtaacagcttcacgatgatataattcacatactagtcagttcagtttaaagtgtacagtttggtgggtttattaattttttaaaaaattactccattttgcaggtgaacaattcagtggtttttactacaattgtccatcggtatctgttggggatttgttctagggccttcctcagacaccagaatctatggatgctcaggtccctaaaataaaatggcatagttgctgggtgcagtggcttgtgcctgtaatcccagttattcaggaggctgaggtgggaggatctcttgaggccagagtttggacaccaacctgggtgacagagcaaaatcctgtctcctaggaaaaatgaataaaactgacatagtatttgcatataaactctgcatattctcttgtatgctttaaatcatctccacatcactcatactacctaatacaatgtggatgctatgtaaatagttgttatactgtgtattgtttagggaataatgaccagaaaaaagtctgtacatgttcatttacagacataatttttttttgagtagtttctgtacctcattgattgaatccatgtattcagaactcatggatatggagggccgactgtatattcagagttgtgcagccatcactatactcaattttacagcattttaatcatcccccaaaagagccccatatccattaacagtcgcttttcattttccctcagcactcccagtcctatgcaaccactgatcgactttctatcattatagattagactgttgtggacattttatgtaaatgaaaccataaatgcggtcttttgtgactggcttctttcgtttagcataatgctttcaaagtatatccatgttgtaatatgtgtcagtacttcatttcttttttttttaaaatctattttctttctttcttttttttttttttttaagatggagtctcgctctgtcgcctaggctggagtgcagtggtgtgatctg

SEQ ID NO: 35291 - DNA, 1032 bp, Homo sapiens
agcggagcggggcgggggcaaccattgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcaggtaagagcgcgggcagccgaggctggtgagagggagcgcgaagggcgcggcgataaagcctggctgtcccgactgccgccgcctccctccgcgcccccgccccgcgcttgtgttgtttgcttcggggtttgcggaggggttttccggcggctgcggcggtgacaccggccgggggctgggggaagggggctgagtgtccccaggcaacggtcgcggagcgggacttggagaaaggggaaggcgcgctgcgcgcctgcccgcggggagcgcggggcgcggggcagggctgagggaagaggttacagaccccggcgggggggatgggccgagcgcagctggtctctccgtgtttacatctctgcgcgagtcacctctgccgagaagcggactgaactgacccgcctcatcccgcggggaggccagggcgggggtccggctccggaggaagcgcgtcctgggagggtttgtgtagggcgggagtctgcggccggcgccggggctgggcggcgagctcggggcgggacctgggaggctccggccgctctgggtggcgggcaggcgggggggggcgctggacaccagtttccttccctgtcgtgccttatcgccgccgcttacctttccttcccggcgctgctagcttgcacgacaggttgtactcggcagttcttttattctcgctctccacgccggcaccgtgctgccatctccccctattccccgggaggtagggaggctttgctcggatcggaatctg

SEQ ID NO: 35292 - DNA, 1031 bp, Homo sapiens
aattccatgggccgatttttttttcacgttgattaggcctctgttggtggtggtgggagggaaggacggaggtctaactaactcgctttatttttcttgtaaaatgctggtggaaggaagttatccctcaagtatcagaaataagacatcttcgttttcctagatctttattgcctttatttttctagatctttataccaaatgatatagagcttttaaatatatatatacactgatgaagtagggagaagccatttattttaaacttcggaagataacgggactgttctgttgagaacggggagaaagattagtcctctgaccgtggcctttcgttttatctgtctgcgttccccaccgacatcatgcgcgcgtgcacgcacacacaaacacacacacacacacgcgcaccttttttttgtagctgcagaaattccaaataattttcttcccaatttgcggcaaaatagaagtagtttaaaaattttaaatacgtatctagcaatgctgcttgtaaaggtactggtctttctctgattttcatctaactatttttgcagcacttaaaatgtatttaagaactattattgattggaaacaaatttgtcttcagtcgtggacattacttaaccttttgttcatactttctactttgatgaaaaataatttttttcagttttattgaaggaaaaatttttaactgtgtctcatcacattttgttctctcctttttgcttttaaaagggtaattttatttttttgagacagagtttcactcttgttgctcaggctggagtgcaatggcgtgatctcggctcaccacaacctccgcctcccggatccaagtgattctcctgcctcagcctccggagtagctgggattacaggcacgggccaccacacccagctaattttgcatttttagtagagatggggtttctccatgttggtcaggctggtcttgaactcccaacctaaggtgatccacctacctcggcctcccaaagtgctgggattacaggtgtgagcca

SEQ ID NO: 35293 - DNA, 1115 bp, Homo sapiens
ttagtattatttaattttaattaatttttttttcctggagacagagtcttgctctgtcacccaggctagagtgcagtggcgtgatctcagctcactgcaacctccatctcctgggttcaaggaattctacctcagcctcccgagtagctaggattacaggcacccaccaccatgcccagctaatttttgcatttgtaatagagagggggttccaccacgttggccaggctagtctcaaactcctgacctcaggtgatctgcctgcctcagcctcccaaagtgctgggattacaggcgtgaaccaccgtgcctggccttaattaattttaaatatatatttgttaatacatttaagaaaaaatgttttgtagagacaaggtctcactatcctgcccaggctggttctcacactcctggactcaagcagtcctcctgccacggcctctgaaagtgctgggatgaacaaacctgaaccaccgctccagcctaactttaattaatttaactagctagatggggctggtggctgctgtactgaacagcactatttagaattgtgccacatagtggcgctggtaaaaatgcttcctaaattaaataattgaaacctaactcaaactatgatttttttaaaaaaattgtgaagataggccgggcgcagtggcttacacctgtaatcccagcactttgggaaactgaagtgggtggattacctgaggtcaggagtttgaggccaacctgaccaccatgacaaaaccccgtctctactaaaaatacgaaaataagccgggcgtggtggccagcacctgtaatgccagctatttgggaggctgagacatgaaaatagcttgaacctgggaggtggaggttgcagtgagccgagatcaagccattgcactccaccctgggcgacagagcgagactacgtctcaaaaaaaaaatatatgaggatagagtgactcacagaccccaagaataggagtggacctgagcccaggaacaattgaagcctgggacccaaatgtcattaagattcttgctcttgactcagctatctgtgagtctgccttatcttcttggcacatggaccttctcttcctcaatccacattgtaa

SEQ ID NO: 35294 - DNA, 1018 bp, Homo sapiens
ttttccatattttataactctgaaactgagctctttactgttgattatccaaatcttttgccttttttctattagcaccctgcccatttcactactctaatcagccaatcaagagataaaatgagtctgggcttggtggctcatgcctgtaatctcagtactttgggaggcctaggcagcgggatagcatatgcccaggagtttgggcaacatagtgactttgtctctaccaaaaaaaaaaaaaaaaaaaagaggtaaaaatgaaataggcattgaaatacaaaccagatggcttttgctgttctttcatagttaaggcaaaatattttttgttaaaattaaataaaataaggtattggtactctttgtgggtcttttctagactttttctgatgttctaaggtgaattcagagtagtttaattttaatattatttctgctggttaatgctacagttttttttttcttcattataggtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaacttgtagaaaatgttaattctaaggtacattaatagaagtatttcaatatggaaggtaccacctgataacaaggtcagtggtaattaaggacactttggtaagaaaagttgttgtgaacatagattcaaaaatcagggctggctgggcgcggtggctcaacgcctgtaatcccagcactttgggaggccgaggcaggcagatcacctgaggttgggagttcaagaccagcctgaccaacatggagaaaccccatctctactaaaaataaaaaaattagccgggcatggtggcacatgcctgtaatcccagctactcaggaggctgaggcaggagaatcacttgaacctgggaggcagaggttgtgg

SEQ ID NO: 35295 - DNA, 1045 bp, Homo sapiens
attataggtatgagccactttgctagcctcaagaatcttttagcgtaatcatttttaatcattagtctttgactctgttcaaagaaaggtatgtttaagaatgaaaccaaaatctgccaggcgcggtggctcacgcctgtaatcccagcactttgggaggccgaggcgggtggatcacaaggtcaggagatcaagaccatcctggctaacacagtgaaacaccgtctctaccaaaaatacaaaaaaattagccaggtgttgtggcgggcgcctgtagtctcagctactcgcgaggctgaggcaggagaatggcgtgaacccgggaggcagagtttgcagtgagccaagatcgtgccactgcactccagcctgggtgacagagtgagactccttctcaaaaaaaaaaaaagaatgaacccaaaatcatattattttcttaaatctgatagtgctttacactttgctttcatagcacttatgacaaattattattcttcgtgtgtgtatttcttaatgtctgtttggtatcttgtacacttgagtgtgaattccatgagaacagaaacctattttattaattatcctttattcagcaacttgctcatctggtccatttaggagtttaatatttgtagaagtgatgaatgtataacggcaatcgattctttttattttattttattttttgagacggagccaccaggctggagtgcagtggcacaatcttggctcactgcaacctccgcctcccaggttcaagcaattctcctgcctcagcctctcgagtagctgggactacaggtgcgcgctaccacgcccagctaatttttgtatttttgatagagacgggcttttcccatgttggccaggatggtctccatctcttgacctcgtgatctgcccgcctcggcctcccaaagtgctgggattacaggcgtgagccactgcgcctggccagagcaatcaatttttaaatttttttctgcatgactatttcattatgattgtcaactcaactaatacccagttggacagttcctggtaa

SEQ ID NO: 35296 - DNA, 1050 bp, Homo sapiens
ggaaccttttataaacataatgacattgtgcagatgttgtggtaatcactttctatacagtatattacttatccttccaacagctgtatgacctataaattcttagtatcttatctaagggacctgagccaggatttaaacctagttctgtctgacctaaaagctttaactacattatactactgttgtaccaaagcaccaagtatttataccagatatttaacagctaagtcacaaggatcaaagaaaagtaactaaagcataaggcaaggcacctatgtgaagacagactaaaaaatgtagacctcccagtatgtaaaattagagaaaaccatcaatgtctataaattcaagaatggcgatcaacagtatcaacatagcctaactcattatcaaatattctttaaccagttaagaaacaaacaagattggacagatttgggagttctatccagaatgttatttcaacaaatctcataaggtaaattttagcttgacatacgattctgtagcaaataaatctcctttccaggttctaccctatcaggccaacatgttcggcttgaattctgtctgtcccagaattatggatcctttcacatgtaagatttgtaatagtaattcattcatttatggaaaatgcagtcttgtagggataacaagagaatatgtatttgggggttaggtatgtctgtattttcagagtagtatctaccgctgatccttatttaaaagcctgctgagtcgttgccttgccctaatacttaaaaactcaagcatctatttatggcaattattattattttttgagacagagtttcattcctgttgcccaggctggacagcattggcgcgatcttggctcactgcaacttccacctcccgggttcaagcaattctcctgcctcagcctccccagtagctgggattacaggcatgcgccaccacgcccggctaattttgtatttttaggagagacggggtttctccattttggtcaggctggtctcgaactcccgacctcaggtgatcagcccgcctcggcctcct

SEQ ID NO: 35297 - DNA, 1075 bp, Homo sapiens
gagattcggcgcccagagcctccaggggcctcagctcaccgcacgctgacacatgtgcggcggtgaaacccagccccaacaggccccgcggcctctccctgggtgcggccgctcgcgtggtctggctcctgacccaggctgccgacccctaaccctgttttctctccacaggacactggtcttcccacacgtgagaccgatgtcgccaggaccacggggtcggggggactcggctgtcctccgtctttcaaataaagctgtttgtctaaaaaaaaaaaaaaaaaaagaaaccacaagacaaataataaaatacttataaagacaagtgaaaatgaaaacacagcataccaaaacttatgagacacaacaaaagcagtgccaagggggaagtttctagctataaattcttacattaaaaaataagagtctggtctgaagaaagcaaaattaaaaattatttaaaaaataagaaaaatatcaaatcaccaaccggactttccaatttaaggaactgaaaaggaagagcaaactaaacccagagctagcagtagaaaggaagtagtaaagattagaatagatataaatgaaatagagactagaaaaataatatagaaaaatcaaaatgaaaccaaaagttggttattcaaaaatcaaaaaactttgcaaatctctagctagatctacttataacaaaggagacaagtcagaaatgaaaatgaagacattactaccatttctacagaaatgaaaagagttataggggaatactgtcagcaattgtctgccaagaaattggataacccaagtgaaatggagaaattcctagaaacactaaacctaccaggctaaaccatgaagaaataaaaaatatgagtagatttgtaactactaaagagattcaatcagtaatcaaacatctcctgtcaaagaaaagccctaaacctgatggcttcactgattaattctaccaagcatttaaagaagaactgtatcaatcatttcagacttcccaaaaattgaagatgagggcatacccttaacacgttctatgaggccagcattaacctaataccaa

SEQ ID NO: 35298 - DNA, 1032 bp, Homo sapiens
taaaagaagataagaaaggaagttaaaagtttcattacaaaaatcaactaaacatgaaagaagacagataagaaatgaggaaccaaaaaaagctgcaatatatatagaaaatagcaaaatgacagaattccctcatcagtaattattttaaatgtaaatgggttaaacttcagtgaaaagacagagattagaagaatgggttttaaaaaaccatgattcaagactcctgtgccacataacatttcagtcaatgatggaatgcacataggatggtaatacaatggtaagattataataacgtatttttactatatattttctatgtttagatatacaaacaccattgggttatagttacctacagtatttagtatggtaacatgccgtaacagctttgtagcctaggagcaataggctataccataccatctaggtttgtgtaagtaccttctgtgatatttacatgatgatgaaattgcataacaatgcatttctaagaacatatacccatacataaatgatacatgactgtatatgctgtctgtaagagacttaagatccaaagacaaaaacaggttaaaagtgaaagaatgggaaaggatattccatgaaactaattaccaaatattaaggatggcgatactagtatacaacaaaatacacttcaaagcaaaaaagattactaaagacaaagaaggacattatatactaaaaaacggttcaggatgagcacgttggctcaggcatgtaatcgcagcactttgggagaccaaggtatgagggtgccttgagaccaggagttggagacagcctgggcaacacagtgaaacgctgtctctacagaaaattaaaaaattagctgagcatggtagcatgtgcctgtagtctcagctactcaggaggctgaggcagaaggatagcttgagccaaagcactggaggctgcagtgagctatgatcacaccactgcacttcagcctgggcgacagagcatgatcctgtcttaaaaaaataaaaaacataaaaggttcaa

SEQ ID NO: 35299 - DNA, 1047 bp, Homo sapiens
taatttctttatggtcagtttttacacagaaaggcagagggaaagttagagtgatatttttaggttttatggctggctttggggaaaaatagttctggttggcaggatctgccttggggtctataggcagcctctgggaaggatgggactcagagacagaagggcaggagaaagtcagagaaaaatctttgctcctgaagctgcctctgaggccttcatttctggatattgtcttctgaaccccaacaatagtttgttattcacagttcccaagaggagggggcacaccatgttacaggggccacatggggaagcaccaggatcaagtaggaggtagatggagtaaagagaaaacgtagacaagaacctgtattgtggtgtctgcaggaagaaatggagaggcagtcagcaggcctgggattggctagcttgaataacttcagtagattctggggtgtaccggctgtctttagttgtctggtacctgaccctggggtaatggtggcttggagtggaagaggcctaagaaggaagtggttgtaggcacagaggctgatttggttaggttgcatgtgaaaggtgccaggcctttgctatctctaggaatcagctagccctgggtggggggcagtccctccagagcccacaaggccctagatgtcaaagagtcagcattaaaagacatgctttaatataataggaagtaaggaatcagggatgaactccgcagtttttgatctgagcaactgaaagaatgaagtaatcacttagtgcaaataacggtcaccactgatgatactgatggtcttaccgtaaatctcctgcactttcccagtttttatttctatttccaaaacaacccattaatttcttcatggtccagctccctcttgtggtgaggatttattctcatactgtttctgacatgctgtaaaacaaacacctctagggaaaggatgatttaacacattttaaaaatcccagcactttgggaggccgaggcgggtggatcacctgagctcaggagttcaagaccagcctggccaa

SEQ ID NO: 35300 - DNA, 1028 bp, Homo sapiens
aagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaagggg

SEQ ID NO: 35301 - DNA, 1006 bp, Homo sapiens
ccttatccgctctagagcctcacacaatgcttgctactgagaaggcacactgtaaatgttgactagttgtggctgggaggccgagttgggtggatcccttgagcccaggagttcgagaccagcatacgtaacatgacaaaacctcatctctacaaaaaaaaacaaaaattaacccggtgtggtgacacatacctgtggtcccagctacttgggaggctgaggtgggaggatggcttgagccccaggaggtcgaggctgcagtgagccatgatcatgccactgcactccagcctgggcaatagagcaagatcctctctcgaaaaaaaaaattactagttgaattaatgaataaatactctctgcctatgttaaaataatcaagctgtctttgtttcaaaattttcttacattttaaattttaaaaataatttgagttggtctttccctattccaaattttagtacttaaagggaattttgggtgtttcattgcatagggcctttcagaggataacaatgaaaacatgttcctgaacttgcaaatatatattacaaggagagagatggagaagtgctggtaaaatcacgtgagcatccctgtgagctttcttctggtataggaccgtgggtctcaaactatcaggatgctaatgatatcagcagggtggagcattcagtcttccttacttgcccctactggccatgatcatggatgtatgtatatacatagatatacatacatacatacatacatacatagatatatagatatacttaaataaatccccatatgtcttccaaggagatggaagggatttcatttgactggataccaattacggctattaatgataaataatacattagtgacttgaaacaaatgtgtagacattcacacactttaagccacatttctatcattagagattactatatacaagccatctgaaagacccttgagaactaccagtgaattctggagcactcttgagggaaattagacatga

SEQ ID NO: 35302 - DNA, 1873 bp, Homo sapiens
cccttgacatcgaatgagataaatctgaataagaatttcaaatatccagataactaggaaaaatagccctgtgaaattttaaaaccaaatttgtaaatagaagcagaatattttattttatttttaaattgcaaacataacaaatgcttagtggaataaaacaaaacttcaagaaattcagaaatgtgaaagtgctcccccccgcttttttttaaccccaacccatgccatagaagtaattactattggcagagaatttgcacatcttaactaaacatattcaaggtaaaatatagaaataggcatttttaaagttttattttaattgacacataattctacatttttctggggtaaagtgtgattttgatacataaacacattgtgtaatgatcaatcagggtaattagcatatccatcacctcaaagattcatcatttctttctggtgagaacattcaaaatcccttcttctagctattttgaagtatacaatatattactgttgactgtagtcaccctgttatgtaatagaacaccagaacttattcttgctatctaactgtaactttgtacctgttgaccaacctctccccatccttccctcctgccttctactccccagcctctgttaaccactgttctgttctctacttctgtaagatcagctttttcagattccccacatacaaatgagatcatgcggtatttgtccttttgtgcttggcttatttcactttacatgatgtcctctaggatcattcatattgtcacaaatgacaggatttcgttttgtttttatgctgaatagtataccattgtgtacgtatataccacattttctttattcattcatctgttaatggaaacttgggttgatttcatatcttggctgttgtgaatagtgcaataaacatgggagtgcacatacctcttcagcatatggaagaaatagctatctatttctaaatcagtttaaatagcaaaaatgtacattgtttacctgttcacaactgtctcagattcaaaatgtttgctagttttgagatcataatatttagtcttttcttcattatatgacaaaatgtggaagagaaaagctaagttactacaaccagcttattaagtcagaaacctaaaatcagaatactcatgctttaccagatggtttgccctacaaataaggaatgaatgagaacataaccttattttaaaaattgtttttaaagtagatattgtgtccattcccgcctcctctattaaaagggaagaagaaattatcctgagattcagtaactgggacttctttacatccactcggtcccgagataaaggaattgatgcagcgtggtgacaggaatcttgaggctttgttggtgtggatctggagtctgtctggtacccgtggatttgctggagtaccatggggtgtgatgaaaacgtgtagtgttcaaaatactttgatacacacatctctaatttttatactaatcctagattctggatgtttattttcatgtatctttctttaattgttctattttgaccatgatttatgaacctaaaggcaagacttttcacaatcctagaatggtgaacaagaaggagatatttcttcagattggctttgcgggggctatggaatattagggtcatgtggtttttagcctaattatgaggtggagatgaggtcattcattcagctttatttgtttatattgttgatgcctctccttcacatgccaatttgattttaaaggatttactactccacggcttctttctcctgtgcccaagtccttttctgatgttgcttggctacatttgccaaaagggctccgtgtaatttatcactggccaaataacctgagcaa

SEQ ID NO: 35303 - DNA, 1050 bp, Homo sapiens
gcttgttgcctctcctcatgagattgatgaaaaaatgcttggcaaagttcttcaaagccacatcattgcagtcccagtaataagacataaacaggtacacacaggagggcaactctctagacttcaattttttaaatgcctgtctttgggatagttggtctttttgtgtgataatttaatactaatgtcagaactatgattttccacagtgtacctctagttacagtatttttcacaacaggatttcttttattttactctcatcccctgtctgaggacactgagagggagaggctccttactcgcttgtgatagataggaatgactataggacgtttttctttcaagaagagatggggttgcccaggcccagcttcccaacaatgacttttaggccctgtcagcttcaggagcaaagagtgaccatgtgaatttctcaagcatttagtggaattcagagccgcaaaagggctagctattttcagacccgttggttgggtaaaatggaaactgacttcaccaaagcaggttataggattctgtaggataccgcaccacttactaaactcctgacattggtaataggccagagcttcctttgggaaagaaaatgtctaagctgacaactgaagggtgatgtcagggactggtatgtgacccagaatcccttttctgcaggcaaagtgcgttgttttaaagggggtaacatttctcaggctctcaatgatctgatgcaatgaggggtgagaacagcaataaaaaccttctaaatgacttttgtaaaatttcattttaattataattccaaccttcatttccccgttgcccccaaccccacctttttgtaaagcagagttttgcttacaaactgtaaattttaaattgtcagatattttacttcctttcttttgggtggatacttgagtgccatagaggcccatttcagtatgttggtattggcctgggcatgttggctcacatctgtaatcccagcactttgggaggctgaggcaggaggattgtttgagcccgggaatttgagaactgacc

SEQ ID NO: 35304 - DNA, 1048 bp, Homo sapiens
tcatggaaagtctctgttattgttttggttgtggctgctgttttagacataaagttctactgctaggaaaactaatccgggatattaaatattcagagtggaagtctcgaatgatcacaacccttaatctctagttcctttaattgatcacaccctagggatgtaaagaaaacaaaacaagccaggaagaggctcctgctgtcgtcgaatagatttcagaattctctcacaaccagcaatctaaaagccttcagaatgatagggagtggtcacatgtccaagcacctccttaatgtgcaaggtcaccagagtaatggccatcatttggtagctctcccctgaccttgtctctcccaagagattaagatgatgatagggctcctcttcatttgcctgttgaaaggcactgaggccaggtgtggtggttcttgcctgtaatcccagcacccaaagtgggtggaccacttgagctcaggagtttgagaccagcctgggcaacacagtgagaccctatctctataaaaaaaaatttttaattagccgttttggaggctgaggtgggtagattgcctgaggtcagaagttcgagaccagcctggccaatatagtgaaacctcatctctactaaaaatacaaaaaaataagctgggcttggtggcaggtgcctgtaatcccagctactagggaggctgaggcaggacaattgcttgcacccgggaggcggaggttgcagtgagccaagatcgcaccattgcactccagtctggacaaaaagagtaaaactctgtctcaaaaaaaaatttttttttttaaattagccagttgtggtgatgtctacctatagtcccagctacattggaggctgaggcagaaggatcacttgagcctacaagttgaggttacagtgaactatggtctcatcactgcactccagcctgagtaacagggtgagaccctgtctctaaaaaataaaggaaggaggaagagaaagagggaaggagggagtgaggtaagaaaggaagaaaaggagagaaggagggagggaggc

SEQ ID NO: 35305 - DNA, 1069 bp, Homo sapiens
aaggagtggcgggctgcgaacagcgcggcgccgggccccgcggccgccactgtcccctacacgggtggccggttgcccggctcgggcgggggcccgacagccacggtcacgccgccgggagcgcgcactgcgcggcggggcgcaggccgagaatggggctccgccaggccgggggcgctggaaacgcacggccgctccatcccgcccggccacagcctgcatccaccctcggagttgcgaaacctgccccgcgctctggcctttccgcctttgggcgcggagggtgggtgcactccgcagggcagccccttgaggccggcggactccgcggagcaatcccctagcccagttttggccaccccgatcccctcccggccgccagcccttcccttctgctgcctctgcgccccgcggcggccgcggccccgtccgggtaggtcccccggcgcagcgcacggggccagaccaggcacgtggcagccgcggcccaggcggcagctcttccgaaaagatgaaatcattgtcgggcgacggacaagtctcccgacccgggactcgaacgtgcgccgtccgggaggcgggcagccctcccctcagctgcccccgagcgaactcagtcaggcctccccctcccccttcctgcttggctgggatgcagccgccacgctgtgcaggcgcgccgcgagtccgcaccgagattgctgggtgacacttaactttctgaattccatgccgttggctgtgggtgatatcaccgcctcagtgtcgtgtttctccgccccttctcttctaccgcccctcccccgacttttctcgccactttgttttgctgagtttctccacctttttttttttttttttgttagttctgaaaaaacgatgtggggacgttatacaatctcgttgtttgtatcataggatgttatgattttgtaacagcgaatactggaaaatactctttagcgtatttatttggttccactccatacagtacgtcgtgatgtttttcagtgtggtgtggtatgataccagaatgttttaaactaagcatgtgagtaaataattttta

SEQ ID NO: 35306 - DNA, 1052 bp, Homo sapiens
aatttttttcccattattcttttttttaagagggaagggcttgcattgaattgctctgaagccactgtcttctaccccaacttcctcccgtctagataggcttcattaatttgataagccgacaccaaaagagaggggtggcggtggaagggggcggggtgctgcaggaggggctgcctaggggctgccctgaggttttagaagatgaactgctaatgatgttgaagacgtaccttttcagactgcatggtccctctggaaaatcagggtccttttttacttattctgatggtactgcaagaactgaaaaatagaggcctggttgggatggagggggtatatgggctggggcgggggtggtaagtagacagatgcgtctccaaggaggaatccgaacacgtcagttacacagcttgaagggccttttctttaacagggtgtctgatattgtcatgctaaaaagtcagaaactaatgggggaaaatagattaatttgctaggtcatttattgaacagtcttgcttgatacttacaaactactgaaattagtgcaaattggcaatatgaatattttgatcaacatctgtgacccttgaatgcaaaccacagagcttttaacatgtcagaggcactaatctttgctagtcctttcccatcttctaatatgatggaagttgattatacctaagagagccatctgtataatcgtcccaagacagtcccagtttatgccagttgtcctggcttgggtgaaaaattatatagttaccctaattattacctctcagcaactgggagacgctgagagatgcccagcttgggtttgattctatttttattctctgttctcttgcacactttcaagatcattctcaaacatttactgaaaacaaatgcgtgcggcattctgaggatagaaaggcatttaaggtaggatcttttctgattgcagttagtggcaatataagcgacttgcaggtataacaaaaaccttgaatattctcgaatcatagatcagaaccataccctggcttatttccttctgaaataaa

SEQ ID NO: 35307 - DNA, 1088 bp, Homo sapiens
cagcctgggtgacagagtgagaccctgtctcacaaattaaaataaataaaataaaatacatctttaaatataaaataatatttaaactattattagtaggttgtttctttcttaaactcttcctcttacagacaaaaatatgtagtttggtgatagagtctgtctagtaaaataaaaataaagtacagtgctagcttcttataagccatagtttagtcaccaaggcttctggcaatctgtaggtaggaaaattaaggcataaaatgatctatcaagatttgcataaaaagccactcataagccgaggagaaagcatttcagctcctggattttttgtcactgtcaagctgtcacaaataactatgtctgcttggagcatttcaaactctgagttctctgtttatatagatgttgggatttcctcccactcctaaaaatatattctagatgaaggggttaaagatcaacattaccctgctaaaccttactctgactcaagatttacttaacgaactgtaattttactactgcacagattcaatctgttgagcaaataaaaatcattttgaaaatgacctatgtatttattcagtttgtatttcagaattatcataatatcaggtataaggggattgtggtaccaatgaaactattctataccattcaccatagatttataaaggagactacaaaagagaaaataagagatgacatcatatgaagtgctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattga

SEQ ID NO: 35308 - DNA, 1039 bp, Homo sapiens
ttcttttcttttctttttttttttttttcagtcagagcctcactttgtcacccaggctggagtgcagtggcacaatcttggctcactgcaacctctgcctcctgggctcaagcgattcttgagcctcatcctcctgagtagctgagattaaaggcatacaccatgatgccccactaatttttgtatttttagtagacatggggtttcaccatgttggccaggctggtctcgaactcctgacctcaagtgactcatctgcctcagcttcccagattgctggaattacaagcgtgagccactgcacccggccaccactaccattttcaaatggagaaatagtacataagataacactgcgggctgggcgcaaaacaaacaaacaaaaagcaacataacactgagactgcagttcaagcagcctgtgtttatttcattgctaaatatttgtatatgtttaaatatggcagttattgtcctgttgattctctgaataggacaaagtagtctatcctccagtggtcccttctccccagtcccaatgtggtgaagagtgggatttttcctccaagagagggtttgttattcatttttctgtctcaggatttaagggcacagtcttatagtgccaggctgctttccttaagatctatagaaagacagaccgcaaaggaatggatactacacacattaaaggcgacacaaggcttatgtagggcctctttcgggctgttctcctcagagcaagactgctctcaggcacagaggtcagccacaaccctgtgttccgtgttctgatgctcaatcacatcaaggatggcagacaagcaactttcccaggtgctcctgagcttcagggagatgttgcctcagccggatgcccaacttcattccatttccagactcttagattcccttcctttcaaggtgcattctgctacaccctaggcccctacccagtgcactcacaggtaagagagtaggcccagctttattttttcccaagaggagcctactagcctaagggttcgacacaggtgta

SEQ ID NO: 35309 - DNA, 1035 bp, Homo sapiens
cctgctgtcgaaactgaggcatagagagattaacttgctccaggatcacagcaggtagctagattctagatacactttaccactaacccctaaattaaaaggttaattaagccccataaattaaaatcagccctcctttctgctagggacatgtgggtgctttgcaaggtgtggattgagctgccctcaggtctacagttcttttaataaataggacagagtccaatccaccatgctagaaaattgtaatttttgtagcagcattgttagtgttacatgaaaccagactttcccaggttcctggtggcagagatgtgtgtatagcttctcttccatggacaagtttcatctctggaggcgatcagggcagcctgtgtagaagactaagacttaggaattgggctgtgaatagctatccatgtccatttagcaaataccacttcgctattttaagagcaagaaggaaaatgccatttaaatagtgatttagacttacaggaaggacaaggcaaggataaaatctaccgaagattttaagaaaatctccaccctaaataaaaattgaaagcagtacaattttcatgtctactgtatgtgtattttcagaaagggacttttttatgcaaaggacacactgacatcaatgactaatgttaaaaaacaacaattggaaaggttgtgcaatgtggagattcttcctctatatttagaataaaactttgtgtttttactgtcaggatgtgagcttaattatagcatgttgcaaactttgcttttctaaagagagagagagagagagagagagagagtgtgtgtgtgtgtgtgtgtgtgtgtgtgtgtgtgtggcttactctgcctggagaaatttgggtgctatttttgttttccttttgaaacatcaagggttgatataaggtagttttagaagtgtagtatttcttgaccctcaatgaactgatgacctccctgaggccaggaaggatgttttattcagctgttttagcttttatattttataatcattatttacatgaa

SEQ ID NO: 35310 - DNA, 1055 bp, Homo sapiens
agacagagtttcgctctgtcacccaggctggcgtgcagcggcgccatctcggctcactgaaacctccatctcccaggttccagtgattctcttgcctcagcctccagagtaactgggattacaggcacccgccaccatgcctggctaatttttgtatttttagtagagtcggggtttcaccatgttggttaggctggtctcaaactcctaacctcaagtgatccacccctcttggcctcccaaagtgctgggattacaggggtgagcaaccgcacccggcctgtttcctaattcacttcttgttcactctaataccaaccaggagaggggagtgctatggacccctcccccttccactccctttcttcctattggccccctcgaattaggaacaagacagaagcatatgttttggcatcttatgtgttctcataaaaaagagtcatcttactcgataaagtccacttaaatctggaaagcccttgcatggcacacgatatctcaagtggcagcctccaaacaaaagatgactatagaacccccgaaattcaaggtcaggagactgaataatgaatgtctgtttatccacctggtgctttaaaactgacctatgtttcccataagatgtcttgaggttgaattatgtcacagcagtaatgtctttaacactattgggtgagatgatttgagagagatcagatttcatctggtgagtgacaaggcttcactccctcttgcagtgtattaaaacaattaaacatcagatgcattttactgcagtctgtttgactcacgtgtgcatattagaatatttttttcaaaaacctatgaaataggagcctagctccctgtgaatgtttatggcgctcattaacaaagttcatctccaggatgtatgattttcagttttctctttctaatcttcttttgggaggatggaggatgggtagaaatcaattttcccagctagatctgcatttttccagttagaaaagatgtttcattttaatttgttgtctgatggtattgaaatatttttccaatctgttgttatt

SEQ ID NO: 35311 - DNA, 1047 bp, Homo sapiens
ttggtccttaccatgtgataggattctaaaaggtcagaaacctgtaaacaccatgcaaaaacacttttaaagattctttttttttttaattgagactgagtttcgctcttcttgcccaggctggagtgcagtggcgcgatctgggcccactgcaacctccgcctcctggctacaagcgattctcctgcctcagcttcccgagtagctgggatcacaggcatgcgccaccacgcccagctaatttttttgtatttttcgtagagacggggtttcaccacgtaggccaggctggtctcaaattcctgacctcaggtggtctgcccaccttggcctcccaaagtgctgggattacaggcgtgagccactgcgcccagcctaaaatctaactctgggactagcctagggtaaatatcacaaatattaatcctagacgtttgaaatctctttactcagcagtacaaattgacaacgctgcccaacagtgccatttcttaccgatgaaaaattctctttgatagtagagccaaataaatgactgtgagttactagattaaggtgacctacagggccgtgtccttaaaatggcaggaggtttcagtgcaagagcagagaagcagttctggtggatggaagtcagtggcttcttcaggatggtgtgggagaaggcacagggtcaagaattgcagcctggtaaggctggtcgctttccctgcctctctgttagctgtggaggaaagaatgggatcagcttggctttcccatttccaggccatccaatggctggtggctttggaatataacctgatcttaccccgaccacctcccttttgttccaaatgggtgagaaggtaaaagaaacagatacagaaacctttttttgctgtttctctttcctctttctttctagatctctgaggcattccctccccactgccctccctttactggaatataatggaatacagaaacgtctcctttcgcctcatcttccattcccttattattattttagctactaggaattagcattaggaagaatcccaggaa

SEQ ID NO: 35312 - DNA, 1032 bp, Homo sapiens
cttttgcaactgtcaaaaataaattgaacatatttgtattaggtggatctatctctgggttctctattctgtttcattgatctagtgtttgtctcttcactagtaccccacagtcttgattaccataactatatacagtagtaagtcttgaaatcaggtacactgatgccttctactttattctttttttcaaaattgcttccattatatcagtctctttgcattttcacatacattttagaatatttgtcttcatctacaaatctattgctgggattttggtaagaactgttttaaacttgtgtatcaagttaaggaaaagtcacatcttactatgttgtcttccaatccattaatgcagtatgcctctccatttatttagatcttctttggtttttttcatcagaattttttagttttcagcacataagtcctgtatttgttttgttagagttatacctaaatatttcatctttcagtaagtgtaaatggtactctattctcaactttggtgctcacatatttattgctaggacatagaaatataaattatattttgtatgctaatcttgtatcctgttatcttgctggactcactagttttaggaggtcctttttttttaaagatctcttgagattttccatttacacaatcatgtcattcataaacaggaaccaatcctttttcatctgtatacctttatttttatgtatttttttgagatggcgtcttgctctgttgcccaggctggagtgcagtggcacaatctgggctgactacaactgccgcctcttgggttaaagcgattctcatgcctcagcctcctgagtacctgggattacaagcgtgtgccaccacatgtggctaatttttgtattttagtagagacaggatttcaccatgttggctaggctggtctcgaactcctaaccccgagtgatccactcacctcggcctctcaaagtgctgggattacaggcgtaagccaccacacctggcccatctgtatacttttaattttattttcctgc

SEQ ID NO: 35313 - DNA, 1073 bp, Homo sapiens
acagattttttttaaatgaaagtaaagctccagtagaaataatgagagttgtcctagaaagcactgccttctgattctgctctgcatttaaataatctaggcaaaagtgaaatcacattgaaaaaaacaatcttcacctgaatcacagtgttgttcagcatatgcagaagaacagatgccattaccggcgttttatatagaagatgccatcttctcaggagaaaacatagccccagactcttctttcatttgtctcataccgattctctttttctttttcttcctttattctctgttctaactgtgtttggatttcttattgggccaataacatgaaggtccttgtttagacccaaaggattaattcagaagaacaggaaaaaaattataaaacaaattaaatgctcaaataggagactaatgaaacaaaatgatagtggattaaaataatgggaataccagaaagctagaacatgatgagttagacactatgttaaaacatgagaacatgaaataactgagacaggcaagatacaaatactaagaaaatatagattaacaataatgccatatatatatatatacatgtattatatctaacaatataattttattatatataatatatgtgattgttcattttatgtccaatatctatctactcagcaggaataatgaaaaaattacatcaaatgttaggttctcttttcttagcaaagaaacttaaattagtaatttttaaaaatactctaaacttggggctaggcacggtggctcatgcctgtaatcctagcacattgggaggctgaggtggaaggattgcttgagcccaggagtttgagaccagcctgggcaacatagacccactactaaaaaaaaaagtactctgagcttgaagggcttcaaagacaaagtgttccaaagggaaaacatgggtctattttactttttgaaagagtcatgcaattttttccttccttgtccattatttgttaatatttaattttgaaagggtatggtaccttttaacttcttaaatgaataaagtaaaacttcttcagtaatctacattc

SEQ ID NO: 35314 - DNA, 1013 bp, Homo sapiens
acagtataaagccaggtgttggttttagtggaatcagtgtttcaggcaaaaatagccatcattgctgccttttttcatcagtttctatactaaccaggcaggcctctgcattgggaaaacataagttggagtggaaaccgaacaacgggaagttttcatatattttcttacctccatgttgagtgcttaccaactgcaattttagagggtaggttttttagaggtgctctgcaaacttcctatggtgaaagaccagtttcttctccttctatttccaatccatttctcactgttacatttagaaaatacaataaaaatgtactactagaaaagtgatcatgtgctcgaatgttcctttaattacagattgctgtgggcctctcaccatgcacttttaaatttctgtgccctgtgggtgtggaacattaccgtttaaaggatgagaaccaagtccagacaccatgctttgagtaacaccatctttgggcacattcagacccatgagtagagctcctgtctgtgatggttaaatgagtgaaaaagcctaaagaagagacatttcagctgtttgccttttctgcaggcatttctgtgctagctccttcaagctccctctttagtctttgcctcccattctttctattgtgtacctttgggttaattacacatcttaacttcccgtttcctgcagattaaccttcacttcaaaaatgtaagtgattacatgcacttctttttcccaaaattaactgccatacactccgtattcatcattcaagggagtatcgtattttttattaatacatttgaaataaatccaaacacctgtcttgcattttgtaaacattttctcaactccatgttgagtgcttaccaactgcaattttagagagtaagtttgtatcttagagtgaattacaccttctatgagtacatacattttacaggtcagtctgagacatttacataacaattaagaaaattaatatattgctgacttcctctctttggct

SEQ ID NO: 35315 - DNA, 1030 bp, Homo sapiens
aagaaggagaatcattcaaaggataagactacatcttgatgactttttggacagccctgtcatgatggagaaattggggtttgtctgaaagaaggggataggggagagaggagggaaagggttctccctcttagaccaggtaaattttccttcctcccttcctttcttccttacttttctttctttccctccctcccgtcctccctcccttcctccctcccatcacacttttttgcccaggctggagtgcagtggtgagatcgtagctcaccataacctcgaactcctgggctcaaatgatcctccctgtgtagctgggactacaggtgtgcaccgctatgcccggctaattttttaaattttttttggagttgaggtcttgcgatgtcgcccaagctgatctcgagctcctggtctcaaacaatcctcctgcctcagcttggccaattttgttttcatgtgcttatgtgtgaacctgttaacaagtatttatgcttgattgttactcattttcagaaggctaaatataatctcattttcctgaagtagagaattctgtttttcatcgtaaagagttggttgtatagttatgattaaacaattatttttggccccttcctccacctatgacatgattcagtgcttaaaaagaggcagtgtgagtagtgaaggagacccaggatgaaatatagatgataaattatcaccctgaaaagtacacaccctcattaggagctgaaagaacatatattaagacaactttaaagtgaagttatatgcctaagacactttaaaaaaataaatgtgagttttaaacccagcgttgattaaaatgtggaaaaacatcttcacttacactttggtgatgtttctgtaaatgggtacaatatatccaggaaagaatttcacaataattaaaaagaggtaaaactttattgttcgtagcgtagaaaccacaggaaattccaaatcattgtgaagaataaagtttctcatggtagcattatttccagtgaaactgaaacagtgc

SEQ ID NO: 35316 - DNA, 1030 bp, Homo sapiens
ttccattctgcactgaacagattgatgcttatttttatattggaaaccaccaagtcaacatgttacctttaaaaatatggagcatgacttggagaaatggctacattcttgggctggggcagggaaagtacaacatgggcctgaatatctagttgagccagaaagtagggggaattgtcaaagaatcaaaaagacacaggggccagtttgatgggctcccactggactaattgggagaatttaaccatcaaaataaatatggtaatgaattataaccaattaaataaaataataatttataaatccatactgatatagaaattgatgacataaacaaatgaggggagaggtaaaagctcttgtttagagagtcaactaataagtataaaaaaggacatagcattatttctgtgttaatgtgaaaagttaccagagtctaatcatgacgaaacatcagatgaaccagaaccaagggtcagtctataaaggaatgagcctctaatattcaaaaatgtcaagatcaagaagacaaagaactactgaggagggcaagggtgagggttggggccactgacatggcaagctggaagaggagaacaaatacttccactctttccattgattgtggaagctttgggttaagaggaggtttctgagccagtttacaaagtttgctctttgaggtggtataggagaaatattccttttaaatgaagattacagaagacaagttacaagtggggtattctcccacagtaggggtgagtaacaggaaattcctttaccaatggcaacttgagttttccagctctattctatcaaatcatttatatttatctagcccttgttacctaaatgatgtctatcaaattccactataaggggaaggggacaaagctaggatgactaagtgaaatccacacacaattatatgaaaatacttcattgaagtgttataaattggcaggattgattggaatgttctagtcctggattggccatgttaaccaaagatgactgaacatccatg

SEQ ID NO: 35317 - DNA, 1025 bp, Homo sapiens
catctaaaaaaaaaaaggaagggaggaaggaagggagggagggagggagggggaaaaaattgtgtatcccaaagtgtctcaggaaggaaggaagaaaaaaaaattgtgtatcccaaaatgtctctccagaagatacgatagaagaagtctgtaatgactgtatttaggtacactaaaccagcagtgcatatctgcaaattggtcatgagatgtgagaaagaaaggtaagaaaagtatatctaggaaggtactaggttagttaaattaagttgatttctgtctaatgtaagactttaatggctgaatctgggttcctttcatgcctcctgaagtgagtgggcaaatggttacaatgccatttcaagcgcacctattaaaaattgtggactacagtaacatcttttaaagtggtctctaggaagggttatgtagtggaaactgaataggtttttctattgtgtgagattggaagtgagaataagatcttgaggttgaccttatcggggtgaattctgaaaacgcccatataccacacctgacttttgccttgaattctctggggaatgccaccataccccttgcctgttaatgtatgtattgaagctagctttgactgaagctgctgcttactaccattcccctggctaacaagcctacattaatttcccaaatcctttgtcaaaaaaatgattaggttggtttgaatgattacacttagaatgtaggatgctgcatccattctgtgtgtgccgtcagaggccttgtgtgggggaggtgaacagaatctaatcaacttgggttacttgatcagaagtggctcttacgcatgttatttttgcaatcggagagaatgttaggctctctttccctgctacagcatgatcgtttccaatgggccataatactttatgaatattgaccagaggcatgaatcgaggctttccaaaatatatatttttaaatttgagataggatctcaccatgttgcccaggctggtcttgaactcctaggctcaagcagtcct

SEQ ID NO: 35318 - DNA, 1073 bp, Homo sapiens
gctgcctttgtgtggggatagcctgtgtgggtgcacccttttttgacacacagagtgctttccaagagctccaagtccttggtgttagaaggatactcctgctgcaaagatcccattgcccatggggagctctgagctgacattccctaacagaacccaagtagtggtcagagcttggggctccttaaaggcaggggtgctgctgggtctgaaatagtactttggatattgcaggtgctccatacatatccatggacttagttgatttttagccctgcaggttgttcctcagcacatggttcttctctgagctccatactgccctcatcttcgctcatctgtgactgtatctaaactcttctcaaacctatgagtatttttggcttctgcacctcctgaggtgtgatgagttctctgtttttatgaagaagagatcttaccttgtattgttctaaagcaccatcttaattgaaggtaggaggaggagtttggagcaaaccagagaggaatatggacaaatgaggggcaaaagagagccagggcacagcagaaggggcctcaccagggagaagaggagctgcctgttctgtcacttagctctccatgatgtgctgggatgctgtctgtgaggcactggacgaaggcaatttagtgaagtcacattaaagtggctccaagatttgatgtcacaataggtcactttgaccttctatttatgatcagctcttgatgtacacataaaattttgggaagtaagtaaaatgtatatggaggtttggcttgcgttctggtgaataaggtccaggaggttaaatctctgtgcttttagtacagctacttggtatctgggcctcatttccccacctgtaaagcaggggtaacagtagttccttcctcatagtgttgatgtgaggactgagagatacagttcttgtagaattttcagtaaagttctggatccacagtgagccttctataaatatcagctgttattattagcaaaccaccaagatgcccactattgtgcctcatgatggcaggctcagtgggaagccaacatgttttctccaaaa

SEQ ID NO: 35319 - DNA, 1027 bp, Homo sapiens
ggaagttaagatactaaatcacgctcttgcatccaagactttgacaatatatattctctgtagattttcagtattattctagccagattcaagggcgtaacaattttttttttttttttttttttttttgagatggagtctcactctgccgtcaggctggagtgaagtgatgcaatctcggctcactgcaagctctgcctcctgggttcaagtgattcccctgcctcagcctcccgagtagctgagactacaggcatgtaccaccacgcctggctaattttttgtattttagtagagacaggtttcaccatgttggccaggatggtgtcgatctcctgaccttgtgatctgcccacctcagcctcccaaagtgctgggattacaggtgtgagccaccgcacccggccagatttttaaaaatcagtatagtcattggcactaacgacagcagtttcaggcttcagggtgttatatcacctttccatgatttttaaggaaaatattataatatgctttactttcctgttgtttcataccaatttgacattggtatctgccaaataagttaatttgcagatgactgctccaaaattacagtatccccccacaaattaaatttttattacaaatacagcctgctttccagacagattccaaaaattcactatttagttttgtgacttggaaatgtagcttctgaaaaatcagctgtcaccaagaactgattaatttagtttaatttttttgttgtttaaatctaagaaagtttaaagaacaaaagaaatagggttagataaaattatgcagaaaatggagttgagggcctgctgtataataaatacttaaagatcatggggttccattcagtggatcagagaaggagcacactttttttaaagtctacttggcaattccatctgttaaacagtggaggggtttttgagttcctttctccatttgggacagaagcacagcattcggcgttctctgagggccgcatgcacgcatggataggagcaggaagtta

SEQ ID NO: 35320 - DNA, 1079 bp, Homo sapiens
caggacagactgtctttcggaaagctttccattgcccaacacagcatgccttaagtttgtggaaaactttttgaaattttgttttttctgtccttcatatgtatttttttcttttaattctcaagaagcatttttttaagctccaatacatgtttaattctattatgttatttggttgtggtatattttatttagtactgggcagccagtggtcagaaaagtagaagcagagttagttaagcattaatcataatctacaaaatgctcttcaagctgagttccttcccagggaaagccaagttttcaggaagctagtatgcttgatactttctatcctgtctcattagaattataagggcaaactttagaatcttttttaggatttctgccacctgataggagaaaaatgggcagtcctgtacatagtttactgacatctctggaagaagaaggatgaggaatttaatagtaaaatagagttatatggagttattttctgaatatcgctgtgagactaatggccaactgttgttaaagaagttttcctgcccatttggttgagataggaatataaggcatttctctctctcatgcatgcacgtgcacacacacacacacacattcactcattcactcactcaccctggtgtgagtgtcatagaagggatccagtgtaagaacctgttttgcatgttaaatagtaattcttggatatatttgaagtacttgtgtgattactgttccctgtttgttaagtaacagtcctgtcttatactcttgagcttaaaaaggctaaattctgttgtctttttccacattacccatcttggagaactgtgaaatcaatcaaacagacatcagactcttataaagaggaacatatttaaaactcactgtcaagattttcatagtgtctaccttttaagtctcccaaatagctttacatttttcactctattattcaaaggctgatggttgagttttcagatcccctggctgcttgctttgtttttccttccccccacctgctgccaaccttttggtcttttcagtgatctttaacaccgttatcaaagagt

SEQ ID NO: 35321 - DNA, 1047 bp, Homo sapiens
ctgccctcaaccctcaacccagctgaatacgacatatctctggagacccagtgggcacaagctgagcgattggccataagggcctggcctaaacaggaatacctgcttcagtacaacaaccctaaccgccaagggctcatccaaaatactgccttgatttgttggacctatgcaagatcagcaagtgtctatcccaattttagacccgctcccaaaaaccctctcttgggagctctctgtggaattgggcccctcttcttctagtattatgttttcaaaactgacagggatagaaaagaaaaacttatccaggaaggaaaattgggctgaacatttaacatctcatgtcaagtctggcaatggcaatgatgaccatatgcattctttttttttttttttttaaacagggtctcagtctgtcacccaggctggagtacagtggcgcagtctctgcacctcctggttcaagaaattctcccatctcagcctccaaggtagccaggactacaggcgagtgccaccacacccggctaattttttgtatttttagtaaagacagggttttgccatgttggccaggctggtctggaattcctgacctcaagtgagccacccgcctcagcctcccaaagtgctgggattacaggcatgagccaccgcacctagccgactgtatgtattcttgcttaaataaatattctcttaatcatttaaaaaaaaaacaggactgaattctttcatgaaacgatggcttttttgcttttactcttggctttacattgcgtattagcaagagggtcttgaatttagtggctgcctccaccgggatactagcttaggctcttaggtccgagacctctatctcttaggtgcagatggaagatttgcaataaaagatatcaattttctgccattattactctccacacttgttcatatgctaagtttaaaatctatatttccgccgggcacagtcgttcatgcctgtaatcccagcactttgggaggctaaggcaggcacatcacctgaggtcaggagttcgagac

SEQ ID NO: 35322 - DNA, 1060 bp, Homo sapiens
tatttaatttacttaaattcagtcaactccagtaaggagaatgcttttgaaaatcttcaagaaggaaaaagagtcttgaagtccagcatagagaaaacactggaaaagaatatttagacttcaaaatgcagttgagttcctgggcaaagtaaactataccccagattagtgggagaactctcagatgtggttgcagagctgttgtcagttacattggtcagttatagttatggagatgggaaagtcaagcagaaatgagaaattctgtctgtgtttaaagaaactaaagaatgggccaggccccgtggctcatggctgtcatcccagcactttgggaggccgaggtgggtggatcacttgaggtcgggagttcaagaccatcctggccaacgtggtaagaccctgtctctactaaaaatacaaaaattagccaggcgtggtggcaggtccctataatcccagctactcaggaggctgagatatgagaatcacttgaacccaggaggcagagattgcagtgagcagacatcgtgccacagcactccagcctggacgacagagtaagactccatctcaaaaaaaaaaaaagaaaaactaaaaaatgaattctgaaaaacatgtatcagtaattttatatcaatccccagagagatccctctagaaattactaaacagatagatggtctttgtggaattagaaattaggggtttcaggctgaggcaggcagatcatggggtcaggagatcaagaccatcctggctaacacggtgaaacccgtctctactaaaaatacaaaaaattagccgggcgtactggtgggcgcctgtagtcccagctacttgggaggctgaggcaggagaatcgcttgaacccgggaggcagaggttgcagtgagccgagatcgtgccactgcactccagcctgggcaacagagcaagactccatctcaaacaaacaaagaaatgaggggtttctgtcagaagccataaattagctgtatctctttctccaacagtgcggctgaaacttagagtttataaacatagcataatgagttgt

SEQ ID NO: 35323 - DNA, 1956 bp, Homo sapiens
ttagaaaattaaaataattataggctccctcacctccagcacaaattctgtttgctggaacaagtattattgtgatattagtgaactagcacttctcaaggaactggaatatgtggtgcctgagagaaggtattatatccacacctgtgtctttgttttgggtaatgggaagtgttggctgcagcatttactgagccaagttttgtttgtcctatttttagcatttaattctggcagagcccctcccaaagtcgggggagggagagaccccccccaaagtcgggggagggagagacccccatgtcattctaattgttcacattcctttacaaatcctccagaaataaccaagcaggaacttggagtccacggtttacatttaggttgggaccatttgctccagagggaagggccactgtgttctgtctctggcaagttgcagagtcctggctgaggaaggggccctgcctaacaaatagcagaatccatttctagttgatattaattagatctaagacacacggggctctttgaatgtcaggcttgtgaggaaatagctcttttgcttggcaccctgcaaaagattacaaagccaatgtttaatattagttactattattggaactttatctccaacacagttttacaaggacagctttggggtctcattttatagaggaagaaacagggtcagaagattcaactgagttgcccactcacataggtaattagtcaaagaacaataatttgaatcaaattttgtctagctccaaaatttatgttcttttcaacccagagacaaggaagaacttactgcctatgatagaatggtagttggtggagttacagagctatttatctgagcctcagaccacttgcagctcagccactgtggaactctgggggacttaattaacctctccaagccttggtttgcccattcgcaaaacagaggtagcagtctagactcactaaagttattgtaaggtgcaaatgagatggcatgttaatgtccctaacaattgtaggtacaataaaactgtctttccttctgtctcacagctagtgttttttattgatcacaggcatcctatggcccagtttgaagtaataaatccagttcttcatcagtaggcatgtaatttgcaatggatgctcactgcttttctgtttggatcaaaatacttaccttccttgaaagtttttctttcctagccaaagataaaaccccatagtgaattaaatatgattgcttttcatcattaatggcagcccctactaactcttgaattccagcttttcagtgcaaataaatattgcatcttcattgttgagaagaatctgattccacctttggaaggcacttccttggagataagaagtttcttccataaatcctgcttttgtaaggttgagacccactcaccacattgctggtggaacatggactgggaagattcagagatgtcagtgtactcttttgctctgattatctgaaaggaatgcctgggtcattcctttcaattccctggattagtccttccaaaacagaaagtaaaaggtactagaaaggcatagtcttttttgctgtaaactccaacttaggaaataggatagtttagagtccactacacagactgatctatagagtggtgctatttatagggatgtcagaaaaaaatacaggattaattaatattgattgggatatacttatagtaaaaaagtattcattgttttcctgaaattcaaatttaactgggcatcctgtatttcctatgcttttattcattgaatctggcatccctagccagttattgggtgcctactgtgctgtgcagcaagtcagaaaggtaaggtgccagggagtttccccgggatggagctaagagcacgagttctcaaatcagacgacctgggtttgaacttagctttgctgcttaccagctgtgtaga

SEQ ID NO: 35324 - DNA, 1055 bp, Homo sapiens
aataaatatgactatatttcagggtaaatcagaagagaggcagtctgcagaggtagcatttagaaatcaagcttgttgtggttggaaggcgcagctttaaagaagcgctcagtgagacggcagtgccttttctttgaactgatgactctgtgatgtattaatggtagagccccaccccaactaatggaagaagcaaaagacttaatgtaatttttattacctttaggtaatgataatgtcagaagagcaatgggggcacccccaccatccatgtggggtctgagtggagggtgccctccacgtgagctgggtacctttcagaaccgagtcaggctgcttgacatccctgggaacattacatcctacacggaatgcccacttttaagattgtatagaccaagaattgttgtttcacttaatttttttaaataaataagctgaaatattgactggaggtttttaacacacattctacatattgacttaaggtagacccagtcaacagatgttaagcatttatccaggatcatgttgctatagattttgaagaaattattaagccagcaagagaaggaattttttttttttttttgatatggggtctctcacacagtcatccaagctggagtgcagtggcacagtcttggttcactgcagcctcctcttccacctcctgggatcaagtgattgtcctgcctcagccacctgagtagctagaattacaggcatgcgccaccacccacagctaatttttgtatttttagtagagatggggtttcatcatgttggccaggctggtcttgaactcctgagctcaagtgatctgaccacttaggcctcccaaagtgctgggattacaggcgtgagccacgtgcctagccttttttttcattcataaattactttccagtgtttcatattaaacaccaagacttgattaagttgcagtctcttttataactcaaattggtcatgaaaatatgtctcattatattgtagcagactctaatgtaattgttctcctttcctggtggcggggagcttatgtgatagag

SEQ ID NO: 35325 - DNA, 1047 bp, Homo sapiens
tttttcagttcaaaatggtcactaagtaataaagattcactaaaggtgtaattaattcagtagacatggattaaatctataattctgacctcagaattcacatggcccagatttacctcttaaaatgaacaagcaaaacaaatatggtattataaactcaaaggagttcagtgggatgggggagtggggttgtgagactgcaatatcttgaaagcgttttcaggaatcagatgttgacccaggcttgttccttgtgctcagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacggtgggtgatagagaccttgtatcttccagactttagaaatgagaaactcactcattcatttattcagtgtaaccttctctgacgatcttcaagggttctgaacactcttctgtgtatagatacaaaactaaaaaagactagctgaggtgctaccagttcagaaagtgagacagacatgacctgctccaacacaaggcagcaggcactcttctggtcctgtgaacacagtgctgtgggtgcacacatggggagtgatagcctcagcccagatggggaagagtgggtaagaaaggcctctcagtggaggctgctttgagctgggctctgaagaggtgatagaagttacctgtgcaggtacatatccatgcctggatatttcaagcagagggaagatgacgatgggggaaacacaagggaaaacacagagagaagtaactttgtcacatggctagtaggtggcagggcatgggatgaggagaggctgcagagaagcctcaaagtctgaatgtgagagcagagctaga

SEQ ID NO: 35326 - DNA, 1102 bp, Homo sapiens
ttgtagatttagaaatctgcaactctggattatacaataaagactaagatatggccccttaagatatcttttaatttggaaaaacaacaacatggattcatttagtaatattgaacatcttttaggtgctagatattggtgattaaaatgttcgagacattctttttatctttggaattcatatttagtggtagaaggacatataaacatgctattttctgccagcatgtaaattaagacaacatagacgtgagaatgcttagaacccatttggaattgggctggtttcacagggaaggtggtatttatgctggacctggaaaggttgacttgggaagattgagagcagattttatgggttaagattcagtgcagatttcttttctctttcactgagagcctgtggaagattataaggtgggaatactgtagtcagatctctgtttcagaaagtggccatgtgaagtaaattggagtgtggagagtgttgtcaggatgccatttgagaagctattatatagtaattcctggactgtgtagagggactttgggatgcttttgttagaagaataggataaagacttgtcttggggctgtgcttgcatcgtaagcccaccatttgctgttatgattattgtctacatgcttacttttaactagaataggacagtgacagagattatagaagactgaagccctttctcctgccatccactcagcagcatcacaactaccggcaacagggtgaaaggtctgcagtggaaataagactcaggaaatgatttcaatacataatgcagagagaatcaacattacttcatgtggggggaaaagaatgatagttgagaaaaggctcacaagagactttgagacttggtaggattcacgaaacagaacagtctgattccagatttcaggcatgtagaatgggagggccataggcaaaaaggtgggaaagtgcagaaatgacatgttcaggccccaagggtgcctcaggctggctggagcacagttactaacgggacatttgggtaggatgtagtccagtgagaaaaagttgcggcattggttggatccaaaaatgtacatgggtctaggctac

SEQ ID NO: 35327 - DNA, 1026 bp, Homo sapiens
ttgtgactaagattatattggataaggccataatacagatgatttattcatttggttccctttatttaattagcttcaagtgcaattcatgtgaactcagtgatccacatagcctgttctgaatctgaaaatactaggtcagttgctctttaatccttggaggcttattgggtttttgttttgttttctgctatgtgatgagtggtttttatttttgtatgcacatacaaatgtacctacacatgtgcatacatacacttatgatcaatgagaattcaccattttagttattctgcaatacaggtttttctcaagttctgcagtcccagaaacaaaatgtattattcctaggaggtaggaagaaaaaaatttattatgaatcatgcatcacaaaagaaatatctgccaaatatctatcagtggagccttaaacctttgttcttaatcctcagaggccagaagtgatagaatcattttggaggtccatcttctatttatttcaagtagacttcatgactttaagatagatttcaaactagatgaataattagactaggatgatttcgtatttttcatcattgcagacaacattaaaaagtttgcccaggtatatatttagggcctctggccattaccctaaaaaactgcttgaaatgataattgttcttattttttagaagtcaatgtctaaaccttaagcctatcaagtgttctagtttttagccacagcagagtgctttaacttgcatttcctgaaggattctcatacccaacatcagggttctttgttattccagctgattacacaatcgggtcagcttgtttttcctgctgcatctctgtaaatggggcctttccagaaaatcaacagccaagcccttcctttctcttctgagtgtcctaacacagtttgttcaagctgctgggtaaatagatcagttccttgtcagggtcatgacaaaggagcttcatattatctcactttaataagttctaagacttgaattactgcagcgcatgtactta

SEQ ID NO: 35328 - DNA, 1026 bp, Homo sapiens
gtctgtgtgttgggcacaagggtttcaattggttaattaaatctgtgaattttcttgtttattgacaattgccaaagtaggagaatagagacttgtcttttccctgaatatttctgcttttgatctaacttaattccagataaatttcaatactgattaaaaagtaacaaattacttctgaaattggagaaattgatttcccaaggtaagcagtttcagatatgagtttggtttgcattattacctcacagtctttgaaatgggatttttagctgccttctcaagtctttgtctcctttctaagattcttagacaattttaattatttaaggcagatttgctagaacttataatattggaaactatggtacaaagatgaattagttcttaaaataattctggtttctcccaatgttcatcaaattgagaattttgtggtccacattataaatattcagcataatgtgctgaacattattgtaggctttgagactcccaagataaataaggcagtgcttgtccttaaattgcccagggtctggtgggaggaaaccatactttttttttttgaagtaggaaacaatgtagtaattaccttagtgtaatataagtcaagatggttggcagaacccaaaaaagctaacagttaattgccaggagatttggggggcttgagtgttgagaacattggttgggagcgtgccggagaaaacagggacacatgcattaggtgaccttgacctggatattgagggaaatagaagtttgccaggatgagaaacacttgtacaaagccttggaggctttaaaaagtaacaagcagacaaacaaggctcattaaagaagtgtaaaagttatggtatggctagagagtttgtaggtatgtcagcagctgcttctgaatgtttccatttaattactttctgaccagtatcatgtaagtgttaagacttctagagaatgtatcacttacatctaaggagcagcagccagaagaacaggtggcagcaggtggcctacagaaac

SEQ ID NO: 35329 - DNA, 1029 bp, Homo sapiens
attttacagagcttgactcttttttgccaacaagggaagtggctcatcttttcatcctaggccacgttttagccttgtgtgtttgcactaatcaaagtccctggtgaaaggctgcacaaggttgccttattctgtatcatcttgcattcacctcttcagccccccaggctaatattatgccaagggttaccgattctgatttttgccagtgacctttacagaaagcagcaggagctgattggttaagtggcttcatcatttacaaactcttatagtaggatctttaatgtttcattgatcctatagtattaaaaactgcaattacttttgcaccaacctagtggttcattatttgattataatacatgtacattgtacaaattataaaagtacaatgttttatagtgtatagttccaatagtatagaaattactttaaaaaatatagttttttttttttaattctttttcagagatagggtctcactctgtctcccaggctgaagtgcagggtgtggtcttaactcactgcaccctctacctcctgggctcaagtgatcctcctgcctcagtctcccaagtagctggaactacaggcatgcaccactacaccttgcttaatttttaatattttttttgtagagacaaagtcttaattattgcccaggctgtctcagactcctgggctcaagtggtcttcccaccttggcctcccaaagtcctgggattacagtccactgtacctggcctaaaaatatatttcaaataataaaaaatgtttctgatttctgccatatcaatctcattcccaagaggtaaccattattaagtttaatatgcatctttcctggcatttcctttgttaatataagcacagagtggctggtctcctgggcttttttctttgtcttgcttatatgtagctgaaggcaacaccatgggtacttagagatttaatgaatactcagtggaaggcccatgaggcggctcacacctgtaatcccagtgctttgggaggccaaagtgggag

SEQ ID NO: 35330 - DNA, 1053 bp, Homo sapiens
aactgccaccagttgtaaaaagcatgcactttatatcacattttaacttagcactctccccgtaacaacctccacccagcaaccttcatttaaactaaaacaaagggcccccatcccctgtacagctcttgttccgctggacctgacaggggttcagatgttcctcatagatgaggaatgaatctccaggttggctcctcttgaattccttaacttggaactctgaacacacaatcaggtgcatagaccatacagggtcgttctcagggtatgcttaagttattgctgtcaggttcatctaccgtacaatggtatatctttctgtatcaaaacatagcatgtcatctttcttttgctttttattttttatgattgcacattccattatatggcaatgccatcattttatttactcctctgttaatggacgtttattctatttttcggcatatactataaaactgttgcaataaatagccgtgtacatatgttatttggctaattgtgaaatatatttgtggaaaaaatttcaacaagtgaaatcgtagggccattggtatatgcatttgcaattttgataggtattgccaaattccccttcctaggggttttaccaagttgcacgctcacaaaccatgtgtgaggaatgtctgttttcccagtcttgcaaaacagaatgtgttatcatattatggatttttgccattctgacaagtgaaaatgatatttcagtgtacttctaatttgcattttcttttaagtgttgttgaacattttttcatgtttacaagccatttatagatttttttcctataaattgtacttgctctttgcccactttgtttttggtggttgctccttttcttattgaccaatttaggaactttgtatattaggtacatgagccttttgtgtgtgatctgagttgcaagttttttttttttttccaatttctcttaatttaatggtgtttttgacatgtagaagtttgaatttttatgtagaagaatatatcaggtttttcatggctttgggattgtgagtcacagttag

SEQ ID NO: 35331 - DNA, 1104 bp, Homo sapiens
gcctcagtccacaggtagctgggagtacagacacatacatgatgcccggctaattttttgtgatttttagtagagatgggtctcactatgttgcccaggctagtctccaactcttgtgcttaagtgatcctcctgcctcaatgtcccaaagtattggaattacaggcgtgagctaccatgcccagctgacatatatgcttataaaagtcacttgcagatttttatttctgatgtgcctataacccatttcattaaagtttagatgaacacaggattttataaagtccttagataaatacttttctttttccactcttattcatgagccagatctttgtcttagagagcccataatggttatgcagagtgggcaatagtattttcaaaaagcttagtaaatgtaggcagtttctttagggttaatcatctttcaaagggccttaggaatgtccttcaaacagaatataaatgtcaaagagaatatctctttctgtttgaaattatttgggcaggttgaaagaatttgataaagggaaattctatatttaatctttcattgtaaattatatgtgcaatgaaagagtttaaacatttttggagtttgctgtcttaaaggcctttctggaatgtaaggaaacccagcagtggtgtctgctaaatatgcgaatgtagttcttaacttctttgagactgctttttatctgaaaatgggagtgattcctcctaccacctcacatgtttattgtgagggttaaatgagatactgaaagcaaaaaacattaattaggtttttcaaatttgtgtttattatttttattttagagacagggtcttgctctgtcacccaggctggagtgcattcagcttgatcatagctcattgcagcctcaaattccttggctcaaacgttcttcccacctcaacctccagaatagctgggactacagtacaccccaccatatcctgataactaaaaaaaatttttttgtagagatgggggtctcactatgttgcccagactggttttgaatggctggcctcaaacaatcttccaatctcagccttccaaagcactgggattataggagtgagccaccgcacctg

SEQ ID NO: 35332 - DNA, 1049 bp, Homo sapiens
ggtaatgatcagaatcatggaggcaaagctctgtccaaaaatgttcattttgttttgttttgttttgttttcttgtttttaacatttccttcatcctggtgaaatatcctggaaattcatagatctgggtttggtcatttcaaagctcaccatgcccagtggccatttcagttactgccctgacatccctgaggctaccatactctcaaaaccaaatcaatgccagtgatctaacataggattctttcttatttatgagttttgtttagatggatatttttgcagagcataaaaaattaaatgacatttagttatccattgaatgtatcaccctgacttaaaaaaaaatccttaaatcaaaacttttcaaaaaatctgggctatggagtcactccctctgtggagcgagagcccagtcttttctggtactaaggccacagaggcaatttccagtagcatttttatatcttctctaagtttcttttccttttctgtctgtatctgtttttctctgactgcctatatcttactttgtatacccatacataaattattttcccatcttctctcttcccctttttttctgatttgttttctctcttgcaagaaactctgaaataaccttcagaacacaaaaaactggaggttctatacctacagagtcattatcattattgtgattaccattgttactgttgttggtgtttttcctctttttattgtgtagcaatatccatattcacttctgatgaggcaaacctgtttactataaaccaatgtcctccctaaaggagtcagtttcattttcacttctcacatcaccagttgtatcgcaacccatcttacaaccattgccatgttttcaggcttccttgccataaatgttttctgggcaaataatggcaaagcaacaattccagaatgctgtctagatctgctttctcccaccctcagcatttgaccctcctcattcgcctgagcccccagggttaggatttcttggaaaaacttgtatactgtacctgatggaatgcccattcttcctaact

SEQ ID NO: 35333 - DNA, 1047 bp, Homo sapiens
gcattgttagtaattgtactttagaaaatggttttccttacaaaagcacttgcagtggaacctagaaacaagaagtagaggttggaaggaatggaaactagtccaattgatggtacatttgatttaaaaactggcaccagcacagcggaaagctttgctccaggcaagctctccttgggttttggcttggatatttacacaagagatgaagctaagaaaataggctcatctgtgcttcctctgttgcaggaaacagagtctgattttgacaactgtgcagtttgtattgaagggtacaagcccaatgacgttgtccggatcctgccctgccggtgagtcactaggctgcctgcttttgattgggttgtgtgtgtggagcgtgcctgcgtggcctccctggccccgacctgctgggcatagtgctgccaggtcagtctgcctcagtgtttccatgtttctattgcagacaaccctaacattcttgtttttgtataacctttgtccttgaaaacactgtatcatgaaatatttttctgatcccctatcccctttgcatcaaaggaagtatactgctatgaactaggacttcatgagacagaatttgatgatgtggccgccaagtacaagttttcttgaacaacagatctatgatgttcagaatcaattctggcttttaccagtactattttaattaaaataataaactctgaaaaatattttgtgaatgaacatgaacagtgtggtaattagaatatggtcagaagtaagtaggaagccaaggacagatcccatgccctttcatttttttttttttaaactaacagaaagagaatgtgacactcaaattcccttaaaattcttgcatctaggggaggatgccaggcatgtatagttggggaagctccccaggtgattcttatataaccctattccctctccctaattgaaattcactgagaagttgtctgaattctttttaaattgttaaaattaaataaatttaaatactttaatgaaaccaaatctttttaaagtcatgtaaaatcc

SEQ ID NO: 35334 - DNA, 1030 bp, Homo sapiens
taatttaagcaattattaggcagtagagatatggatgaaatcttaagcttgaattagttgagtaatgacttcaatcattatgttactttctgcaggtagatctagcttgcatgtttatctagacacatgcatactgtgaggtatatgaaaaacaaattgaaaggtagtggtatgaaagtggttcatggggtttaaatttttattctcctcccagtttgttaactttccttgaattgtaggatgctaccatagggtcactcagtgaattgtgatcatgttaaaagttaacactccttcctgatcaaatggacactatactttagccctttgatggatggaataacatataatttcccttagaaaaatatttctgctttaatggccagtgttccactccattcaacagaaagttatagctgtacaggtcatagctataataagcatcaggttaacttaaaccatttatttttattaaagcattattgtccttcagaaagagtgactttcaggttagatgaaggctcacagcctgaaatggaacatcaaagccatttattttacattgtcgaagtatccagccattcaggtatatgaaagagagactgaccttgaattagccagatgagcacctcagtctctgcttggctttgtgcagatcacaattaaaagaaagtcaccagcatcttacataatcatggccactttcatgtcacatgtacctggagaagatcatttcaattcagtttcccatgaagtaatatttgctaaatgttcttcacattataagcctcccagcaaggtcttttagatggtaacatggagaataagggctacaactaaaaatggagagaagatttggctggtgtgccatgtttcctaaagatttaaccaagttaaatctggtagagggtaatagctaaagataccaactttggagtcagatgggtctcgattcaaatctttgctttgataattcctagtggtgtgactttgcacaagttacttcacctttctatgcccaggcttcccc

SEQ ID NO: 35335 - DNA, 1053 bp, Homo sapiens
taatttgtttccatgtggctagtggctacattagacagaaagctttacagaatatctgatgagtttagtttacagaatatctcagtgaatgctctctctttaatacccaaaatacccaaaaaatatcattctctcataaggtcagaggtggaagagaaggatccttgactctcccttcagataggcagtttggtggttttcagtagctgtgtgtaactgcaactatttttgtgttaattgggcgtgaaaaggtattaaagaaaagattctagaactacttatgctgaatgattctcctttttaagttaaaaatgggaggggcaaaattcatgtaattcatgtttttgcattcgctgttttctttctctttgtaaacaaattattaaagagtgatatttaggaggcagtgtagtgtcactaaggcatgagccattatagctggtatttaggacatcagagaactatggagaaagaaaaaagagagaagtaatttttggcacagtcttggtttgggtttatttataagcaggactgagacaaaattcagggccaagccatttatttaaaagttgattccaggaaacacttgtttgggagtggagaaatgcaacagggaaggaaaggagccaataaatcatatgttatcaaggaagtaatgaagcttaatgccactggggagctctgggaaacagtgcagaaaatgtgcagcagagtttcactagcacagtgagggaggaaactgaggtatttatacacccacttttttagtcattagttcatggctgctcctaggtggtagcaattcctcctttcccttggcccacaccaagtgagagtgatagtcagtggtccagaaagtcacttaagcaaagaaatacaggtgctggcaattgaaaatcaagacaatgtgcactaaaatgtatgggataggggagtgtaatggacagcatctgttatagacactttttgatttacagtgtagactgtatcaaacaaaggacaggaaggtatgtttcagacctttgtagctttttcagaatacaaactcagttg

SEQ ID NO: 35336 - DNA, 1032 bp, Homo sapiens
actgaactcatggagatgagataggaggcgggacacaactccagaggcagggttcagacaccagaccaaattgaggattagctaaaacagggatggggcggaagcagctttccataagacacgtccaccattgtgccatgtcagtttaccattccctagaatggcaacacctagaatttactgccgctttctatggcaatgacctgatgacccagaagttaccacccatttcctagaaatttctgcataatctacaccttagtttgtatataactaaaagtggttataaatatgactgcagcactgcctctgagctgctactctgggcacactgcctatggggtagccctgctctgctctgagccgtacctctgctgctgctgtacattgccatttcaacaaaagctgctaacaccactggcttgcccttgaattttttcctgagcaaagccaagaacattcctgggctgagttccaaatttggggttcacctgccctttatcatagatagagagtagaatgatggttaccagaggctggaaagagtagtagggttggagtggggatggttaatgggtacaaaaaatataattagatagaatgaataagttctagtaattgatagcacaacagggttatcacagtcaataatttatcagacatttaaaaattaataaaatagtataactggaatgtttgtaacacatagaaatgttaaatgctgaagttataaatacctgtttaccctgatatgattattattaagcattgtatgcttgtatcaaaatacctcatgtacctcataaatataggtacctattatactgtgtacccataaaaattaaaaattaaaaaaagacttatagattgaacataaacttctatccagatggtccagggaacaccagaggcgtagcaacttgggtggaaaatgcttcctgccttttactctagtgagcctagcaagcaaatcatttcatccttcagtgctgcctgtgctcagggaatgtgtaaaaccttttttcattttgt

SEQ ID NO: 35337 - DNA, 1023 bp, Homo sapiens
taaatttaaccaagaagataaaatacttgttttctgaaagctataaaacactgatgaaataaattgaagaaaacacaaataaatggaaagatatcccgtgtttatagattggaagaataaatgttgaacaggtgttcatactacccaaagcaatctacagcttaaattcatatggaatcataaaagataccaaatagccaaaacagtcttgagcaaaatgaaaaagtctggaagcatcatgccccctgatttaaaaacattatgaagcaattataatcaaactgcacgatactagcataaaagcagacacatcaatcaataggagaggatagaaaacgaagaaataaacccacacctttatagtcaccttatttatgacaaaggtgaggaacacaaaatagggaaaggacaatctcttcaataaatggtgttgagaataccagatatccacacgcagaagaatgaaaattgacgcttatcttatgccatgtcaaaaaaatcagctaaaaacagattaagaacttaaatataaaacctgaaactgtaaaatactagaaaaaaaaacataggggaaaagcccatgacattggtctaggcaatgatttttggatatgatcctgaaagcacaggcaacaaaggcaaaattagaccagtgggatggcatcaaactggaaagcttctggacaggaaacaacaaagtaaaggaacaacctacagaaaatatttacaaactgtacatctgataaggggctaatatccagaagatataaggaattcaaacaactcaatagcaagaaaacaacctgattttaaagtgggcaaaggacctgaatggacatttctcaaaagaagagttgcaaatgtggccaattggtacctgaaaaatgctcagtttcactgatcattaggaaaatgcaaattaaaactgcaatgaggtattacctcacacctgttaaaattgcttttatcaaaaaggtgaaagataacgtgttggagagaatctggagaaaaagaacttttata

SEQ ID NO: 35338 - DNA, 1046 bp, Homo sapiens
acattgaatttaaattttaaaattatacttgcctgccatttttccctagacttccccccccgagcttgatattgtattaattgctggccaccttaggtcagtgtagcaattcaggaaataaatttgaagagcagtaataataagtattgtgagtagtaagtaatagcgaatgacatagtccttcctctttccagagtcctcttcgcctgtgttactatctcattttattttgcatcccccatgaaatggaagcggggagattattgccactataaaaatttaaatactgaggcacagggatctcagaaagcagataagagttgatctgtgatattttactctggggatgaggcctgtgctgaaacctttgttttggattggaaacatgggttaggaagaaagcaaaggagataatgcccggtatctgtggcttaccccttgtgtgcctatctctgggatagtcactgccattttccttgacccttcgcagaaaactgatgaaagactggctgtagccatgaagagtcctttccccttcatccaagcctatttccacttcttccattgctcctttttacttctgtcttctacttggtaccatgtccctggctcacctgatgtagctgggattaacatgatggctgatcaggccgtggtgccgtgactaaatatgatgccctgagggatcacagataatggaacttgtgtgggtacttcctctagtgatggtttacctatcaagcaaggtagatgacattgacaaactatagctgacaaatatagcatgaggtgggaatttccagtgtagaaagcatagtgattcaaaagaatataaaataattgtttttaaatatggaagccttttttgttttgagactttgattctgggaggtgatttagctaattcaagaagccagactgaatatgatgctattctgttaataaattatagtggtgcatcaagtacaaataagactgagaactgaaattacttttcatagggatggtaaattcaatgtgcacttttcacatctacctgtctatgt

SEQ ID NO: 35339 - DNA, 1049 bp, Homo sapiens
ggagcccacttcatctctcccttctctcttttaatttgcaaacaaattttttaacatttattttttatctcacatataattaaatttattttttgtacaggccgatgagttttcataagagttacatagcaccatcacaagcaagatacagaacagttccatcagccccaaaatgcttttgtgctgcccgtttgcagtcacatatgtagccttttgcatctggcttcttctacttaacataatatatttgatattcatccatgttgtatcaacagttcactccggagtagtatttttctgtatggatgtgccatagtttgtgtattcattcactcattgaaactatttgttgattccactttggggccattatatgtaaagctgctgtaaacatttgtgtagagggtcttgtgtgaacatgttttcattgctcttgggtctgctctcattttgagtgggtataacacattgatttctatcccccttttttacttcttctcccccaatatgatagaaggaggtgtagtgagtagagctgaaaagtgccacaaccctaaaccaggtgactttttcaggatcatgaccagccacttctcaagcttaacccttgaaacttacattttaggatttgggaggcaagaatagcaattccattgatatcaagtgcctggaatggggatagaatcaaagctgccctgcaaacaggatcgtctagaccatgcgagaaactgcccttcactagcataggaatatattaaatattttaaaatgaatacaatttaaatgaaaaaaactaaactatttagtatttactatttgaaacatttttgtgaataatatttgcattgtataggcaatgtgtttttattcagagacaagtaaaggtctcaaaagggctggttatgtcagtttgatagaattttcaaagatggtcaggaatgaccatcttttataagggaggtcaggaatggaggaaaatcaggatctacccacaaaggtgctgaaatttaacaggtaagtatgtgcaggaggaatactagatgaagaac

SEQ ID NO: 35340 - DNA, 1059 bp, Homo sapiens
taccacactgtccaacccaaattttgacaaagtgaatctttatttcaccatcatttcacctctttgttctccaggcttattcctaagtatacactctagttcatgtgacctctgtactagaattgtctgtgagatgcttctctgctgatcagaagcctgcgcgtcctttaggaccaattcagttctcaggcatttgagagcagacttgctgggggaaaaaagtgtttttcgttattttgaaggtccattttgtttccatggttgacataatttaatactgttagagttaaaatagttattgacattatttttgaaatattgtattcctagtatttaccttggttttgaattaatctattttctctgcagatttcctcttttaaaaagggtaaaactctttatttggttttgtttcctgagaaaaagttatatcctatatattcgtcatctttcagaatatatagcttgaacagatattttggaatatataatattgctacaaatccgggtgaattataagaaaatgttttcagttatttgggaaaatgtaatagtactcaaggtcgtggaaacggttatctgctaagctgatattgtcattaaaatgatgaacattcaagagtactgaatagtatttgtttgtcatttatttctggtttgtgcctaggaatgaaatgggtgtattctatttgaatatgcattctacttaaatttaaatatcatgattcaaattagggacagtattacccacatcacattaaactatttattaagaaatagaaattaggtgtatatgtacagacataggattgggaggcaggggtataaaatctgttaacttgattttcttttacatttccaaagagcataattttaatctttattcagtctccatttatgcatattttagtaaagctttattcagttgcctttgtagtttccatagatgcccagaaaggaatctgagtcatgtgagggatttgaaccacgtagctttgtgcatattcctatgaatcgtgtgtacacattctgccactctgaccagtgggctttacaacc

SEQ ID NO: 35341 - DNA, 1029 bp, Homo sapiens
tgtttgaggcccccagctattccagactgaggtatcagcccacatttggcctccaacaatttcttaaaattgtagctgatttcttcttacccactcttggggtgggtggcccacctttgggtgagctagtttgaacatgtcttttcttcttagaggagcctcttcctccttggaattcattctttttatttgctctatgtcctcaactctcagctctctgatagggtcaacgaaacttacaattttatagtttttttctcgttgttaagtgggaacagcactctttcctgctttccaaatcatatgcagaagcagcagctccattttctagcattttggttctatttatttgcttttcattgcatacattagatacatactttattatatagataatgtttatctggactgtcacatatgtttaccaatgcttgatgacttcttgtatctcagaccatttggtgttattttgcatctttttgaagtttactcttgaaatttctctgctgagagtctgtgggcaaatgtctttgttaaaatgtccttacttcctgacagataattttgttgtctcttttaggggctggcaaactacggccatgtgggccaaatctggcctgaggcctgtttttgtacagccccaagctaagcatggtaaagtgttatttttactattttaaaagtggtattaaaaaacaaatccactaccacggtaacaacaaaataagaatatgttacagagattggcctgcaaaaccttaaatatttactatttggccctttgcagaaaatttactaattcttggtcatattctatattaatagttactcttagcattttaaagacaatattccattgtctttcagcttccactgttgctgttgagaaatcaatatacagttactagtcactacttggtagaagtacgatttttttctctggctactttcaatatcttccctttgtgttagatgcctttcagtttcactttgaatttatgggtgtagatcccattactcaggaaatcc

SEQ ID NO: 35342 - DNA, 1027 bp, Homo sapiens
aactcttcctggaagttactgcttttcttaggaaagacttagaagcaacttagagatgttgattaaatatataaggactagaacataattaccacactaaagagctaggcaaatagcatttgggtaaagaagcaaaatctgggtatcaagtgggaactcctagtcccttgaggtctagattatgttgattttaacctagtcctataaaagtagaaatgtttctgtaaaatttttttagcattctaaggggcttatattttcatgtttatcagttatcaggagatcttttgcgatgtctctttcacactgcattgatcaaaacctaatcagctttcagagacaggtacacacacactccaaaccaaataccctactaaaacatacatagtcacaatcacagtatcatttaatgtatagaattttattgaaaatctgagggttcacatcacatactgtatggctcaatactgtattttagagttccttgttcttaaaggttttttttttatatatataacttggatgttttgaggggccatcccactctttaccatcatgtcaaatcactccctggtctaaccttgtgttcagactgacatctctaatctctcatttatccatctactcccctgaaataaatattttgcctcaaaagtcaaaataattactttcttatttagtttctcagcaggagaaactttccaggagcccaattttcctcacttttggtgaagatacacatggttggggtgaagtttccatggtggccatgcaatactttgaccattagtcaccagaagtttctttttgcccttctcctgtacagagtccaattttgtttcccccagcttctctctcctccctgtctcttctctttctttttctgctttctgagccagaaaaatgccttttgatccagatcaatctgatattgataactgatcaatatcttctgatccgggaggtaaataatttctctactgcttggttgcagagcactttctacctttttcctgaagctctagat

SEQ ID NO: 35343 - DNA, 1040 bp, Homo sapiens
ccttgaacaagtcacccagcctctctgcttctgtttccgtgtatgtaaaatgcaaataatagtaataataggaccaatatttttaataggattctagtgagatgtaaatgggttatgtatatgaagcatttacacacatatataaaaaatgctataaaagcatttgctaataaagcaaagcaataggtagcactagaattcacacttattttaatccaaagtctatgttctttataatgtgattctctataactgtgattctgcatgctaactaatagttaatatgatgtggtagagatcactttaaattgatgtcatcctttatttctaggaacattagaatgtaagataaagtgtttatttttcattgtgtttatatttatcctcaatttggacattggccttagaatcttaaccttggatatttttcaagtgaaagaatagagatttaaagattatactctaagattatactaaatatagcagtctatatttgacatagtgctttcctctacctgatttcatttgattcttagactagaacattgtaggtggaaaagaacattgtagatggaaagactagaacattgtagactagaatattgtagatggaataatatatatatattattttttttgagatggaatttcgctcttttcacccacactggagtgcaatggcacgatgtcagctcactgcaatttccgcctcccgggttcaagcaattctcctgcctcaccctcccaagcagctgggactacaggcgcccaccaccatgcccagctaattttttgtatttttagtagagatggggctttaccacatcagccaggttggtctcgaattcccaacctcaggtgatccacctgcctcggcctcccaaagtgctggtattacaggcgtgagccaccatgcctggccggaagagatattgttatgtcatcttacacatgaagaaattgaagtttgcagagtttgactcctaccttggctagcctagctaggactcaaactcacatcttcttactcttaattcaaa

SEQ ID NO: 35344 - DNA, 1038 bp, Homo sapiens
taaggtctgttttattgaagactaggattgcaacccctgcttttttttttttttttaactttccatttgctaaatattcctccctccctttattttgagcctctgtgtgtcttcgcacatgagatgggtctcctgaatacagcacaccgatgggtcttgacaaattgacagaagtaggctcagaagcggggtaataacaaactcctccaagctaaaggaacatgttctaacccaatgcaaggaagctaagaaccttgaaaaaagattagaggaattgctaactagaataaccagtttagagaagaacataaatgacttgatgaagctgaaaaatacagcacgagaacttcgtgagacatactcaagtatcaatagccaaatagatcaagcggaagaaaggttatcagaaattgaagatcaacttaatgaaataaagcgtgaaaacaagattagagaaaaaagaatgaaaacgaacgaacaaagcctccaagaaatatgggactgtatgaaaagaccaaaactacctttgattggtgtagctgaaagtgacggggagaatgaaaccaagttggaaaatacacttccggataccatccaggagaacttccccaacctagcaagacaggccaacattcaaattcgggaaatacagagaacaccacaaagatactcctcaagaagagcaaccccaagacgcataatcatcagatttaccaaggttgaaatgaaggaaaaaatgttaagggcagccagagagaagattgggttacccacaaagtgaagcccatcagacaaacaccagctctctctgcagaaaccctacaaccagaagagagtgggggccaatattcaacatgcttaaagaaaagaattttcaacccagaatttcttaccagccaaactaagcttcataaacaaaggagaaaataacatcctttacagacaagcaaatgctgagagattttgtcaccactaggcctgcattacaagaggtcctgaaagaagcactaaatatggaaaggaaaaactggtaccagc

SEQ ID NO: 35345 - DNA, 1066 bp, Homo sapiens
tcatctactcgctaacctgactttaaccccttataaggtacctcctgttaggcccttaccagctgctgagaatagagaagtaggaaaagggtggtgccctgtgccctaaatccttgggcttctgttcagggatggtgggaggtctggagcaggaagccagttgttatttttctgagatcttctattatcacgccagtgtttctaaagaggcctggatgctacctgtgagtatttacaagcaaatcctttgcttaggaggagctttcttttggatgtcagcagggggactttctatagataacagaatggatatgtcctttggagtcagctgttatcaaatacagaaagtaatctgagaaaagtagttgagcatagtgctgcctggatgatcttactgggatatgggcatgtggtagaccagatgcctcaaggggccctgactgtggctagaaggaattgtatagtttgatggtaaatcctacctgtctagatgtgttgtatgaatctgtctctttgtatatggactgcttcattccagaagaatgaagaatttaaaatcagtgggccagaaacaggttgtcagaattcctctaaatgaaggaaatagcaaacggcaaatgaccagtaaagtaggtcaggttgtgaccttttgagcaatgagagaactatgagagaaatctcaagttttctccttaaaccataatgtcattagttaaaagtagcattagccttttgttatagtaattgaagtgtgctccaaaatgaatttaatctcgtgtgtatatggctgggtgcggtgcctcatgtctgtaatccttgcactttgagaggcctagacgagtggatcacctgaggtcaggagtttgagaccagcctggccaacaaggcaaaaccctgtttctactaaaaatacaaaaattagccaggcatggtggtgggtacctgtagtcccagctacccgggaggctgaggcaggagaatcgcttgaacccaggagtcggaggttgtagtgagccgagatcgagccactgtactccagcctgggcgacagagtgagactctgtct

SEQ ID NO: 35346 - DNA, 1035 bp, Homo sapiens
actttttaccatctggctcttggcctgccgtgttcatttataattcctacctcaaccccaaggtcacagtgcatgggactccatctttatgtagccaaacttggggtagtgaggagatgttacggaaacagacttggttcagcacaggaaaaacaaattcataagaatagaagtgtttagaaatggaagaggttttcttgaaagggtaagctttctctggcattcaggttgaaactgagtgggaacattgtggaattgctgatcccaggatttaaggatggacttccagtgggtgacagctttaagggccttcccaagcattgagagtatgtgattctctatcacttagatatttaagaaacatgttttttaagagcctcagttcccacttcatttttctcacaagatacatgcagtctggctatcatttatgcttggtcttgatcttccatgccaaaataatctcaccttctcacttagtatgcatgtgtgtgtgtgtgtgtgtatgtatttattttgcactaaactgtaactcttcacctgtctactagcagaaattccaatagccaggaattctagactctgttattaaaagccataattcatcaaagtgttaaataacattcttggcagtgtagcttaagatgacccgggcaagaaactgtatgacttgtttatacattttaggtcatagaagtacatatctagaggattgggaaggaaacttaccttctgtcttctaatctttaataagaattcaatcatcatctctcctagtggctgtgtcttaaaaatctcctggcttctcaaaaaggaagtaattttataaccatgaaatctggaaaggtccagaaagaacctggagcttcttatttatagctcattcttccagttttcagaaaacagtgattgtgcctctgatatgaagttaatttgtttagaaaaccagtctcaacttttgaaaagttaaccgttattgttgcttaaccattattgttgcatttctggacattaagcatagcatataaagaattt

SEQ ID NO: 35347 - DNA, 1030 bp, Homo sapiens
acttagttttcccacctacctttgaagtgttttccctaggtaattttgtggttcacttatttccttctggtctttatgcagaaatgtcacctcctcactgaagcctttcctgcaaccctatctaagattgcagtgtctacctcagagctttctatcgcctttctctgcattatttttgtgattagtacttgtcattgttcaatgttatatatatatatatatatatatatatatatatatatatattttacgaatttatctcatttgtggtctattttcctcactaatattaaacttcatgagacaaaactatttgtctattttcgttccctcctttatccccagtgcctgaaacagtctaagtcagaaataaatgaataaattaagtcaattttactttaaagaagtaaagctaaaaattatctcatagaagacagaatatgtggctgcgtataactccataacaattggtggatcaataaataagatggcatgtagtgaagagtgtaggactgtggaagaaaaataaagaaacttacagaacaacttttgaagtagtcaaagacaatgctattagagaaaggataagtaggaaccaaataatcaaatcaggtgaaaaatgagaaaacccaataagtaacagccaaaaggattgcttgagacaggaaaagtcctcccattgagcacagcccttctttgcctgcagcagagatgatcagcttcctgtcaggattaaagcattgttaggagcatcctccagtgaggcacgggagaggcttagtttagttcagcccctgccttacctcttctattagtttaagatctgtgttgtattggaatgcagcgtagcacaagtgaccaaagggactgtgatttctacaaaaggaaagaaaatgtcttactgatgataccagcaaaaatagtgtaagtggaatacaaatacatccccttctgaaaacctgcttttctcaggccatgttgctcctgttctttgaagtactgttttcattgtagtttatcagcagtgctc

SEQ ID NO: 35348 - DNA, 1049 bp, Homo sapiens
gaggaaataccatgtgaagatacatgaagaagacagccatctataagccaaggagagaggtctcaggagaaaaccaacctgccaactccttgattttggacttctagcgtccagaactatgagaggataaatttctgttaagtcatcccatatttgatattgtgttaggcagccctagcagactaatacagcatctaacaatcagagaaaagttggacattcatagaaaaataagatagtcacgaggcaaatctcatcattacgggtttaagcatcactcaaggaagaaagaccacagcgtgtgtgtatccatcttgttgacaagattttctgtgatgaagatgagatgaattcatcagccaatctcagcctgatgccctcacatcttcaatttttgtgtcattcacaaaataaacatcattatgtatatggcagacaaacttctcagaaggctcccataatcctcagctccggtatttgcacctttgtgtggtttttccctctcctagattgtgagtagaacctgtgactttcttccaaccaacagaaattggcagaaggacaggactcacatggttacatgagtgtaacatgttaagtaatatgtgtttatgttgcatgagatgatagcatccatcttgctggcatctcttttgctagttttgagaaagtaaacagccatgttagggaacccatgtaaaaaggaactgcagatgacctctagcagctgagggcatccgctgaccaacagccaaaaattggtgatttccaatcagaataagagagaaaaagccagcatttattaagttcaaggcactattctatatgacgcacaaaagcaaactcaattctaaaaatggatacatatattatgccccttttacatatgagaaaagctagcactgaaggctaaaataacatgtacgtttttataactggtaaatgataaggctgggactttttgctgactttcatatagcaaaatgtctttcacaatacaaccagtctcaatccacgactccatgaattattttcttctttctcttccc

SEQ ID NO: 35349 - DNA, 1059 bp, Homo sapiens
cgttgtatttttaaaaagggtttatttaaactctgaaaaaattgctaaatttagaagtccacagtgtttaactattataaaagatacaatattgcaggtggagaaactctcaaacattacctactactgtgattgtaacctatttttcaaattctaccacatcttgtttatatccattttaagagcttagtatcaggaacctatttaatatatgactaaaattgtttatgctgtaattaagctcatttcttcttgtgctcttctcctgcagaatacaaacaatcggtggttatagttggcatgttgaaatttattttattactgcccatatgtttttatgttcttattgataaatgtaaacctccctggtattgtaggacttttcttagttcagctaaagactgggttcttgtccatcccaaggccacaaaaatttagcctcacagacagtttaaagggtgagcaaaatagggttttattgggtgaaaagggagaaaaacgggtgggggaaacacctgcctggcgtttgaatcccaggtccacacaggaagacgacgaggcaggctcctccctgcttcaaatcgtgtgaacttcccaaggctccaccccagtgcgcaggctgcttggagtttctccaggaatcccctcccactggctgtctcattcccccctctaaagaagtacatctaactgtggttagattaaggataaggatgaagactgatcttaaccgcttcctgctgacagggggcgctgttttggggaaatggcagaactccctcagaggctgatctaagggttcccggcagaaggggccatcttcagaggctctggttgcatgactgtttggagtttgatggcctgaaggtaagaacagacaaacccaattattagaaaacatgtatcaaagtgaaacaaggggaggggtaaggacagctcaaaaatcctgaggccctttaccagtttgcatggagagagggaggccaaaagcctgactagttaaaatctttacccttttggtggcatgttgggcttctgggtttccttcccctgggccca

SEQ ID NO: 35350 - DNA, 1026 bp, Homo sapiens
tatgaatatggtacatctatccatttgtttagtttcctttaatattttgtaaagctttatagtattttcagaaatgcattgcatatattttgttaagtgtaatcttaactactttgtggattttttttcatgctattttaaagtagcatctttattacattttctgactccttgctgctggtgttttgaaatgcaattggttttatattgttttgttttcagtaacccttctaaaatgttttattaatcctagtaacaaatagaaagtgcttagctctgcaccctattcatttattttttcttttgtttgatgtttgaaatcacagttttatatgcacaattgattaaagtgcttggtattactgccatcctttgactaggactttgaggcctctgaggaaaatccttacagatacattttcttacttgcagggcttgaaccctagctgctgcaacaagcatgtcatttgctttgttttgccgtgaattctttttgttccactgatcgttgctttggaatatgcatcctgctcatagttctgcttctctattcagcttaacactaactgagtttctattgtgggtaaatattggtccatacagtggattggatgctagggatacaagaatggacaagtcagttcttgtttcctagtaatttagagtctagtggactttctggctgacttgttccttattaattgtttattgctaagggtaatttatcttcttcacgaagttccacttctgatgggcagttactagaagcaaaacatccttgtgggtattccatatgtttttatcttggggattaaacaaataaacgtgtgtaattgatcggcccatccctgattctgtagcacttttgtcatttgctctttacttcagagggtatcttgggatagtcaaagacttagaagatgagtatttcgatggaatggatgttgggtcttctacctcctgagtttggttgccaatgtctatctagtaaagggagcatcagggccaagattggggtatagagaa

SEQ ID NO: 35351 - DNA, 1115 bp, Homo sapiens
ccaggttcaagtgattcttttgcctcagctccccgagtagctgggaatacaggcacgtgccaccacgcctggctaacttttgtatttttaatagaggcagagttttgccatgtgggctaggctcgttttgaactcctgacctcaggtgatctgcctgcctcagcctcccaaagtgctgggattacaggtgtgagctactgtgccctgccagcttctgtgtgtctttaatttccattactatgtcaagtaattctgaatatgtacatagaccaagtgtctcatggaactctagaatcacatatctgcctttttattatctccactttaataatttcatgaacgtttcaaagttaacaccatgagatctaaattgataattttcattacgtagacctctactttcaatgtttcatacctcaataaagagcaccattatttattggcaacttcttcaagccagaaaactgttgtccttgatcattctttttgcccactccatatttttaattagttaccaaatcttatactttctatctcttaactaatgaatatctctactcgctatgtaaacggataacatcttatactaagtttcaatcatccctctttgggactattgcattggcctcttaacttgtctttcagtatacacacttactcctttccaatctatcttccacattttaacgtaacagcctttaaagtgcaaacctaatcattgtctcttcctttaaagacttttagtagtttgttactgtctttatgacaaatcaaattcctcagtatggctgataggcaggtaggatccatgagggcagagaccttgtgtcttgtctgcatctccagtgcctattttagcacagtatcgggtaaaaagttggtgctaataaacatgggatgaattaataataactataggatcccatatagtttgtgctctatttgtatcaattagcttttgctatgtaacaaaccatcccaaaatttaacaatttaaaacaacaatgtatttgcttttaattctgtaggtcagctaggcatttcttgtctgggctgtcttggcagatctctgaggttacctggcagcttttctatggctggatagtccaagaaaa

SEQ ID NO: 35352 - DNA, 1061 bp, Homo sapiens
cataagcacctacatcagaaaagtagaaaaacttcaaattaacaacctaactatgcatcttaaacagcctagaaaagcaagagcacacaaaacctataattaatagaaggaaaggaataataaagatcagagcaggaataaataaaatttaaattaaaataatcacttatttggtcttctgtcgcctgtgcacctaacttggttcttgtctttattgttccatgtcctctgctccatgaggctcaagcaactctgtcaaagaccagtgattttgtcctcctgtgacctccaggtactgagagatacttgagggggtgttgtaaggacatccagaagctgggaaatgaaggctgactagatgcagccaggtgaaacagctgtcagtgaggcaccaagacgactggagtacttctaacagatcttcagagggaaggcactgagagtggatgaagggaagacacagaagctgggctgaaggggaagaaagctgggaagcctacctggggctactggacacctgaactcattcctggcccccaatggctctggggaaacggatgagttgaactgacaagcagtaaccttctcttgctatgggcctctggaatactggcaggagactgcccaaccaccttggatactcaaggtggcggggagagctacttagagaagtggtaggagcagcaaactagttgatgtggagcccagagggtttggtgtggaagcatctgtagtggagcatgactagggatggccatctccctaggctctacttgctcccacaggagactttagccctagaggaactattggtcctgaactctgcagggcagtctagcccatcagatgggccagtctgacctaaacaccacttgttctgctgtctctcttggggccccagctgggccacacctgcccataggtggaagtctccacctatggagaccatgcctaactggcagagtgcaccactggggcagcacccacggcccctcccaacactgcagcttctgcagggtccacggcaactccccacattgctttgctggtgcatgtctgca

SEQ ID NO: 35353 - DNA, 1050 bp, Homo sapiens
ctgacaacaagatccagtctatccagcgagtatgctatttccaacttgggaagtaattccagcattatctggaatagtaataggttgaatttgaatcgtattctttgctaaaaaggtccttttaagtgtttttgcaataaagttatctgctgattttatttttttgttcatgtgaattacaagtgttgttatttggtgatcttgttcacttacatcttttaatactaaaatatgaaaaaggaagaaaagattgccatttagagggacccaggtccctttgaatgtctacttaggcctgacaccctgcttgattccttgcataaactgtttctcatcctcacaacattaaaaatagttaacatttactgagcactttctttgtgccagtcacatgatattctttatgtaatatttaattcctacaacattcctacaaaataggtcttattatctctctttcagattggagaaaacagcttagatgaattcgactaagtaatagaactactaaatagaatatttatctttgagtaactctgaaataactccccctatatacgtatgcatgtatgtacgtgtatgtgttagactatctttctatcatctcttctacataatattgtctagtatcgaatacctcatagcaataatttgacatcacttgggcatcagaaagattcatgtcactgttacaatacgtaggtaggatgtagctgcttcttatttacaaacagtagctaagacaaaaatataaggaatggatgagcagtcgaaagaaagctgggtgattaggacagaggagtggttggagggcagaatgctataagaaatcagctgcctgaggctaggtggtagaatacttattgatgttgatggtatgtgtggataagttaggtatgtagcctctggttttatgttttctgccataccaaagacaaaaggacaatgttgtcctgggatcctcacctttgacctaatcaaataaaatcttctctcttcacttcacttgttagggaagaggggtgatgcaggaaggagacaaaaaattaa

SEQ ID NO: 35354 - DNA, 1068 bp, Homo sapiens
aagtaatggcagggtctgaaaggaccaactccaattttgaaagttttgccttaagtaaaatactactaaacagcattgcatgctacagatgaattttccatgaaaggaagagtcaatcattgtggcaaccatcattgttgtcttattttaagaaatttctacagccacccaaaccttcagcgacaccaccctgatcagtcagtagccatcaacattaaggcaagaccttacaccagcaaaaaggttatgactcactaaaggcccagatgattgttagcactttttagcagtaaaacattcttaaattgttttcttagatgtaatgctattgcatacttaatagactctagtatagtgtaacacagcttttatttgcactggtaaaccaaaaaatttgtgtgacttgctttattgcaaactggttgaaagtctacaggggccttccccgagagaatttgagggttcagtttgaaactgtcacaacaaatgaaatcttcatcgtgtaaatttatttctgcattactacagattatataggtaaaatatagttagtgaggcaaaggactgttcaagataaagctgaggaggtaagcagagaccaaaatcatgcaggaccgtgtcaaccattttaaggatgtgttattttataacaaaaatccttatacttcctgaaggctaacggttattctgactctaggatagattactttcactaaagttttgtttgcctgttgttatttgttggttttttttcactttgcatagatggaatcatattgtgcatactcttttgtgtctggcttcttttattcagccttatgtttgtgacagtcattggtacaattgggtagttaacaaatggttcatcctcactgctatatagtattccatgttgtaaatgtactccaatttatccacttgactattggtgtgtattttgataatctggctgttataactagcattaggagatatacctaatgtaaatgacgagttaatgggtgcagcacaccaacatggcacatgtaaacatatgtaacaaacctgcatgttgtgcacaggtaccct

SEQ ID NO: 35355 - DNA, 1011 bp, Homo sapiens
caaaattagctgggtgtggtggcacatgcctgtatcctagctactcaggaggctgaggcaggagaatcgtttgaacctgggaggcagaggtgcggtgagcccagatcgtgccattgtactccagcccgggcatcaagagcaaaactccgtctcaaaacacacacacacacacacacacacacacacacacatacacacacactaaaacaaaagcatacaatagtttgcttttctatataatctcatgaaattaagagttttcattacatctaactgtttatttctttgggttgttaaagatccaagagcatgggctttggagtcatctgctggagtttgaattcttgctctgccatttaaccatgaaccttggaatgttagcctcagatttctagtatctaaagtgaagattaaaagaatgtaccttggctgagtacagtgacttacgcctgtaattccagcactttgggaagtcatggcaggcagatcacaaggtcaagagatcgagaccatcctggccaacatggtgaaaccacgtctctactgaaaaatacaaaaattaggtgggtgtggtggtgcgtgcctgtagtcctagctactcaggaggctaaggcaggagaattgcttgaatccgggaggtggaggttgcagtgctccaagatctagccactgcactccagccaggcgacagagcgagactgtgtttcaaacaaaaaaaaaagagtatacctcatagggctattgcaaggctggaaaaaaatcaatacatctatagttcttacaactgtgcttgccaaagaaaaagtgcttccaaaatgtttattgttatttattattatctcatagaaaaggaaaaatctaaagcaagaaaacttgaatggagtcagccttaatcatgtctctttcatccactcctatataattcacactacttttcttcccaatctctttcagaattccacatttccacaaagcatatttagattatattgaagtcagaattgtgcatct

SEQ ID NO: 35356 - DNA, 1023 bp, Homo sapiens
aaaaagtaaagctgactttataatatggatgactttgaattttacttcttagcccttatactttctatgcaggatgtatttttaaaaagaaatacaatatttacaggaacaaatttatagagtagggagtataaatgggcattttaaaagttatttatatacatcttaactgccatgacttttagccaagccagtattttcaagaaagcgctgtctatcctaattgcacaaatatttttgcagacttttccattaagcagtgaatgaagccctgaaagtcactgtagccaatgtgaaggcagaggatttgagagtagtaatggatttttagaaatgcttagggtgcgctcctgtaacagggcatttgcttttagggcagtttggcccaacaattgaacaaattagttatgtttgaaaatttataaagcaaaagcatagataatcataatataatttttgctagaacatatgttaagttggcttattagatcagatcgttttttaaaattacagtatgaaaaagttattcaacttattttaaaaattcttctttgcaaagaaattgataccttgatacccatggcattaagacagctttttacttctttgtgggctggcataatggacagacagtactttagccttggaaatcaggagtattgacgtgtgacattttagatgagtatgtgtgtatgtgaacaggtacatgtggatgcaagcatgtgtgtagaagatcacgtatacattcatatatgtgagagtgcatttgggttagaagtgatatgaaaaaaagtggagtattgtatcttagtaaacttttacttcattaatctccttcaagttgttgatcattaataattggatattcttttgtagaatggctttggaacttggcagtattctgtaatccagttttacaagatgacatggggagatgaccagggaatttactcatattttttttaggccgagtgatgttgatagaccacagtttggcaaagtagacagatctggtttcagatc

SEQ ID NO: 35357 - DNA, 1039 bp, Homo sapiens
ttattttactaatttttaaatttagttttttaaattgacagaaaattgtgtatatttatggtgcttataatgatgttttgatatttttatacattgtagactgactaaatcaagctaattaacataggtaatacctcacatatatgtcattctttgtggtgtgaacgcttaaatctgtcttagcaattttcaagtatacaatatattattattaattgtactcatagtgatgcacagtagatgacttgaacttatttcttatgcctcaccgaaattttatgtccttcgaccaacatctcccaactgtcccccttactcccagccccaggtaaccatcatcctactccctgcttctgtgagttcaactttagattccgtgtataaatgagaagatgcagttcttttttcactccaattttttaaaatgttacttaaaatcatattttctttaacatacagtttttcaattttgtaggagttaacctaagtaatcagactatgtgaaatcctctgaggttgactaaaaggtactctgcgattatttaatagatagtgtccttagactaaattaaatttttcaggaaaattataatattcttcaaagtcctgttggctccttctctcatttcacttaattatggtgaatctggccaatccatatatatagtttatatagaatgtctctttacaataactgtatgcaataataactatgtggctgttggcttattcctctaactgcatgaatttttcatgaattctttgagattcatgaaaaaaaagaatagttctttaaaaattactgcatccattttcattgtatactaagtactatacaggcctacctcattttatgcttttcaccttattgcactttatagataactgcattttattacaaattgaagctttgtggcaactgtgtcaaggaagtctattggcaccattttttttaacagcttgtgctcaattcctgtttctatcacattttggtaattctcacaatatttcaaaccttttcattattattatatctttt

SEQ ID NO: 35358 - DNA, 1053 bp, Homo sapiens
ctcactacaacctctgcatcctgggttcaagtgattctcatgcctcagcctcctgagtagctgggactacaggcacacaccaccatgcccggctaacttttgtatttttagtgtagacagggtttcaccattttgggcaggctagtctcgaactcctgacctcaggtgatctggccgcctcggcctctcaaagtgctgggattacaggcctgagctacctcactggcctccttttttttaaagaccaaagaatattcagcaggtgcaaaaggtatgtatttcattttgcttatctattcatctctcagtggtcacttgggttgttcccacctcttgcctaatgtgaatagtagtgctgtgaacagtggatgtacacttatcttaagatcctttattcagctcttttgggtatatatgcagatgttggatttctggattacaagttagttctatttttaattttttttgccttagaaatttaactcagaagaaacagaagcaaagttagcatcggcaagatctgatactgagagatagtgatatggaaaagggtgggtaaggtgaagggccatgtgcaaactgaagttataaagtagaagagtacaactataagatacgggaagacacagaatggtgtagaatgaataaaatagatgcgagggtagatacataacaaggagaaagaacaataaacttgagcaagtggctggggtctcttatagtcttcatttactgacctctttcatacttgaccactttttcctgagttccatggacacatgcacacacacacatgcacacacacacaggcacacacacaggcacacacacacacatgcgctgcacgcacgcgcgcgcgcgcgcacacacacacacacacacacacacacacacacacactattcagtatgtcccctcatcctgtggtaagtttttttttttttttttgagatagagtctctctccattgcccaggctggagtgcagtggcgcgatctcgctcactgcaagctctgcctcctgggttcactccattctcctgcctcagcctcc

SEQ ID NO: 35359 - DNA, 1022 bp, Homo sapiens
accacaaacttatactgtagattatttaagagatgtagtctggcatttcatacaaaacagattcatgctttattctgtgaataatgctgtagggcctgctaagtgccaggtactgtgttagatactggggatacaataaagtcacagtttctgcctttgagcacttcatagtctcatggaagagatatgcaaaaaattctcagttgccatttagtatagtaagtacctggaggtggctatgggaacacaatattgttttgtggtttttaaagcccagtggtttaaaaagctgaagaggttgatggttcaactgactgtttaggataaatacaaagcctattcaggtgcaaaatcaagtggaggcattctagcagggtcatgatgtacataaaggtatggaagcacagtagcatggtatagtgacagaagtgcaagtaattcagtctgccatggaagctggataggtctgagggagtggtaagaaagactggagaagtatttattcattcaacacatatattgtgatgtaacatggttcccatacataagtttacattcttgtagggaaataaatatagtatataattgtttcagtgaaaatgtatagtcagattgtacgtaatggcagacattaaatgaggaaacatcaacacagcttaatcatgggaatgggggagctggagcacctagagaccaggtagatataatattagccaggtaaaaattacgaggatttaattaaggctatggcagttgggttccctatatttgaaataaattaaaaggacttgtgactgattgctacctggggtatattcagaatattgggtaggatttgaataagcagaaaggggcatctggaattctcagcttaggcaactggttgaaagttggcatttactagtaatggcatacagagaaggaacattctgagggggaggggcagagagaaagggacttagataatgagattaattttggtcactgatatctggtatctcttcaaatggagggattttcag

SEQ ID NO: 35360 - DNA, 1054 bp, Homo sapiens
cccatgtatagaaagtatatttgggccagggacggtggctcatgcctgtaatcctagcactttgggaggccgagatgggtggatcatgaggtcaggagatcaagatcatcctggccaacatagtgaaaccccatctctactgaaaatataaaaattagctggacatggcagcgcatgcctgtaaattccagctactcaagaggctgagggaggagaatcgcttgaatcagggaggcagaggttgcagtgagccactgcactccagcctggcgacagagctagacttcgtcttaaaaaaacaaaaagaaagtatatttgttccgacctctagaaaagcactaaatgtgcaaatttagtattttgcacattgtcaaactttaaatgaagattatttgttttgttgcttactgtttaaaatgtaccattgtgcacaaaggcagttcaagaaattgactagatcgtaatatgggaactttggagggattcattttaaattcattcagtactgcattgcatgtagttagtattcagtcagtgtttgtcagatggagtagcaaaatattgttggcttaccttatacagtgttattttagagcatctttgtttcagttgccgctgggctttattagagaaaaaggtagtaagtcacaccttaaactttactgtggaaaaatttaaacatatacaaattaagaatagatccccattataaccagcagcacaatttttgaatcccaatataactcaacacccatttttagcaactaacagcgtttggcaaatttttttcattttttttgagatggagtcttgccctgtcacccaggctatagtgcaatggcgcaattttggctcactgcaacctccgcttcccgggttcaagtgattctcctgcctcagcctccccagtagctgagattacaggcatgtgtcactacgcccggctaattttttctgtttttagtagagatggggtttgaccatgttggtcaggctggtcttgaacccctgaccttgtgatctgcccacctcagcctccctaagtgctgggatt

SEQ ID NO: 35361 - DNA, 1032 bp, Homo sapiens
tgcttttggttgaaacaaaaaacctgtgtgtaagtggacctgcacagttcaaacctatgttgttcaagggtcagctgtgtacactgcatggcacatagtagacaatcaagttatttattgagtatatgaatgtgtaggtgtgtatgtgacagtgaatttaaagggctaatgatggtgctttcattgtgctgaacattatttgacgtagagtattttttttttttttgagacggagtttcgctcttgctgcccaggctggagtgcagtggtgtgatcacagctcactgcaacctccgcctcccgggttcaagcgattctcctgcctcagcctcccgagtagctaggattacagccatgtgccactacgcccagctaattttgtatttttagtagagatggggtttctccatgttggtcaggctggtcttgaactctcaaactcaggtgatctgcctgcctgtgcctcccaaagtcctgggattacaggcgtgagccaccatggccggctgatgtagagtatttttaataaaagggttgtcgaatctgcctatggatacttttgttgtaaatggattgtgtttttaaacggggcctcatgtgtatattaaaaggaagtttttacattcttttgtaaattcaattattctacccacccaaatttcacagtttatgttttcttattactgagccagttagaattactgttgtctttgacttctgtcttatatacacacatttacatacatatacccttttatatatagatatacttgtaccaaaacttgtatgagctcactggaatatagctctttttggagcatagttctgactttgaagacgtttagatgaggttagaaggtaattacgtgcaaatacctttttctgccccaattatggttatctttctttgtaggagtaagactgctgctgctgctgctgatgtgaatggatttaaacctttgtcaggcaatgaggtattttttttaaaagtggttttaaatgtagttctttaatataagaaagcatgtacat

SEQ ID NO: 35362 - DNA, 1033 bp, Homo sapiens
agcatgggggacattggaagagagaatgactagcttgttacaacttattacctgtgattggggttgggggacttttagaacatgccctttggttgctgttgctgttaatggtgttagaaacaactgggtcttgtatggcagttggcaggtgaagtatagagtaggggctagtaagctggagaagtttaccagagaaggtagagcaggtgtgtaagaagatgtgttcactattgtgtttttctttttatactgcactgttgttgtccttggaatgtggattacctttctattgcattattaaaatttctttttttttttttttttttttttgagacggagttttgctcttgttgcccaggctggagtgcaatcgtgtgatcttggctcactgcaacctccgcctcgcgggttcaagcgattttcctgcctcagcctcccgagtagctaggattacaggcatgtgccaccacgcctggctaattttgtatttttagtagagatggggtttatattggtcaggctggtctcgaactcctgaactcaggcgatccacccgcctcggcctcccaaagtgttgggattacaggcgtgagcctctgcggccttttttgtaagaccatcagatcttgtgagaactcactatcatgagaacagcatgggggaaaccacccacatgattcaattatctccacctggtcttgcccttgatacttggggagtattacaattcaagatgagattttgggtggggacacaaggctaaactatatcagcctacatctcaacactcattttttgcctacttatttttttttctttatagcagttatcagcatttaacatacttattacttatttagtttttatctgttgtcaccagattgtacatttcatgtaggcggagtttttgttctcttaaatgctagaccctagcacctaataatacagtcatcccttggtgtttaccaggagatttgggactcttgagtataccacaatctgcacatattcaagtcctaccacgggccctgtg

SEQ ID NO: 35363 - DNA, 1049 bp, Homo sapiens
tacattcttctagtttgtattttggctttccattttctttttttttttttttaattttttattttatttatttattatttttttttgaggcagagttttgctctgttgcccaggctggagtgcagtggcatgatctcagctcactgaaacctctgcctcccgagttcaagtgattcccctgcctcagcctccagaatagttgggatcacaagcttggcttttcattttcttaacaatgtcttttgaggaacaagagcttaatactgatgactaagaacatttaagttatgtaattttgttatagtatggttaattagttaaaacatattttgaaggaattctttttacaagaaagatatatgtcacacatcataaaaaatgctgattaagtaaaattacagtgttagaagacagtggtagtataatatcgattttttttttaaataatttaatactgacactgcttggggaagattttaggatatccattgtttacctaaccagactacaaaagaatttattctgaaggttacgtatcaaaaagtacattattctcatgtagcattttgttgagatggatagaatttttcatttttaattttttttagagatggagtttcactcttaatacgcaggctggagtgcaatggtgtaatctcagctcactgcaacctctgcttcctgggttcaagcaattctcctgtctcagcctcctgagtagctgggattacaggcacccaccaccacgcctggccaatttttgtattttttagtagagatggggtttcaccatgttggccagggtggtcctgaactcctgacctcaggtaatccaccctccttggcctcccaaagtgctgggattacaggcgtgagccaccgtgcctggcagaatttttcattttttaaagtgatgtaatacttcttgtataaaaattagaaatgtagctcgtgtgtttgatctaaacagactcatatcagtgaacggtttcctctacaccagagggtatcacttctagcagtttgtgagaagccatgattgttaggct

SEQ ID NO: 35364 - DNA, 1023 bp, Homo sapiens
ttatgttttgcatttatttggacatttagaaagctactatgatggataagacgctgagctgtgggggatggaaagatgacctggacaaggcccttgcatactaagagtgggctttgtctgacatggtcagggaattgggggtgttgtgattaatagtggtttctgtgatgggtaactccctataaattaaaagaaaaaaaattcagtctgggcatggtggctcacacctgtaatcccagtactttgggaggtgaagagttcaagaccagcttggccaacatggcaaaactctgtgtctactaaaagtagtggcatggtggcacatgcctgagtcccagctactcttgagtctgaggcacgaggattgctcgaacccaggaggcagaggttgcagtgagccgagttgcgccgctgcaccacagcctgggtgacagagtgagactctgtctcaaaaaaaaaaaaaaaaaaattcagacttgcagtgtaaaaaatacgctgagtgtaagtaatgctgaacccttaattttatcagaaggcattcataggtttttaattttcagggttcagtgtgaactcacatgtcagaacattataattatgtaagtagtgattaatagttaataaaatgttgtataacagcttaatataattttctcagtagtatgtgaaataagatgccacagtgacctgttttcattttacattcaaagtcttacaggatttattacttactggttttaagacctagaattatgtaatctgacaactttgggtgttatttcccccagttgactggtagagaatgttgatataatactttgcaaatgataggcttgaaaccttgttttattaaaaaaacctggtaacgcagaggctagataagagagtgcagaggtgtggtagagaagggaagtggggaggtggaatggtctttaaattaattcttattaatcattggccccagagggtaaaactgtgttgataataatggacattgctaacattggttgaggtgcttactat

SEQ ID NO: 35365 - DNA, 1051 bp, Homo sapiens
gcctccctttgcatttttagtttagcccttccttttaaccctgccttgcttttctggtgatgggcactcactaatcacgtgactaaaattcctcatgtgagcagctgcatttaggggccttatatgtgtaagcggcttgaatgcccttttgaaattctcgactttattgaacttggtgattcataagagaggaagagtgtgactctttcttatttttcagtgacttgccactcatgagacaagcactgacctgagttaagaaaggagcaggtaggactataagtaagtgggacctggaggattatacgtaagtggggcctggattgcttacacacacagttgctgaaacttgcatggacagagttcttacgctagttactcattgcttattatttttactttgtttaatacttactaactcctttgagccttgtggcaacgccatagtaggtggtataagtattcccattttacagatgaggaaactgagaaatggagaggttaggagtcttgcccaggttagcacaatgaataggtggtagaactgagattcttttttttagacggagtctggctctgtcgcccaggctgaagtcagtgatgcgatctcggctcactgaaacatccgcctcccgggttcaagctattctcctgcctcagcctcccaagtagctgggactaaaggtacctgccaccatgaccagctaatttttatatttttggtagagatggggtttcaccgtattggccaggctggtcttgaactcctgacctcgtgatctggctgcctcggcctcccaaagtgctgggattacagatgtgagaaactgggatcacaggcatgagagactgggattctaatccaggcagtgtggttccaggattctcttccccaggctgtctctacccacaaattacagaaagaagcagcaaaacaggaactcggctctgttctctgcccttcttgtgcgttgtggaattagccaggatttcagcatgttctggatgttgttatgtcagacagctttagaatttgtgttaatagttttag

SEQ ID NO: 35366 - DNA, 1043 bp, Homo sapiens
cattttttcccaacatatttgatttaagtcgtggtgttgaaaaggggcatcaaggtcttagggcactttgtttttcctgtcattctcttttggaatgataaggtgtgttgcaggattgtgcagctactcattacgcttttaagagtatgattttaaattttaaaggagatgtagggggtggggaaaggtcggtggagaattggttctgtatttcagtgaagatggaagtccccacgatgatttccaaatgccatgtcagctctttggagattgacaatacccttttaaatggagaataattggtcaccaccttcctttaaatggaatgtgagtcgcatttcactaaatgtcattgccaggtgaattagaggttcagctccactctgaagtccctttgctcagggacacttcagtcgggtcttttggaatgtcccccttaccacagatctttgctcctcaggagtgggagacactagttggaagaaatgaggaaaggtaggggatggaaaatgagatgtcccagaaatgaaccaagtaggcaaagagcggggaatgtaacagtgaagcacaccaactggcaatgagagtgagggggccctatgctggaattggccaagtttctgactctggctctaaagaacactggcttctctgctcctcatcacctctctcccccgacttctccctcctctattccaatctaggggaaaatgtgatttttagagactttgagttttatatttaaaaatttttgaacatgtggggaaaatacatgttttcatgtattccatgtttgctgttctgatcctttaggatttcacctccaggggaactctagtttttccttgattgtcttccctgccaccgtgatagcaaagggggctccttttatgggcccttatagtgcaatccccagggaaggaatgcaaatgacatattcacatcacatagcttagaaagggggacatttccttacctaacagacaggggcaatccgagtgggggtgaatgactctgaataaggtgttactccctttactcca

SEQ ID NO: 35367 - DNA, 1034 bp, Homo sapiens
tactgtagaaagatttttttaaaacaaagaacaggagatggaatcactgcttcccagaagtcagtgttctgaaaggggcagtagaccaaatatgatcatgagcacttaccaagaatacagggcttgtaaacagatgaggccagtgggagtttgggcagcatcggcgggagggagtttcagttcccagggcagtccacagcatcaccatctgcagtgttttagaagtgctgcacacctcatcctgaatgatctcagtgacaagcccctccctggccagtcctggtagactgctaaatttgagccccataatactatttcataatgctacttcttataataataataacaacaacagcaacaataataatcctaatagctatcattttggggatgctcactctatgccaggtactatactaggtacttcccatacactgtctcacttgaaacctctaaccacccttcgagatagttattttaacctcatttgagtcagatgtggaaactgaggggggttagggtaagatcatctgcttatatagctggtgggtggtacagtgaggatttaaactcaggtctctaatttcaaagcccacgtcctttccatcacaccacccagccctctagatgtacctatgagtggcgtgttagctatctgatgcttgctcagcctgagtgatggagcaggaacaagaggggccaagtgcttgcatgtgtcagcttcattctagctaagctctacctgcagttgtcacctacagctcaatggcaaggagacatgaaaaatcccacatattgtacagtggcacctcacagtatattgaatccttgtcactgcgcttcctaatgacagctcttagcattagaagcttttaattccatagtttcctattaatttcaaactaaaaaataccttataatagagatggctctaaagagattaattttacccattaaaaatcaactcacatgccctcagtgctcctgaaaggggaattccaaagtaatgaggggcacactttctgttgttctgg

SEQ ID NO: 35368 - DNA, 1140 bp, Homo sapiens
ttatctagggttccaatatatgcagaaaactttctcacgatacttagcaagcaaatgtttcaggacatttgaggtccttaagttaagcatgtttgtgttagtttttaatgtttttaaatagcaaactgaaagcacataacctcagagtatgtcagctgactattagcagtcaatggcaagactccaaatttcttatttccaaaagtacttctgaattgaatgaatgctaattaaatattaaatagagtaccatcatcaatgcttattaaaagtccactgtatatcttgccatttacagacatttgtgtacaaaggcaaatcaaggaaactatttcttacattgtttatatgtacttaattatgggtctagttgcagttacacagctgaactatgacaagaacctgtgcactaagctaaaagaatatagctttctggtagacataggataaagagcacatccctgattctagtctggattcctgttccagttctctcaccaaaagctggaacaaatcacttaattgccataggcctcatttcctcatccatacaatgagaagatggacaaaatgacacttgagattccttccagtattaagtttctgtgagtctgtgactgatatttctgctctatgaaataacaagtttccctattatgtgcgcaaaggaaataagttcttgaaaggaatagttatataaataatgttaacatattacagaaaaggaaatatgtctatagcttcttcctaaagaggttaaaaaataccttcagaccctccaaactgtcttaggagaaacataatcttaaaaggatcttgttttccatttgattggaagtttcttaggaatgttaaagaattacctacaacttcggctaaaaatctcatttaataacatttgagtcattttgtcaagaggaaattgatttgaaatacaaaagtttgcatttctggtattattttccacacaaagcctattctacttggtacataaagaatcttatcttaataaaactactctacaattggtctaaaagattaaagctcttaaccctgtaatataatgttacctaaacaatcttgaatattagcaagtcagtaattgttgccttattgtgcataaaaataaatgaaagcata

SEQ ID NO: 35369 - DNA, 1003 bp, Homo sapiens
ttagctttgtgggcccactaatggcattattgtccacatcagcagtctgtacaattaagttttatgcttatagtatcatttgatatttatcaaagatgtgaaaatcaaaattgaatatgattgattgctatgagatatgttaatattgggattcctaggctatgttatggaataaagcattcgctgtaataacaaagataaggcctctaacattactcattttatgttctatcagtaatcaggccttaggagtaagcgtcatttgtctgctggagatccctcatgttaaaggaatcacaaggtgaaagttcactgaatcatcatttatgatagtaggatctaccagtcaatatcaccagtaaagaaatattcaaagggagataatccatctgttttatcagcgtgtttgcttctatttgccttgacctctgatatttaaaaatgaagatgttttatgtttacatatatttgtccaaaaagactaatgataatgttaaccaatagttcctgagtgtttactaaatgccagattctgtagaatgcaattaatatgtataaatttatttaatcctcacaataacactaacttgtggagaagctgttgttatcactgttttactgaggaagctgaggctcagagaggttagataacatgtttagggtcacacagatggttaagtggtagagcaagatttgaacccagggtgtctggctccagggtccatactccttatacctgctggaggaatatacaagagatgtagcccctgtcctcagtggcttgctttctcatttttgtgatactaatcatgaataggaagttataatagaagacagactagtaagtaactgaataagtgcccctgataggtgttgcaggtcatcaagtaaaaaggaagattaatacaggctgggtagctctcaaaataatttgtcattatttacttaaaactgagatgcctaggaaaactttaaagttcctaaacaccgaatgttaatacca

SEQ ID NO: 35370 - DNA, 1049 bp, Homo sapiens
atgattaaatatgagtctatgttggtaggtccctttggtttagggacatattgccttacttatctcactagtatctgaaggtactacaatattatatgacagaatgtaaaagcattttaatacacaattttggttataagacattaataaattacgtgaaacctatttttaaaaaacaagctaaagaagtaaataatgatgtgtgtttgaatgacacacttaaaataattggaattaaactgtcttagaatcttaaaggtatcatctttggctatctgagaaaatcagcttatttagaaaatcagcttatgtattattctacagtgatcctagataaatgaagttttcccacatatatttttccataaatatcaatttttaaaggataaatgaagtttttaaaggaatagagaagtttaggaagtcctttggaatctcttctaattcaatctggttgaaattttaaaaaatttgtttgtataagaaatacttattgagtatttactgtgtgcctggaactaagctagacattggaaatggagtggtgaacagccagatatgatccttttccaggtgaaatttacattcaaatagagagggaaacagacaacagatataataattacattataattaagtgctattcaggaaataagcagagtaagtaagaacaatagatagttcaattttgttctagttcttctcccccaactgctccccatttctcctcctgttctaagataatttttgtatcagagaattcagcctttaaatgttttgcttaaatcatccatataaaattgtgtaacacagataaagaatgtataaatccttaaaaatgtattaatcctttgcttaaatcctccatataaaaatgtgagtcattgacagattagctgaagtcaaaaattggctgatgtttatgttgatatacataaaattttaacttaggtcatggtaggcaggctaagctagaagaacatcattttaataacaaactataacaataacaagcttagtaggcatatttgtgtgctttataaatgtta

SEQ ID NO: 35371 - DNA, 1047 bp, Homo sapiens
aagtttgtgatttttgtagcctaacgtagatatgttgtcctaatccagagtcacaaagatgttctttaagtgttctgaaagttttatagatttagttcttatgtttaggtctatgatccattccaagttgctttgtgtgtgtagtgtgaataagcatcagagtttttcgttttttttttttgtgtgtggatgtccagttaccacctattgaaaagattattctttccacattgaattactctagcacctttgccaaaaatcaatttaccatctctatatagatctgtttctgaactttctcttctcttctgttgatccgtatatctgtccttaagccagtaccacattatcttgattagcataactttatcgtgaaatataaaatgtgagtcttccaacttttctaagaataattccctgaataaataaataaataaagtttatttttaaaataaattgtagtcatttgtcaatttctactaaaaatcctgtagggattttgactgagattacattgagtctataaatcaatgtggagaaatttgacaccttaatatcaaggattctaatccatatctctctatttaagtcttttagaatttatcttatcagtgttttataacctttagcatacacagtctacacgtattttgttagctttattttatatttcatgttctttaaactgtttgtgaaaaatatttttattaatttcaatttaaaattattccttccttgtatatagaaatacattgatttttcaatatagaccttgcattcttgaattttgataaactttcctattttgtagtttttttcagaagggaggttttctaggatgatgtaatttgtgaataaaggcaggtttattcctttccaatctatttgcattttctttctttttctttcagtattacatggctaacactttcaggctgttcaaaacaaaaatcagatcagataagtaaagagagttttaaagtttactgttgagtaaaatagtaaatacagattgttacacacaagccctcaaaatcaaaagtggtt

SEQ ID NO: 35372 - DNA, 1060 bp, Homo sapiens
tctgtgagccattctggcaaattattgaactcaaagaggacattgtgggaacccttgatttgttacagcctgatgggttcttcttacccactgcccagaaaagccaatacagtgagaacagcaggagttgcagtagggaaagtttaggtgggttcatgcctgtaatcccagcactttgggaggccgaggtgggtggatcacttgaggtcaggagtttgagactagcctggccaacatggtgaaaccccgtctctactaaaaatacaaaaattagctgggaatggtgatgtgtgcctgtaatcccagctgctcaggaggctgaggcagaagaatcgcctgaacttgggaggcagaggttgcagtgagctgagattgtaccactgcactccagcctgggcaacagagtgagactccgtctcaaaaaaaaaaaaaaagaaaagtgtaattatcacaaggcaggcaagtggaagaatgggacatgtttttcgaatccacctccctgagaactcagaggctagttttaaaagataatttggtggactggtggctagggaatggatactgctgattggttggggatgaaatcatagggatgtcaaaaacgatcttcctgtgctgagtcaactttctgggtgggagtcatagaagtatttgagtctgaaaaatgtctcaaagaccaatcttaggttttacaatactgatgttatctataggagcaattggggcagttatacatcttgtgacctctggcaccatgattcctgagcagtagggcattatagaaaaacaagctagggtacaatgactgggtatcatttaactgtgcctacattttagcagaattcaggctcctcccataatcctaaccttgtggcctttccttagttttacagtggctgttttggtccctgaacaaggagggggttcatttcaggaagggactattaccatccgtgctttaaagttaaactataaactaaaatttctcccacagttagcttaccctatgcctgggtccgtcagtttgtgaggttagaagcaagatggagtgagctatgtt

SEQ ID NO: 35373 - DNA, 1058 bp, Homo sapiens
tagagggccacaaagaaatgatttaggatggcgttggcttttctcatttggatgagtgggtgtgaaggcaattcagctatggaaaaacaagtttggagccagagagtaacagagacaaggatgattaattggaattatatctcccaatcaaagtcttcccaaagactctttctttggaaagagtcatctggattctgagcttcactggtccctttgccattactctaggacatcttccactgaactactagagtgaactcccaaaacacaaattagacctggactggcttcaccattgcctaagattcatgtccagactgtgtcatatggtctaacaagtcctcacggttttgctctttctcaattctacacatacaccccactgtgcaccagccacaaaactcacccatcccaaaatatatgatgccttctgacaacattttttttttagtgtgtttctctgggtaggaagactttctaattccctttccatccagaaaacagtcctcaagatgcaaatctattgttatttcttctgtgaagccttttctgatttctgaggcgaaaatagttactttctcttctgtattctcttagcacttattcatgtgccgttcttgccccagggcttaatttgcttaggagccactctcccacactggattatgagtccctaaaggacagggatctcttattcatctctcttcccagtgctgtaactggcatgtaatagccacccgataattatttgttgaattaataaaagagcaagcagacatattgaattaataatgcctaacttaacaaacagaacatatttactgtggttaaaaacatgtatcctagaaaaacctctggaaggatacagagaaattgataacagtggtttgccttgggggaaggaaactaggtggttagaggataggagagggggagagagagagccttttcaccagatgtcctatagtacatcttgaattttgaaccacatgcatatattatagcattatagacccaaaactagtctaatttaatatttgtgcatgtggcaaaacaaa

SEQ ID NO: 35374 - DNA, 1074 bp, Homo sapiens
tgggtggctgaagcaggtggatcgcttgagcccaggagtttgagaccagcctgggcaacatagcgaaaccccgtctctacaaaaattagctggaaatggtggtgtgcgcctgtcatcccagctactcaggaggcctaggcaggaggatcagttgagcctaggaggtctaggctgcagtgagccatgatcacaccactacatcccatcctgggcaacagagcgagagcctgtctcagaaaacaaacaaaaaacaacaacaacaacaaaaaagaaaaaacaactaatggagggcatttaatttttaagtggaatgttcaaaaccaaaatgtatgctctctaaaataatgagaagtataaatatatagtataaaattggagtcagatctataaatagaataaaaacctatataactgagcataattttggctaattataaaaatttcctccttaaaagaaattgcaaagagagcatttcagatatacctattcttatttctcaaaatgttcacagataacttattgattcttatttctcaaaattctgtaacagttggtgtttgtacgtaattaatgccttatagaaagttgtattcagcaaatcaaagctacctttacctgggttgtggcttctcggaaagtaaataatctaaatttctccttaaataatacacagggaataaatataatacatgttccgcataaatatataaatatactttattatacataactatacagtgcatataaaatgaaagcataaacaaaccaaaattattcagttataccacagatgaccactatattatatgtatttccttacaatcctgtgtgtgtatgtgtgtgtactaacacattgcatataagtgagaccatgtttcatattacaattattttctgctattttgcttagcatatcgtaagcattttcgatatgaaaaaaattgtattaattgaaaatcttaaatcctatgtcatgttttacaacatgtttttctacttttaaccattctagttggcattattggttttccctcatataacttctataatgtgcaaatatgcatattatagaa

SEQ ID NO: 35375 - DNA, 1047 bp, Homo sapiens
ttggataacatctactgtaaggattcacccccagatatactgaaggataatcaatcatttgattacataggtaaggggaggtatgtggttttgttgatacagtcattggggaaaaacttaccatttgctaccggctgtgtacccaacagtaaaagtagaagtctgggttttctctccctggtgaataaattatgtatgtttaaatctgttttgatcttaccctttttatgcagtaacgcacttggtagatgataatcacatgtatgaaatacctctactgtcaggagagaatactaagatttcaagcagtgttactgcacattaatgtaatgtcataacttcatgctagccttacatccatttctttctcactgacctacaacttacctagatgttgaggcaaacaacagggacaaagtactagagattaaaaaaagagagaagttaaaacacacatacacagaggctgctctgcaactttagttactttgcttatttttctcccacgttttgtaattttggtgaattgtaatatgtagtatgtaaggacatcattttgcagatgaggatacaaggccaaagatgtcttgctcaaagttatgaagctatttgatagcagaactgagagaactttgagtgatgaaaatgtgtgattatttttgtactctccccacaccacacacacacactctgtctctctctctctctcattctctctccctctctctctctctgtctctccactatgctccttgcttagttatagcaacagatctcatgatgcttgtattagagaattttcatgataaatttatggttatacgaataatccagtcatttgtagatatgcctctaatatgatattggttttctctctcatgcccatgtaatttgtaaagcaatgtttgacttttgtcacagatattttgctatgtctttaatttactggtttgtggcagtgaacaacaaaaagatttctacgatacttgttaaggcaggcaggatgattcttccccccattcccagcttttctgagatataatggat

SEQ ID NO: 35376 - DNA, 1075 bp, Homo sapiens
ggtttactatggtgactttgtaaaaatggatttgaggagatgggttaggagactattctagtagtctgaaaaaatatcatgacctgaaccagggtgtaatttggaaatgtagttaactgatttaaaacgtcttttagagatatttctaaaatgttgagatttttttctattaatgtattagtatcagttgcttgaaaaattaaaggatatctagtttgtcttttctatccaagtacttattaatcaaaagtcttacatgttatgaatagcattcccattagtttcagtcttaccacctgaaatgtcttggaaattcccatattcagcaacagaaagtcagtacacagatgacttcaaaagggccagcctgcaagggcactaacttgggagaaaacagacctccttctatactttgtaattaggtacattggcttgggcaattaatctttctcaacctcaatattctcatctataaaatggagatatgccggaattccctggcctgtagaattagtgaggataaatgaggcactgagcataaagcacctgggacaatactagctcactttctaagcaccatttgtttttatttataataaggtactttcagaaaagaaaactatattgtatttggtttactctgccacttgcataacaggacacttgttttgcatatttactgaattttatgtttatctttcttttctttttcccccaaatgttttcctgcagccttataacattaccttgggagcggtaaactgtagtgttatttgataccaacaatatagaccataaacctttcttttacacttttctggagactcaaagaaatttagcaagtaatgaaaaaattgtctaatgggaaatggaagtcatgaaattaactgtgatactgtttgtcatacattaacatcaacaacaaaacatcaaatgtgttataaacactaaggaaagtagttattatgaatttttttttccccaagccaccaccagaacctttgcagaaaggagagaattctcatttaagaaggtttgcttagtcgtcagtccaggaagtgtctttgtaggtatt

SEQ ID NO: 35377 - DNA, 1028 bp, Homo sapiens
tatgatgataaaaatcctaacttctatcaggaacatgtaagaactatgtggtctgatacattctaaaaattacatctaggttacaaaatgttcaaattattagctttcttttttttcccccctttaaaaacccatggtgagggcaaggtagaggaaataaacacatttggtcaaatgttgggtgtagttctaaggaaaccaacttataatcttttcagatgatatttaagttgaatgggtcagaaaataaaaaaaagagagaggactatatagggaagttggaccaaaatcatagattagcagaagcatttcaatgatcagttcattcaagcatgaattttttctttttacagctctctcctggtaaatgatctgaatgaacgatgcttgaaaaatgattcttgcactctgtgtgtgtgtgtgtgtgcgtgtgtgtaaattgtggtttagcttattttatgtgatccacttagtgtttttgtagatgttttctttttctaagatcaaacttggctaatggaaatactcttcttggtatgttattactgtgttttaaggaaattacaaattacaaattaacttattagccaggtactctaatggattaattataagcatagctataagtgtgttgaaaatgcaagcctttttttcttgagattctaagactactacttttaaaacctcagtgattaaacagtttcatataatttaaatttagcaaaaaagaacggagatatggcattttatttttttttttattttttatttgttattatactttaagttctagggtacatgtgcacattgtgcaggttagttacatatgtatacatgtgccatgctggtgcgctgcatccactaactcgtcatctagcattaggtatatctcccaatgctacccctcccccctccccccaccccaccacagcccccagagtgtgatattccccttcctgtgtccatgtgatctcattgttcaattcccacctatgagtgagaatatgcggtgtttggttttttgttct

SEQ ID NO: 35378 - DNA, 1066 bp, Homo sapiens
aattacaagttggattgcttcaaaaaacctggttgtgtagctgagagaggctttcctttactcttaagaagagccaagtgtaatgccttggtagatgaaagtggaaatttgagatgaaagatagccctctatgttgaacattgagttaattgaggtataacatgtgtctttacaaaattgatacatagcacaattaggtataatctggtagccaggcaaagctttctcctgtaagctagcaggctgtagggtgtcctgcaaaggcaaagtgtatgagagcatttgtccctttccaactgcttgctatggatagatgttacccaggtcccttaagtgaggttggctgatctacagaggagtagggaaagtacaccttctcctctgggtcttctgcaagccttgcgactaaagagtactttccaattgtcagccacccctactgggtcttctcacttattacccttttattagtatttgggcattccagtgactaagtgataaacaattttaagaaatagattggttaattctgaataataagtgtttaatagtctccccaacttattatatctaagcatttaaaaaattttctgtctgattttatatgttagaattgttaaatggttgatatagtttgatgtgatgatgtgttgtgatgtaaatatacctttggaagattgaaatgttcataatttataacttaggagagtgactaaggcagatgcattctctccacataggttgagcatttcgaatctgaaaataggagatctgaaatactccaaaatccaaaactttttgagcgccaatgtgacgcccaagggaaatgctcactggagtgttttggattcagatttttcaggtttaagattttcacctattaagtatgatgcaaatattccaaaattttaaaaagtgtaaaatccaaaacatttcttttccaggcattttggatgtagcatgttcagtctgtactttattgttttccctaaaatactggatttttattgacttgtctaatattcagggaaaaagtaagctaccctagcatgtaaattattttccg

SEQ ID NO: 35379 - DNA, 1031 bp, Homo sapiens
ccatctaattctccacatgcattgaagtttataagctttgaagattctcctaaatttatgcttttatttctggttattttaagtcagttaaatttgattataattttttccttcaggtaacattctcagaggcaaatattacaaataaattgtgaatgtaaattaaaaacattacatagattttcatcattgccgaaagtatgcccctaagtacatttcctccttttttattgttttcttgtgctttgatattatgttttaaaatcattttatcattttgcttccaaaaaattcatcaagatccatgtttattagtttgaattttaatttctaaatgagatggtagatcataagtgctgggaagtgattgcttgaaattaacagagcattacactagcattatacttatgcttatgaggagacctaaaatattttgtttgcatttttgtgcacagataacgtgtccctgctctagactccccccaaaaaacaaacaacacaataaagactctggaaaccttagaatggtctttgacctgtaacaaaattttgactattagtgtaccacatttaattaataaatgtatttttattcttcttttgttccacatgtcataattcaagtttattcagatgaacacttcttttaagtgaatcctgttctaacaaaaaatattatctaatataaataatcagtgaataatttcagttttgaaatgtttttcaaactggagttttcagttattttatgcaggtgtgccaggccttaagcctgatctatgaaatgaaatgaagccaacttggacatgaatttttactttacaaaatagttccaaataaaaagcatcagaagagcagacttttaaactcagatacatctgagttcaaaatatgacttgattctctgtctgagcaaaatgtgtaacttatgacatgttagattccttatccaagaaatggggataatacctatcaaaaagaaaaggcaaataacatatgtaacatttgttgtggaaggtgaaactttacat

SEQ ID NO: 35380 - DNA, 1050 bp, Homo sapiens
gatgaaatacactaaatatttctctgaatggtgatattatgggttatttcattttttcttaacacttttattttctgttttctactgtctgttttcataaatagataattaaatagttaaaatggttgcctattggtaaagatacctgttgatcatcaagaaatgtggttcagcattttttgtaaaagaaagtatctttgaattataaggttttagtggttgactagatcatttcaatgagtttaaaaacctgagtttgatgctgtggagtataaagaaacagaatgatctctgccttccaggtatataaaacttggtgggggaatcaagataaaactctactgaaaatcctacaaataaaatatctgaattttagagaacctacctctatagtcaccttaaaatagaggatggaaatctagtttatgttcctagcacatatttttgttttttatcagttacctgataactggctagcactgatcaatataattaattattttgatcattttctctaattcgttgaggcctggcttggcccctctgtgacatgtaacacccctttcctctgttttgatgaaaacttgaaacacattcacttagaggtagtggtcccctgctagttcaaatgtgatagctaataaagaacctttttattttgtagctaagggtattgattcagccacatgttgggttgcctcctgcttcagcacaatagccggaggaggcaggtgggagggagtgctcttctaagggtgtgtgtagtttctgcttttggtgtgctctgaaaatctaatctaaaaactgttgcttttttaacttccaggaaggttttactgagagcatgctaacaggttatcgggactttctttacgttaacttgctaatatatattattggaagaaaataatattagtgttcaaagtcaggattgaacatcattccagtagtaaatagtgatgggacaaggatattgatatgtgccattttacagtacttcaataagactaaaataattaaaagaactcctaactaatgtaaaaatggaat

SEQ ID NO: 35381 - DNA, 1029 bp, Homo sapiens
atgtggtaaatatttatgcaagatggctagccagacaaaaagaaaaaaaaaaaggaaaaacaaccgtgaaatagagaatgcagggtgacccatgtaaacaggctagagatacatttgaaaaagatgagggttaaagagtgtgtagatgttggcaggtaaagagatagcatcctctagggaggatattatcaggagtcagagtaatcttggtaaatgggagaatatgtaagaaatgaacatgtagaagagtggaaagccagcttttaggtcatacttccacttgctcatcatatggccttgagcaagttacctatcctctctaagaatgagtttccttccacctctgtaaaatagtgacactaacagtccttcctcctatgctattgggaaattttctgagctaatctatgtaaagtactggcatgtagagagtgctcaatacaaatcttagttcttattattgttgattgttattagtttcaattaaaattgaaatagaggaataggaacaaataggaactacaatgggtaaataattactcatatgagagtatgacctaagagattccattttgaaatgaattaacaatgtagtattaataaattcaacctctaacattattgtagagagaggaaattcttctagttctttgtgagaacttaattgagaactgtattctctgaacttcaaaaatagagattatcatgaagatatcttagtgatttttaaactctttttttagagcaatacaaatgaagattaacatttacatatatcacatgctccatggtggtttgattgaaaagcattgtgtgggtatgtgtgtgtgggcagtaaagcaaatagcacaagttttgtttttgtgatattcataaaaatcaatactcagcatagaaatatgactcagtaagaattgcttattatggactataacatagataagataggctgcacagtgatgtactgtgatggttttcatctccgcctcttttctcacttgtgaacaccatcagaatgtaaacgagagt

SEQ ID NO: 35382 - DNA, 1038 bp, Homo sapiens
aaattgagagaaaaatattagcttcttgattacatttaaatatagccattaacttggatatctttgatgacattccaacatttattaatgaaaaccgaggaaaaataaaagcatgttaaatggatagcgtcttcattttaaacattagggtctctggttttaaacttgtgaagtataggatttgtttttagttttaagagttttattttgttccttatatagtaaggtggtgatgaagttaaaatgtaattacatataagcacttgttaatttatgctctagaaacttctggatttatgattgttagtggtatggctaaggccaaaatttttatgtagaaaagtggtggaaattgtttgtattttgtgctagaaatagaaaactgtagtttaaggaaggaaacaggacaaaaaaaagtaatttgaatgcttaaaaagttaataccttagggagggagtatgagataatagctggccatctggattcataactgtggctatgacttaatttcatttctgatgaatacttcattggtatgtaacgaatattcaccttatatattaggagtttttgagataaatatatgaaaactctgatatgaaactgaaatttggctcgtaagtggcaaaattgactttagatattctggcagggagaggttatatgggcaagtcttggaaaatggggaggtgggggatgatcagagttggtatttacacttagcattgaaaatcttgcagggagtgggtagtgggtacttactggaggagggagctctgtgagcaaaatcctggagatggggagaaaacactgagtgtggttgagccgcgtggtgggctgtgatgtcggggttgggggtgagaaaacctggaagaggctagttggaactagaagggagttgaatttgaaatttacactaagaaatttgtacttaacttggtaggtagtgagttgttatggaaatattggagcaggacatggcaggagaggaagtgcacttggggaaaccttattgggcagtgtgtttgtagggtggat

SEQ ID NO: 35383 - DNA, 1020 bp, Homo sapiens
gccaatattccctgaccaattgtcatggtctctcaagtttttctattaacaccccatacatgaagctaatttattgttccgcttgagttcctcaaagcatatcaattatcaaaatttttgttttcagttcaattaacttttgaactggaggatgtctgagtagttaagtaaaccatctgggttttacagtgcataagcttgaatccaatttgtggctttcctggggaaaaaaatgccatattttatgataatattacataagtttagaattttaataactcatctgcagcaattatggagcagagtaagttataattttcctttctaaatctaataattaaaggttagtctttctaacagaaggtgacactggttctacagaacatagtttgaacacaggaattctgagcattgcctctgctttccaaaagtgtctggagatgggtcagttccttttctgaattattgcatgaaatagcatcaccatcttcaagacaactttaaaattacatacacaatagttggtgctgaagctatagatagaacctctaagcccttcagcacatatttggtaagaacatttatacttacagacagtaaatacttctctgctaaaatatatttttcagtagcttgttttacaataattcattgatattataacatggtcagaaatttggggtaattggcacagctacaagttagttgaggaaatgctggcaaggctatgaagaactttatgggtcttccaacgtttaagttgtgagctatgtgcttaacactagaagatccatgctcagggtaaccactttcttggcttaagtgtcatacaatactcagatttgaaagagtgaaatatatacacagccttaatactaaaggtttggttatacccatgataagggaagatattaattacaaaggaaaagaaattattatattggaaatttactagtttttataaatttcttctctgcctttgagttacccattttaactcaagatccaaattggtctagc

SEQ ID NO: 35384 - DNA, 1041 bp, Homo sapiens
taactgtcagaactatgaagctgaaaagataatctattctgaaccctgttttagggtttatgatttgcacaaggttgcatcaggtagttcctgattcctgatatacttcctctctaccgaaagtccttctccctttcagagggaaacagcctgcaaaacctctcttcaattataaaataagtatgcctgaatctttaaaaccattttgagaattgaacaaagtattcttaggatagattgatttttgttattcatctccttctcagagtatttttaaattgaaaccatggaaatattaaatattaataaaacttctttttaaaccctcaatccaatctttaagaaaatatttcagccaaatgcatttaactaaaacatttatctgcggatagctttctttatttttattcaaactttcaattgattgattttaagtgatggatgaaacactaaatgttccctgacttagagctttccctttctccatcataagttgacatttttgtagatcctttgtgctgtagcattcaaaactgcctttttaagaagtaacaaaaaaatagtatttgctacagtcagcagatggttgtcacattttgttttcagtgcgctttaccacttaattttgttttgttgcagcatcagaggttgccagtcaagcatctgctatagcttatggcctaggactggagccactgctgatggcacagttcagagcggcactaatctaaaataaatgtttaataagctagccataaaagcacctggatttttgttctttaaatttcacaaaactgcatgaaagatttagagattggaaacaattctacataaggtttgacttatgcatttttatgtagtttagtatataaaaaataatgccttttttctttatcttttgtgaattccagctcatcaaggtgctgtacaagaccagccataccagctgccagtggaaatcgatcctctcataggtctgtcacttccttctctctttgcgattcattaagctctgtatggtggccctgaagtgtagattac

SEQ ID NO: 35385 - DNA, 1050 bp, Homo sapiens
gaggcatttcttccttctttattttagctgtgttaagtggggaatacaccaactcccacatgaaataataatacagtacagcattttatttagtgctttgtatgtgctaggtactgtgctaagcactttatatgcattatcttatttcattttccaaacaattatgtgaactaggtattgttactatctctttgtagatgggaaacggagataagctaattgcctaaagtcaaacagcagataagtgtcacagtcaggattagcactctgagccatctgacatgataggccaagtgctgaagcaataagttctttgccacctccctccccttttaatcagggaggcatgtgggctgccgggcaggaaccacagaaggcaactgtcaaggagacaggtctggcttgtacagtgcactcttgttcaggctgtactcttgtccaggctgcactcttgtccaggctggagtgcagtggtgcaatgatagctcactgctgcctcgaactcctggcctcaagctgttctcctacttcagcctcctaagtatctgggacttgaggcacacaccagcacacccagccaattttctttattttttgtagagacagggtcttactatgtaggccgttcttgaactcctggcctcaagcgatcctcctgtcttggtttgggattacaggtgtgagccatcatgcccatccttaccagctgttcttcaaaaagatataaagttctcattcataaactaagtccataagttcatatatcataaattagcagtgttgctacctccttctttgtgactacctttagccttcaggttcccattttatgatttttttctcaagcttgttcttgatgtttaatcataaattaatttcactctatcagaaaatatttgagatgatgttctgaaaatgatcctagtccctacctcacttccttttggctccaatttttattcttattaatttgagggttttcctcatccttttagcctgggagttaagcatactgactgttacgggagtgtcgaagtagcctttatatgt

SEQ ID NO: 35386 - DNA, 1050 bp, Homo sapiens
tgtggtttggatttatcaagaaaatggatggcttaggctggaaaagtgtattctctggttctgtacttttcaagaagatagacagcttaggccaaagacctgtaactcttttttatataagagttgcagaaacatttcaactgctggagaaggaaacttcctttatttaatcggtgtgataaccaaataaattgatcttacactaatgatgtaagctaaagtattacatcatgaagaattacccattagaatgccatgtaatggaacagaacttggtgtgtttccaagtgcttaaaaagataagaagcacttttctgaataaatattgatgttagttgcagatactccgttccttctcatccactggcaaaaaaaaaaaaaaaaaaaaaaatacccagacaaaaatggaagtccagatctctgtattcacaatggattgtctcacatttgttgccgacaacactgacattatgtaccataggaatttgttggtgaatccattcattattgatcctgccactaacaaatttagtaagactgctggtgcctaagagtgagactattagacatgttcatggttagtctctggagttttgattcctttctttttttttttttttttttttgagacagagtcttgctctgtcacccaggctggagtgcagtggcgtgatcctggctcactgcagcctcagcctcccaaaaagttgggattacaagcatgtgccaccacgcctggctaatttttgtatttttagtagagatggggtttcgccatgtgttggccaggctggcctcgaactcctggcctcaagcaatctgcccacctcagcctcctgattcctctcttgattcctctcttgattcaggtcataacaaagcaaaactctgaacaatattaacctaatctcctatggagtatttatttatttatttatttatttatttagagactgagtctcactctgttgttcaggctggagtgcagtggtacaaccatggctcactgcatccccaacctcctgggctcaagcaatcctcccacctcag

SEQ ID NO: 35387 - DNA, 1033 bp, Homo sapiens
tcccatgcttatttagatctgttccattcaccatctcacatatttctattccaccaacagaatgtctgtggagaaaaactcttgccaggatctcatgatcccttattttcttctttctactttttttctgtgctagagaagatactaaaatatatatgtaattatttttgtaatgctcactgtgcaacatattttcaatagacaaaatttatatttcgctttgtttaatgggattttgttcattaaactttagatttttagaaggataataagagctgtcgtgcgttgaacacttaataatatgcaccagacattgttgtaagccatttatggattaactcatctaggtctcacaataagtttatgaggtaagtgctattattactctcaacctgtagattagaaacttgaggcatagagagtttaggtaacttgtgagtttaggtaacttgtcacagcaatcataaatattgaactgggattccagtgcaagaaacctgtgttgttatactctacattatacttcctatgataaaattatactactgcatatgttttaataagttttagttgtacaaatgagaccatacctattttaagaatacattcttaggcctggcatggtggcacatatctataatcccagtgctttgggaggccaagggaggaggattgcttgagcctgggagtttgaagctagcttggacaacatagtaagaccccatctctacaaaaagtaaaaatattagctgggcatggtgtcatgtgcctgtagtcccagctacttgggagcctgaggcagaaggatgcttgagcctgggaggctgaggctgcagcaaaccctgattgtgtcactgcactccagaccaggcaacagagcaagaccctgtcttcaaaaaagaaaaaaatgaatacctttttgtatcgtacattgtatgaaaatatgcacttaatgagaggaaaattactttcatttttcacttttcatcagaaaaaatatgaaaatttattttattttagaattcggagaaaa

SEQ ID NO: 35388 - DNA, 1034 bp, Homo sapiens
tgggtttagttcagtgcatagaattggtgactattaaaaggagaatcatacagcctggctgcaaaggttgttcatatcagtggaaattataccttaataaagaaaactaaagcatatgtgtggtcacaaccaatccttgtcattatgccatgaaagccttgggatttgtgatcaaagcaatgagcttatcctgaactgtggtgtaacctctggttgaacctttcaaatttttatcttaggagatgatacactaaatgttggccatgttacctgcctctaagacccatctacctaattaagtgatagagattaaaattattttgagcaagccagaagaaaacgtgaattgtaaatgtatctgtcttctgtcagtgttgtttacttatcattttccactgatgttttaaagaattgctgaacatgtgttttttatccagagctgactgttctgttctgatgaatataaaacatacttcactttgtaaatgtgcattaaaagtattagaaaggcataatctttgactctgttactacatttcatctgtcaaaagagataattttgaactgtaatatttggtattgtatcaagatatggttcttagaaagatgcttttagtattaaaatggaattctactgtataacttaaatgccattgtcatccacagtaagattttggctgtattatgcttatttattttgttacatattggtatatatcagttgagttcagcatgtttatttcgtattaagagagtattgcactctcatcaccgacttattcatgcagattttcttgtgatgagactgcaatatagtttaagtacagcatgtcctcaaataacgtcatttcattcaatgttttgttatatcgctggtgagaaaaaaaacatcaattcatggccggggccactttctgtgtggtgtttgcatgttcttcccatgtctgtgtgggctttttccaggtactctggtttcttcccacatcccaaagatgtgcacataaggtgaactggtgtgtctacctggtacccat

SEQ ID NO: 35389 - DNA, 1031 bp, Homo sapiens
atcttcatttcttcaaagctattcttacagtcttccccctatcgtaaatggtttcctatttgagtataagctgaaatctttgcaacgtaagaccctacactacctaactcctttccaaaatcctattacatcttgagctcttctgtttgccaccccgttcactctgttctagctaaacagggtctgcttggtgtccttcaagtacttctgacctcagcacctttgattttccttttcctttcacctgaggcatttgttttagttatctttaagaactcattcttcatgcctttcaggtttttgctcaaatgtcaccttttcagtaaggccttctctctcctccctatttaaaattgcccccatcacctcatgcacttttacttactccctgacttcatatttctttatgtcactcaccatctgacatacttatctcatgcttattgatttgtttattatgtcatatcccacttgaccattagctccatgagatcctaaatttttgactgttttcctcattggtttatccctacaatctacaaaggtgtttggagcatggtaggcactaaattaaatatgtattgaattaataatgtgatgaaatgaggaagagggttctgagcaagggaagtgacatgaacaaagctcagaaaagacgtttggcacattgcttattgatctgttaattggtcttatgtttcgggtgtgtagaaaacatagaaacagagattctgaaaggcagttgagtctaatatgaaggcctttggtaacagtctaaaaatgcttgagttaattatataagccagttcagcaagtaatagccagataatagatatgattgactttgcaatctgcctgatctgtgtcacagctattaaagatatgcaaacaaatgagcatttggttgactgtaagggacaggaggcataaagcttttctaagagttagtgaaagagcctgggaaaaatagcgaggtagtttgaggagaaaatggagagtgtatgcttattctagccagaagggcacagcca

SEQ ID NO: 35390 - DNA, 1049 bp, Homo sapiens
ccatttataagtagagagacctttagcagattacttaattttgaggatcctaggtagcaaactgtgtagctatttaatttatataaccctgaagaaaatttttcatgggtacactgacctttttaaattgaattattacgtgttcaatgtggcatgttagtttaaaatgtgtctgtgcaactctttatgtagaatttaatactaagttcaggaaagtggaagcatatatatttaaggaatatatatgtatatggatgttataaggcatttacaggatttgttgaagttttgcttttaaaacagaattagtccatttattttgtatggctgtgtttcgaaacttacatcttttaagcattagtactctgtatagcagatttggttttctgtagaagttatcttctaatagaagtttttgaatgactctaacagacgttaattctacacttaattcaagcagcctccaaagacattgttttttaacattagtcagaaaatgataaactgaagcaactgaaatggattgtggttaatattactgtcagggtgatgaataatcctgacatataccagcaacacactgccagtcagtaatccttctcaaagttaagtatttattctctaatcatgctaagttactgtgatgtggagtgactatttattattatttataaatgaattgttttatttgcatagcattattaattttatcccataatgctttgtatttgtttggtgctgggtgtacaaactgaggtaggtttagagtagggaatatctactgtgaatttacataggaactattttcaaaacacctaggaaattttttttaagtttaattagtagtagtaactatcctcctgatttggctatttttttttaattatagaaagtgaatttagtagaaggacatttaaaaaacatgtatgcatttgtagcttttaaaatatacttgcatgtatcaacttctgattcttatcttgcctatgattttaaaagttactttgtatgtgaatatgtactatgcttttttacagtggataatgtaa

SEQ ID NO: 35391 - DNA, 1026 bp, Homo sapiens
aaaggaaggaagctctgacatatgctacaacatgaataacccttgaggatgttatgctaggtgaaataagccagtcccaaaaaggcaaatactgtatgattccattcatatgaggtacttagagttgtgaaatttatagagacaaaaagtagaatactggttgccagggcctggggtgagggagagaatgaggagttagtgtttcatgtaataggtatagagtttcaggattgcaagttgaaaaaagttctcaagatggatagtggtgatgattgttcaacaatgtgaatgtatttaatactaccgaactgtacgtttatgttatgtatattttgccaccattaataaaagagaaaccagcaagaaaaaaaaagttagcaaactagaaacaatttgaaaaagtgcttgtgtgtttctgctcttgcttctctgtgatcactttgagaatatgccctaaacattcccaagttaacctgctgatgggttgtgactgacacatggaggacacttgagctgtgacagcttaggtcatccttaacaagctagtcctcagctgacctgccagctgaccacaaacgtatgaaggagtccaactaagagcaacaaagccaggcccagatcagcagaatttcccaattgacccattgaccatgaggaatgataaatggttggtttaaaaaaaattgaaaagaaaaggaaggccttacacctcggtatcatatttgttctaagaccccatagtattatggaatctgtagagctctgtagtctaataaatgaggactgtattagtttgacttgtgtaatgagccatgcagtaggtcaataataaaaactgggcagctctttaatcctcaggctattataccctactctctctctatggtttgaattttgtgtttgcaaaagtaaaaatatcatttttggggggttgattttgttagaatataaaatttgcttcacaaaatgaatgacatatatatgaatacgtgttctagggtcctagaagtattgccttgccttctg

SEQ ID NO: 35392 - DNA, 1042 bp, Homo sapiens
tgggaaaaaagagaagcacatgtagtcaaagtaagctgaagaaagaaaaaaataataaaaataaatgatagagaaaaaaatcagtgtaatgaaaagctgtctcttgacaagattaataaatgtattaatagtaaatatctagcaaagatgcagaaagagaagacacaaattaaaaatattaagaataagggagggaacatcactacagatattaaaagaaaaataaagaaatattatgaacaaatttatgctactaaattagacaacttagatgaaatagatttcttgaaaggcacaagctatcaaatatcactaatgaagaaatggttaatcttaatagttctacaaaggaaattgaattgtagtaaaagaccttacctcagagaaaacttgtagttcagatgaattctatcaaatgtttaatgaagaaataataccatttctacacaaactcttgcaaaaaatagaaaaggaggttaaattgccaaaaacattatatgagaccagcattacctgaacaccaaatgcatacaaaggcctttcaagaaataggaactgcagacatcctgattggaaaggaagaaataaaatagtcattttagcataccttcttgaatgtttatgtggaaagtcccagggaatctatgaggaaaaaaacagcaacaacaacaactgttagaactaataaatgagtttagctgttcatagcatactgggtcagtatataaaactcaattttatccctgtatgctagcaatgaacaatcagaaattgaaattaaaactagtgtttaaatactatcaaaaaataaatacatatagataaatttgaaaatgtatttataagacctactcactgaaagctataaaactgttttggagaattaaaacttaaaaatggagaattgtactatactacgctcatggattggaagactcaatattattaagatgtcagttttctccagaattgatctgaggtccaaagcagctctatccaaaatctgagcaggctttttctttctttctttcttttttaaaga

SEQ ID NO: 35393 - DNA, 1043 bp, Homo sapiens
atcttaaaagtcatttattctattttgtataattggttaaaagaaatatattcctcacaaatgaatcttcctttgtaataacactttatttctgaatctgtaaaattaatgtaaactggattttgctgaatttaccaaggtaattacaccctgtgaggattggtctcggtagccaactggtttccttctttaaataatgtttacttctttcttctaatagcaagattgaagagattagaaatttgagaggaataaaatagagcttatttgtatatggaaagagatgtatgtctgtaacggctttccttgcctacaacctagcataatatagttatataatttcattcagatggaaatagcaggggttttataagattccctagtgtaaaagagaaatcagatataagtatgtgttgcataattggtgttttgtaaaaattgtgaaatatttctatccttacgttcctggatgctggtttttcaagcctgtgccatgatactttgatgatattgtaactctctaaaaggaagactgtttctaaaacagaaacatcagctaaagtgaacctgtagttccttgtatttgttctagagatctgtggttagtttgaatgatgacctaatctgtgtcagaggcaggtaggccgtttatctagcacacagcccattttcccacacacagacactgaggctgaattatttgctatttcaataggtattatagattgaacttgagtccctgataaatggttatcaaagtaatgaatcttttgggctatgaaaaaaaagaacataatggaaaaacactgaaatcaaaatgtgttctcttagtagaaaaaaaaaagccagagcatgtcattgactgcataggaacagcataaaataatattttcttcagttttttttaaatatgcagactatacacaatgccttctgatgctcactccatagctgataatacttcatataagacataaatagaaaaatattattgtctgtaagtctgttttcagtacatatagaattgaaatctattttaacat

SEQ ID NO: 35394 - DNA, 1047 bp, Homo sapiens
atataaatacaaatggatacatagaaaaataaagaataggtgtgtatacatggattggtatatatgcatacatttattagctttgttcaccagggtgtctagaagtaatgacactccagtagcaatgagaatactcaatgcccaggtcttagtttctaataccatgctccaataaaaggaacccaggactccccagagaaatggttgaatctgttgctgaggccaacactacacaagatgagcctggagcatattatagtgccagaacatacataagtgtccgaagaatagaataatgggattaggtcaaagggacacaagagccaaatgaaagagctctcaatagtcaaagtcaaaataatttgaacaacaaaataaataacttagttttggtttataacctaaagtatgaagtaaataggagtccatactgaaataaatagctaaataaattagtaggggagagaagagttaaatctcccttatagaaggagtctaaataatttatgtagatactccccccaaaagaaatggaccattactccccacctgctaagtgtgggctctgcttagtggcttgcttccaaagagtgcaatatggggccgggcgctgtggctcatgtctgtaattctagcactttgggaggccaaggcaggtggatcatttgaggttaggagttggagaccagcctggccaatgtggcaaaaacccatctctactaaaaataacaaaaattagctggttatggtggtatgtgcctgtaattccagctactcagggtgctgagacatgagaatcacttgaacctgggaggtggaggttgcagtgagccaagattgcgccactacactccagcctgggtgacagagtgagactgtctcaaaacaaacaaaaaaacaaagggtacagtatggaacagagcagcaggaaataactaaaataactatacagtggaaacccctgagaaatgctacttcaaccaggtaattaaggctaatatcagtgacaaaacacgttgatagcatgtagctatgatatgatatgat

SEQ ID NO: 35395 - DNA, 1029 bp, Homo sapiens
tgctatgatatcttgtttaacattgtgatattgtacagaaccagagtttgtctgtagtatcatctagctgtagagtaccctgcttggccaaatgaatcactttcatttgtccagtgcaactgaaaatttctcaaaaaaaaaaaaaaaaaaaaaaaaacaactaaccagtaggttaatgcatactaaaggtatgaatgcttaagtattttcttcagtttatagtgatatttctgtgtgaatgcccctgtctttttgtttacaaaatggagaatacaaatttgaaacctagtgaaagatggcaactatcaaagtgttatcttagttttaaagaagcttgggattatgttaatatttagggaagttttatttggattccttgaattagttaccttttgaggcttatggattcttaaagcaataaagcaatattccttttaaaatcattgtttttcttctgtttattaatcattgatttaatctgtgtttttctgttggattagagaaaagatttacctgagaatcttgcaatctctatatcattagctatattataggtagagcttctttgctttatctgtaatctctcctgaacacgttgctttttcaggaatgaaaaaaaaaagaagctgcagaaaggggtacaaattaaattttcatgaaagaaaatcctaatcagcagtgacagtgtaagagaaagatgattgccacttggtcattgtggagaggcacttagatttggtgtcagtgcttctgttaatgatgactaatgtctttcttggagcaagtgcatgctcaaacatactgctacagcatatagagggagaggcctcagtaataggcatcagtaagcaaaagcattagttgtcttaaaacaaagactttttaatacagtcaatttgacactctgtattattagaaaaatacaaacataattctaaggcatttaaccacaaattttgaactattttatgttcagtactaagaggtaatattttttaattaaaaggtaacgaaaccaaggaatgttaa

SEQ ID NO: 35396 - DNA, 1025 bp, Homo sapiens
ttgagggcattttcttccattttatagttttaaaatttattagaaattggtagcaatgatttgtaacattttcctaatgccagagccctggttagctgttacttactatcagagcattttagatgtagaaggaacctaaggctaacatctagtctaactttattctttacagataaggaaactgaggaaacaaagggccagtataatttttggtagataaaggactaaagcccaggttaactgactgaaacccagattttcatatcagtgtgctgtgctgtcctctaaaattcattattaaatataacgggaattttatatttaaattaaagacatgtaaaaaatgttttaaacggtagaaagattggttttaattcaggtgctaaaacagtttagcagagaatcctattgaattcaagacatttttatttggtagagaacgtgcttgctaatagaaatatataaggagaatttaacatagttttaaaagtatcttgtaagcatatggaatgatacaagtaactcatttggttttctagggatgacagatcatgtaaagatcttaaatcgtgccattgtctcataacttcaataatgccagatactgttgcttcctttttaggatcaacatatactaggttctctatctaaaattttggttagcccatgattattacgagatgcacctggcttattctcctaattatcctttgtagtttcattaatttttacagagtcagttttcttgacttggaatgctatggacatggcataaactatagaggggaatcaattagaacaatagttgattataagatattctttatgtgtcctgttcagaatgctgttatggtgtgtgcttcagatcacataagtagatacccatttttattttatgtatgtttgaaggcactctgttattctaatagtagtcttttttaaaaatgctaattcttaaagtataaacttcttttactttaatacagactattgatgattccagttcacttgctcagtagatgtta

SEQ ID NO: 35397 - DNA, 1968 bp, Homo sapiens
aacacattgcttttgcagtgttacatgacttagggagatgagtggaatgtgagtagattacatgtatgtcctttctgggctgaggtgatatatcacctattggacctttcctatgttcttttttcatctctacacttagctttaggactttgatctctacttcaattataggtctactttttccatgtaacatttaattaactttgtacatcacatggtttggaaactattttgttgtgaacaaaatggctgtatgcttgagcttttctttcatacccttattcatttatatttattgcctaccttgtatcatagacaattttaggcaagtttcaataaaaccttgataggataaatctgaaaaatagaaatttaaaaattagtattgaaggctctcattacatgttgtttattccaataactttcttacttttttttccactttcttgtgaaagtgatatttaagatatttcttccctatagtctaattttctatttatctgcagttataatacctacttaaaactcttcaatatctccccattgctatagggtaaaacccaagctccttaacatgacatggccatggcctaagctgagctgggagagttgaactgtcaggtgtaggagtagccaattaaagtaacaagccaaaaatgaaagggtaagcctttaatcattaactatgatggtattagcaagagtctaaatccgaaggaaggggttgactccccattccatttcccgccatagaatggcatgcttttcaagggttagtgtggatctgcgcagatgtgagagtcatcttattgttgaagaaacttgaaactaaagactctggtagttttatggacacgaggtcagaggaagggctagcggggtggtcttggaacaggctgaatcagagtagggaatactgtcttcagagttttcccttcctctccaagtaaggagttctaggaagagatgcctggagaggatcttaggccaaggtttcagatacagacccaagaatcaattcatcagggctaggaatgtaaatgtgcaaagagcataactggccagagaggcctaagaccttagctgcaactcccgccagagatgcaaagcattcgctgtacatcaagtctgatgtggggagtacagcttttctctgtgaggcctgccaggtaaaggttttgtaactacccatggtaaggcctgaaaaaaatcacacataggttttaaaccaggagccagactcctaaaatgattcttcatgatctggcccctgccctctatagcctcttgtttgggcacttcttgctttatgccgctccaaaaattctggaaacatttaactttagcttatacccaattgtttcttacttgtttggctttgctaatgctgttccctcagaaagaatgattttccttttcttattctggttaacatctgttaactctttgactcaatttgtggattactcacttctaagaaggcttctattactttggataatgcccttcaactgtgtccctaaggtaccttttgcatatattgtaattatctcttcatatatctgtttctcttattggattttgaggaccttgagaataatgactttctatcaccaaatgaccgaatctcctgtctttactcattgttggtattcagtatgtgtttttgattaaatgaacaagtgagtaaatgagtgaaatataagcttattagtttttcattcctgattttttatgttatggctctaacttatctttcatatctcattttctattggaccggctaaatgagactgcttccaattttcagacctctatacttttacttaagatctcctaaaagcctaaaatgtcatcgtcttctttgtgtatcaattgaaaattggcctcttcttaagggtatttctcaaaaatctcttgctctttaaagcttcttggtccctttaaaacaaatgtgattactctttg

SEQ ID NO: 35398 - DNA, 1072 bp, Homo sapiens
ttcccttcagatagatacccagtagtgtgattgcttgattgaatggtagacctacttttaattctttaagaaatttccaaacagttttccatagaggttgtattaatttacattcccaccagcagagtatatgcattcccttttcaccacatccatgccaacatctactgttttttgactttttaataatggccattcttgcaggagtagggtggtatctcattgtggttttaatttgcatttctgtgatgattagtgatgttgagcattttttcatatgtttgttggccatttgtatatgttttgagaaatgttttttttaaaaatacactattgtagttactttaactctgatgtaatttttgatccattaacgaaacattaacgtttttaatctaggtatttaatatgtcagtatagtttagcaaatttctttttacataataggaatacaataaattttttgtagttaaattacattcatttaggaattttatacattagtagtggagcacaagttatccaatttgtgctatgttgtgtaaaactgaggctcctgtaagaactccagtctattttctaccttgattttgagagcaaactcattttaactttgaatatgttagcttcattttagatctatgaaagaatgatcagagtagggtacatatttatcattttgatgggctttatttaagtgcatactagttgcttcttcttgtgctagaagcttgggattcatacaaacagtggggaagaaccagactgccctcagttgtggagcctaatggtatgatggatgttcaactagttatttaattacagcctacttataatcttaggaataacaaaattatataggaatctgtatagtaataacaaatagactgttacaagatggttgatatctgtagaatatgaaatataaacagacttgaatatgtagatacgccttcttgctaaacttaaaaaacatcttactgttaggaaaagtgtttataacaacccttattttgagattctgaagactaactaaatgttttctaagtaatttggagttaaacaggtgtta

SEQ ID NO: 35399 - DNA, 1086 bp, Homo sapiens
ggttctcttcaaatatttgtattaatattttaatgtttttacagacattatgtttgtacaaaacccattgacacactaggttatgacactgtttctaatttgttttaattaaaatacaaatttaagagtttttataggtggttaagatagttttaggcaacaaaaatcacataatgatggaaatatttctaaacatctctttccatagtatgtttttctaaggtagttaccttagagttaaaatgctacctttatgttaaaggtatatattttatgtgtttattttcaaatagctgtttcagagcttgttgcagtgcactgccacagaaaagtttagcaaatttggaataattggctttttaagataattgagtattatcatactattcaaccattattaggtaatttctggtcactttttatcttattgcaaagtattctaaatactgtatttgtttaaaacagtgtaatctgtaaacctgtttaagtagacataaactacagtatgtgttaatatgagaaaattgcatatcacatatgacatgattactgatattcagactgaataaggatgccagaattaaactatatattaaatattaataaagctcaatttctgacttttttctctgcaattatcttccaacatccagatgaattatgttatgtatcccctttgggcatcgctgctgtaagggatgtagtgctattgaaatttgtggagtaaactattgatgtcaacacatctttttaggatagatcattctggtagttctttttgattatagatttgaagaagaaaaacactgccaatagtgaaatcataggtgttataataacagtagactaggcatgagatatggcagaactgtggtagtgggcatggattgaaaattatttaggaaaaaacaattgaaagttcattgtaagaagcttaaggagagggagggttcaaagatgatatacaggctttgtgcttgggtgattctgtggataactgtgtcaacatgatgggggtggaattacaacagaagggagctgggtttgcaatatgtttttgttgttgttgttgttttttgatactga

SEQ ID NO: 35400 - DNA, 1372 bp, Homo sapiens
gcgtggtggcttacgcctgtaatcccagcgctttggtaggctgaggcgggtggatcacgaggtcaggagttcaagaccagcctggccaacatggtgaaaacctgtctctactaaagataacattagccaggcatagcggtgcttgcctgtaatcccagcttttcgggaggctgaggcaggagaattgcttgaacccaggaggcagaggttgcaaaaaaaaaaaataattaaagaaattgtaaacaaatagaatattatgcagtataatgtaggatgctagtatgccccaaactgatctatagattcaatataatcccctatgtaagtttcagaatttttttaatagaaattggtagtcggaacccaaaagataaatggaaatacaaaggtcccagaagagctgcattagtaatctgttgctttgttacaaatcactctaaagcttaacagcttaacacgtcatgcacttattatttcatagtgcaatgggtcaagaatccaggcactatttagctgtttcctctggcccaccatctctgatatggctttagtcaaggtgtccgcaggctgggttctcatctgaaggctcaactgggaagtatccactttcaagttcacttatgaagttgtcagaatttaatcctttgagggctcttggactaaggccctgagttctttgccacagggacttctccagtatggtggcttacttgcttcatcaaagccatcaagagagaggagtcatctagcaaaatggacatcacagtcatttgtaacctaatttttggagtgacatccccttgatgttgccatatttcattggttagaagcaaattactcaaggagggattgtcaagaccatgaacactaggaggcagggagcatttacgggctatgttggagctgtctgtcacaacagccgaaacaatgttgaaaaagcacaacaaaattcagtatatacactacctaattccaaaacttaaagatacagtaattaagacaccatgctattagtataggatagctgtatagatcaatggaacagaacagataatcccaaaataaaccccagttttttgtggcaaactgatacttgccaatgtaccactgtaacacgatgtggaaagcttagattttttttttagaaggaataattcaacttcattactaatgtcagagatccatatgcttcctacaggtatttattatataattatgagaataatatatttttactgtagaaaatataaatacacgtaagatgaaaagaagaacaaaaaattacctttaatcacaccatcctttccaagccactgttaatgttttagtctagtcccttctagacatattattggcatcaaaaaataaactt

SEQ ID NO: 35401 - DNA, 1024 bp, Homo sapiens
atcattaatagctactaaaatcattaggaaagaagctgatatggattttcctaatgaatagacaaagctgacagtacctagattcacagaccaatattaacatcaccaaaaaggaaacaagcaggcgttaggtgtctaacctcaatttgatcaagtctcgattactgtgcagtctagtatggttgccacatgtggctgttgagcacttcaaatgtggttagtctcaactgagatgtgccataagttgtaaaatgctcactggatttggattaatattcaaatgatgaaagaatctaaatattttatttttatattgattgtgtgctgaaatgatattttgaatatattgttaaaaatatattattagaattaattttatctgtttctttccttttttatgtgactgttagaaaactttaaaatgtatatgtgatttgcattgtatttctaatagaaattgctgttttaaatctaataaccagtttatgggaaacaaaaggaaagggggaacatgttacaagaacaagagcataattagaaaaattcagaatgcaaaaaagctggatgcatgcagaaacagcttagtttctgcaacaaatagatgtcaaaaatataaaaataaaagaggaatgtatatgataaggcttatgaaatacctcaacaggcacattttatggaccttggatcctgatttgaacaaactagctgttaagaggtgggggaaaggggaagaggagagggagagagagaaacattgagggaaactgaatattggttgtttcctttatgtattaaggtattttcccctaacttgtataggtgtgaaaatgatattggtgccccgcgtagtggctcacacctgtaatctcagcactttgggaggccgagtcagctggattgcttgagtttgcgaccagcttgggcaacatggcaaaaccccatctctacaaaaaatacaaaaattatctgagtgtggtagtatgcacctgtggttccagctacttcggaggctgaagtgggagaa

SEQ ID NO: 35402 - DNA, 1040 bp, Homo sapiens
cacacacacacacacacacacacatcagctatgttgtgggacaaagtgaaaatctaacagcattacaaatgaacagcataattgctccaataattgtgggggagaaagataatgaatctaaaattcctttatatgtatcctaggattagagcaaataagtaaatatattttggatagtaaaagcaagatttctttcttttggagaaaggagttacaaataaggagaggaaactctagaatgaatcctgtggtgattgattggaatgaaatatcaatgtgaatttattgttatgtgtacacacatagaaagatgatataaacaattacatatacatgtgttagtatgcacaattagcatacatacttatatcacctagccctgtctcctgagaagacatagaagcagtgacaaccaatgataaaatgcaaacctagttcccaaatcttagtttctgtatgccatttgttaacttaaaaaactagatctttttggataaatggctgatttcagagctaggaaagggcaactataagattatcttgtggtgccagaaggtaaggaagtactcaaaaatgggtagcagcatgtcaaaaggacataaatcccaaagatctttaaatagctaaatctgtgacaatttgagcaacattataatattgacagtaatagattaaaaacccatagaataaatattttttagtttatcgtgaagtcaataatttataaatgggaggtaagagacagctcttctttacagtagaatgtcaatttttaaaagtaaaaagattaatagatgtagaaaaatcatcttttggcagacaccacagtactgtacaatacaatacagtttaggcaataatcagtgaatactgaaacttaaggcgatggaataatgagaaaaaagataattccattgtttcaaagtatctcccaacaagatagttattaattacaagcaggaaacatattaacttcatagttaatatgtagaaacgtggcagacatcatattcaccaaatgatcaacttaataccatcag

SEQ ID NO: 35403 - DNA, 1042 bp, Homo sapiens
tttttattcctataatatagtcatcaacatgttaatgtatctggactatcttagaacttagggaatttgtagtcattaaatctttaaggattacttacaaggcctggccctaactggatactcaaacgttgaggatggggatactaataacattaatagtagctatgatttattgcatacattttatgggtcaggtatacattgattcatttaatccttacaataaataacccatgagccaggtgggcattatttattatctctgttttacagatgaagaaaagacaaagactgattaataaattgctcagtgatttcaactcaaaactttatgttctgctcttttaatcgctacagtatactgcctgtccttgagttgcaccagaagaattgagtaaaaaatgatttctcttccttaatgataagaaatggactagatagggtgtcattatataatgatgagctcttctaaatgagtaccttcataaaccttggaaacatcagtgagtaaacttttgaattcagaagagacccattgatgatactgagcattttaaaaggtcttttattgatattattgcctctgttcctgtattttttacattgcacaaataatttttactttggcactttgtgtcccaattatcattactctggtaggagaagttacacagaaatgtgtttaaaagtaatttttacaactgctggacataagtacctttatagttattgatgggttttttaatagttatttatagttattgatggtttcttacatattctctagaaggtagtgaatcttactaaataaacttggcactttgctttgacatacctgacaatgctattttaaaaatacaactcttgaaattatattgtggttgcaaatttaacttccagctgggtgtggtggctcacacctgtaatcccagcattttgggaggctgaggtgggtggatcacttgagatcaggagttcgagaccagcctggccaacatggtgaaaccccttctctactaaaaatacaaaaaaattagctggg

SEQ ID NO: 35404 - DNA, 1033 bp, Homo sapiens
ggtgcgattttggctcactgcaaactgagcttcctggattcaagtgatcttcccacctcagcctcccgagtagctggcactacatgtgcacaccaccacacctggctaatttttgttttgttttttgtagagatcggttttgtcatattgcccaggctggtctcaagctcctgagctcaagcctcccaaagtggtgggattacatatatgagccactatgtctggcaaatatagcaatctatatattttttaggtgaagaattcaaagatttttttccaattagcaagcaaaatatttttattaaaatagtgaacatttttgtgagtacttataaatttttaaaaataaacacttctatagtaccacttgtttttctgaattcttaacaaatataaaataaattatcataacagtcctctgaggtaaatgttattatcttcagcccaattttacagataagaaaactacagcgaggctcagtggtttgttttaggtcatatagctagtatatgatgaagcttggacttgaaccagggtagtctgatacccagtataaactggtgatctctttgctatgtggcctaacgtcatctattaagtgatttagtacacattgtctcatttcagtaccacaacacatctttgatgtatgtatgcaaggtagattgagagaatgtgatttagctttgatcacagaacaattaaatccatgattctgaattagaacccaggtttcataacaataacccagtacagtctgtccccatagcctctgtcgacttcatggcagtgttttgctattgtaataatatattctattattgaacatattcttgacagttctaaaggaatgtgaaacattttaacaattacatattttagtgttatgtattttagggtactgtatataccaattttagagctaatcatgagaaattattcaattttcctcttaagtagctgcttttctcctcattgatcgatttttaaatttaaacgtgtttatttttctaattataaaaatgaagtatt

SEQ ID NO: 35405 - DNA, 1031 bp, Homo sapiens
aagtagcaactaattcttacaacaaacctctgagatagtactgatattatccctcattttataagtttgaaaatagcatgaagtagaaataacctagagttacaacttggatccagatccaggtaatctgtttcccaattactaatctatgaatttggttcaaattttattagatttctaaagaccgtgtgaataggatctaatcctcgaatacattgcagctttattctaagctatttaattttatgttttgtctaatatagtttttcattttaatcattgtgctatgagatttgcaatattgtgtagtattttaaggtgttataataaaatttctaaataaaacaagaaatatttccaaataaatattgttgttacttaaaattttagcagagaaaatatatttgttcatctcttctacatcagagtcaattttaagagagcaaacgtatattttttcttatgtctgctagtctttaccctttttcaacaaacttcaattggttgaagtatgctcatgttctaactgtattgctcttaaacaatactctgcaggatgaggcattttttttttgagacagcttatatcttagaggttatctgtattcagccttgaattcaagctgtacattcttaaataatataactgaattttatctactgctaattaccttcttctgcaaaaaaagatgttgtcatctatttaatgtacgatttgtgtgtaaagtagctgacttgtttcatttattatcagaggattgatgacagtgtagatctgcaatgtgcatctatttagttcattgcatgcttatcattggagtgggatatccttgacattttatgcttttggtttacagagaggttccatgaatgtcatgacatcattgatgagctgtacatcttaactttgtttcttaatcttatggttataaacagaatatttatgaaaaaaattatgtcatgcagaaacatcataccttgtaaacattgtgcatgtgtgaatatacaagtttcctggcaatcatttttgt

SEQ ID NO: 35406 - DNA, 1058 bp, Homo sapiens
gtattgttttcttcatttcaaattcatttatttctgctctgaacttaagtatttcttttcttctactaattttgagttcagtttactgttacttttctagttctttaagatgcattattaggttatttatttgaagattttctttttttttgacacgggcatttatagctataaattctcttcttaatagtgcttttgctgtatcctgtatgctttagtatgttgtgtttttattatcatttgtttgaagaagtttttcaattttattcttaatttcttcatcattacactggtgattcaggaacatattgtttaatttcaatatatttgtatagtttttaatattcctgttattattgatttgtagttatatttcattgtggtcagagaagatgcttgatatttcaggttttttgagtgttttaagacttgttttgtgacctaacgtatggtctgttcctgagaatgacccatgtgctgaggagaagaatgtgtattctgtagctactggatgcaatgttctgtaaatatctggctgggcgtggtgggtcacacctgtaatcccagcactttgggaggctgaggcaggtggatcacctgaggtcaggagtttgagaccagcctggccaacatggcgaaaccccgtctctactaaaaatacaaaaattagctgagtgtggtggcatgcacctgtaatcccagctgctcaggaggctgaggtaggagaattgcttgaacgtggaagatggaggttgcggtgagctgagaatcatgccactgcactccagcctgggtgacagagcaagactccatctcaaaaaaaaaaaaaaaaaaaaaaacaacgaaatgttctgtaaataactttagatccacttgttctgtagtacagatgaagtctgctgtttcttttttgatttttttttttttgtccgtgagatctgcccaatgctgaaagtgggatattttgatgtgtctagctattattgtattggagtctatctctctcattagttctcataatattttccttatatatttagttgctccagtgttgggtg

SEQ ID NO: 35407 - DNA, 1197 bp, Homo sapiens
tctgggctcagtctgcccacctcagtatcctgagtagctgtcactacaggcatgtgccactatgtccggctaatttttgtgttttttatagaggcagggttttaccatgttgcccagctggtctcgaactcctgggctcaagcagtccacctccttatcttcacaaagtgctgggattatagacatgagccatcatgtctggccactactcatttttgtatgttggtttttgtatactgcaactttactgaatttgtttatcagttcttatagttttttggtggattctaggtttttctaaaaataagatcacatcatctgcaaataaagataatttgacttactcctttccaatttaaatgctctttatctccttctcttgttggattactctagctaaggcttccagttctatgttgaataatagtggtgaaagtacatgttcttgtcatgttccagatcttagaggaaatgctttcagttttctccattcagtatgatactggttgtgggtctgtcatatatggcttattatgttaaggcatattccatttgtatcacgttttttttttttgagggtttttatcatgaacggatgttgtactttatcagatgctttttcagcatcaattgaaatgatcatttttttatccttcattctgttgatatcatgtatcacattgattgattgatttgcatacattgaaccatccttccacccctaggataaatcccacttggtcatgattaatgacctttttaatgtatttttaaattcagcttgctagtattttcttgaggatttttgcatcaatattcaccagtgagattggcctatagttttctttttttaatatgtctttgattttggtatcagggtaatattggccttgtagaattagtgtggaattcttccctcctctattttttggaatacttagagtaggattggtattagttcttaaaatgtttggtagaattcagtgaagccatctggccccaggcttttctttactgggatactttttattaaggcttcactcttgtcacttgttattggtctgttaggttttagatttcttaatggttcaatcttggtaggtttatgtatctaggaattgatccatttcttctagattttccaaatttattgacatatagttgctcatagtagccactaatgatcctttgaatttc

SEQ ID NO: 35408 - DNA, 1043 bp, Homo sapiens
agtcaggtcaggttaaaaaatattctatagctttatatattctatatctggtagtaggccatattcttaagagcatacaaatttagaatctcaaaatactaaatttctgtatctctagttcatttatccttttattaatttaacaggtttattttatttctgtttgcttctcatactaaaaaaagtttattaccttttagcttttaaaaattgttcatgttttctgaaattatacttttcaatctttgtttaaccttatattgaaattgtgtcacttacaagcatcatatgccttaaaaaattgatttgacaataattttactactaaatgtttactttctatgtatttctgatatgtttaggttaaaatttatcatcttattatttatgtcctttatatttgctccacatcttgtgtttcttttttttttccttcttctgagctaagtatttgttgcttaatttttttcccattggcttgttggttatatattattttaaataactttagtggttacccagagattgtagtatgaatattataattaacatcttacataaactgattcttttgccaattgatgtatgacacaagaaacttataacactaattcagttggtttctcttgccttgtatgctgtggttatatattttagattgcagtattttttaattctagaagttacataattattgtaaacattcagtatacttttagatttacccacgtttgtcattttcattgctccaattgttttccttgacttgtatcaatcttatattatttttcatccttgtgaagtatgttggttggctggtgacaaattctcactattttatttgtcatggaatgttcttattttgcttttgatgatgaggaaaagttttcctctaccctcttaggtttgttgtttggggacctgtgaattaaacagacaaacacagcttagcaagaaaaaagacctatttttagtcataagtctgtcagaattcggccggctgctgtgtctcacacctgaaatcccagcactttgggaggcca

SEQ ID NO: 35409 - DNA, 1042 bp, Homo sapiens
ttgatttttttgttgagatagggtctccttatgtttgtcagcctggacctctttcttttttttttttgtttgagatggagtttcgctcttgtcgcccaggctggagtgcaatggcgtggtcttggctcactgcaacctccgcctcctgggttcaagctattctcctgcctcagccacctgagtagctgggattacagatgcctgccaccatgcctggctaattttgtatttttattagagacggggtttcaccatgttggccaggctggtcttgaactcctgacctcaggtgattcgcccgcctaggcctcccaaagtgctgggattacaggcctgagccactgtgcccggcccctagcctagacctctttttttaaaaaaaacaatttagcccaggtgggaggattgcttgaggccaggagttcgataccagcctgggcaacatagcaagaccctatctctaccaaaaagaaaaacatttaactgaacttggtagcatgtgcctgtagacctagctactctggatgctgcagcaggatcgcttgagcccaaagattcgaggttacagtgagctagggtcgcactggtgcactccagtctgggtgacagaggaagaccctgtctcaaaaataaataaataaataaaaaacgtcaactttattgaggtataatttatatacagtaaatacccacacattttaagtgtactgttcagtgaattttgacatatacccaaccattttaatcctcaaatttccctgtgcctcttttcaatcaatcccctcctctgtcacctcaagttgccagtgatttgatttctattactgtggattagttttacttactgctgaacttaatataaatagaaatttatttcttttaagtggagtggttagctattcatagtgtgctgtgtttagggtacgcttcaaccttttttttttttttaactaaaacttactatccggtattaggaaaattatgtatttatttcaaagaaataattgaggtaatgaaataaaggattattttttgccaacca

SEQ ID NO: 35410 - DNA, 1021 bp, Homo sapiens
agatcaggataaaaacgaatatttttggcagaaggactgctatgcatagcagtaatgtctctttaggtgatttttaatttttttaaataattatatatatatatggaaatacatctttattttcaaaactagaaaattgatacaatctgttgaatagttcaagtaacttaatgtcttttccttagtattacagagaggcttgaacacgctttggaaaaggcagctcctctccttcgtgagatttttgtggattttgcaccttttctttctcggacacttttgggtagccatggacaagaactgcttatagaaggaacaagtaagtggtttttctttattttatttgtatgtatttatatttcaggattaaaaacttacatggataatgaaataacatggagtttcattgtttaagtgttgtcagcctttgacaaggtttctcataggctatcttttgaagactgtgtcacatgtctattatgttgtaatcttcaagatttttatcagtgatttggatggagcgtagaattatgtgttgaaccaaagaactaagacttttttttttttttgatacattaaaattaattttgagagcaaagaattggagagactagtgtcacaggattttacttgaacttagatccatatgaacaacaatgtattgccacacagataaggaatgcattgttatttgtagaattctgttttacaaatagagataacagcattttactctatactgcttacgtcattcatagattcctgggtctcttctaggtagtgtactttgagattgtcaaactagatagcatgctgaggtaggttgctgaggggattggaaaccatgctatttatggagtggatgaggaataatgggtcctttccttctccttctcctttcctttcctttcgtttcttttcctttccttctcccttcctttcctttcctttccttctccttctcctttcctttcctttcctttcttttcctttcctttcctttcctttcctttcctttcct

SEQ ID NO: 35411 - DNA, 1027 bp, Homo sapiens
acacacacacacacacagacattcgtcatatctactcccccttaagtcaataatcttcatctgatataagctgctgtgatttaagcacaccattttggattgggggctcaggtggctgttgcttctattttttagtgtatagttaacattggcagtcacccttataatgatgtgacaccagctaccctgaagtacattgaataagccatgcctagcacaagagaccttgatttaattggcaacagtgtttgccctcacatgataggcactgaggtaaaacgaaacctattttgctttgtgtgtgtgtttttaaaaataactacaaaaatgtattattaaaatattggaattacataattttcacttttgaatgcatgtatagggatcaaatacctaagttactttgtttagaagctgaatactttaaagctattaagggaatacttgaagctcgcagttatagtactgtcaacaaaagatgtgattaaataaattgaatgttgaagactttgggcttatggttaacaccaggtaattaaaagtaagcactgctgtgggagtgcattatatatcagctgtcctctttacctcattaactgagtttttgcatgtttatggagccaacttcaattaaaaatgccttttaagttatgcctaacaaggtcttttacttactgtttggtataaagtattacattttaattgaaattggtatatcataaatacctgtgtttgaataatatacaagataaagaactttgactatttgatatttttgcgtatggtttttattcctatgcattgcttttttatatattatcaaaagatatagtctttggggtttaaaaatgaaaaactgggttgtatacatgttagcaaattgcttatatctgctttttttttttaagcttataagatttctaaggttttattatttcagattagcagtgctttacaattcttgtggaaacgttgaattttctgctttaatacttttggttatattttatttgttagataattaaga

SEQ ID NO: 35412 - DNA, 1046 bp, Homo sapiens
gtagaaggggtaacaagttttccagctgcagtaaccatgtttgaggtagagctttttattttatcctaaagattgcggacttgggccaggcatggtggtgcatgcctataatcctagcactttgggaggccgaggcaggtagattgcttgagctcaggagtttgagaccagcctgggcaacatggtgaaacctcatctctacaaaaaaatagaaaaattagccagacgtggtagcacatacctgtagtctcagctacttgagaggcttaggtgggaggatcgcctgagcccaggaggtcaaggctgcagtgagcctaggtcacaccactgcacttcagcctgggcaacagactgacacacacacacacacacacacacacacacacacacacacacccccaaaaaagattatagactttttcttacaggccaatgactttcaaccttgtgttgctacccattactttagatcatttttgcaagtattttattatttattttattataccatctgtcttgataataggtgcacccactcagtacattctgtagaatacgtaattagtttttgcttttttagaacatgatgtatttcataattcaaaacagtagatagctattaaaacagaatataccttttaaaaattagttctaaacttttgtttgtttatttcttgtgtttctgggtatgatatagaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagt

SEQ ID NO: 35413 - DNA, 1050 bp, Homo sapiens
tattcctttagggaaatctgcagcgaaggtaagtatacagattaattaattttcaaaaagcatactcctattttacaattaagatttttatttgttcatttcaacataaagttaaataaatctggcagagattaaaatagttactttaggcctgcatataacattcaaatatttgtgtttaaatacacaataaagatttgtttatatttaaacctctctgcttttcccagtgtttactttgattgtttctgtgatgccttttccttcaaatatgtcattttttcctgcatgccatctttctccacctctctccccaacccctcaaagaagaaggaagcatacacacaaaaaaagtggggaaaggaatgctatagctttgcttttctggttctgggaatactgtgtttatttttaaagaatatctgtgtaatgtatatatgaatatatatatatacaatttttttttaatcttaaatagagcccagtggacattgtgactggcggtatatctccagtaagagatcttgacaggcttctacaggacatggatattaatcggcttagggcagttgttttcagagacatagtaagttacaatatgtctttcacatactctcttaactgatgcatatttcctcttaggcctaatgtattgagattaaaaattctttgtgatatcaaatagtggagcagagatagaaaggtctagaaacgacttcttttgacaatgattttagaaacagaatattagaaaagatagtttatataaagcgagctagcagatcagcatagtgatattaaaaggaataatgcattattacatagtaagcagtctaagtgatatacatgtattaattaagtccaacaacttattgagctgtactattgtaatttccattttatagatgaataatctaaggcacataaagcttgagtaacatctccaagctagtgttgataaacaatgataaaatcaggattcaaacccagcagtcttaattctaaaattgatgctctgaatgtaataaaatgttcaacttctgaatggca

SEQ ID NO: 35414 - DNA, 1063 bp, Homo sapiens
tatagagaaaggaaaaaaaatattttttgagacaggtgaagtgtagtggtgtgctcatagctcactgcaacttcaaactcctgggctcaagtgatcctctcacctcaacctcctgagtagctgggactacagacttgtgctaccacacctggctacttttttagtttttttgtagagacgaggtcttactgtgttgctcaggctggtcttcaactcctggactcaagtggccccccgcctgggcctctgaaagtgctgggattataagcatgagccacacacccggttagaatgtgtgtgtgtgtgtgtgtgtgtcttttttaaatgagacagagtcttgctctgtcaccctggctggaatgcagtggtgcaatcttggctcactgaaacctccacctcctgggttcaagcgattctcctgcctcagcctggcgagtagctgggacaacaggtgtgcacctccacactcagctaatttttttgtatttttagtagagacagggtttcaccacgttgcccaggctagtcttgaattccggagctcaggggatccacccacctccacctcctaaagtgttaggattacaggcgtgcgtgactgcacctggacttttttttttttttttaaattatactttaagttctagggtacatgtacacaacgtgcaggtttgttacatatgtatacctgtgccatgttggtgtgctgcacccattaacttgtcatttacattaggtatatctcctaatgctacccttccctctcccccaccccatgacaggccccagtgtgtgatgttccctttcctgtgtccaagtgttctcattgttcaattcccacctatgagtgagaacatgcagtgtttggttttctgtccttgtgatagtttgctgagaatgatggtttccagtttcatccatgtccctacaaaggacatgaactcatccttttttatggctgcatagtattccatggtgtgcatgtgccacattttcttaatccagtctatcattgttggacatttgggttggctgcaagtgtttgctattgtgaatagtgctg

SEQ ID NO: 35415 - DNA, 1056 bp, Homo sapiens
catagtgtgttctgctgtatgcgtaactcaaaactgaaacttccacgcttattttcttagctgaatacagatattcatgttctacctcttgttctttgtaccagaagtagtttattttaaaaagaaaattttgggggtagaacaagtgttggtaaactgaagtctttaggaatccagttagccacctgtaaataaagttttattggaaaacagccacaataatttatttgtgtatcatctgtggctgctttcatgatacaaggacagtgttgagttgtgacagaaatcacctggtccacaaattctaaaatatttaccccctggccatttgcagaaaagctttgctgaccccaagggtaaaattaaagtttgtgatcctttagtttctgaatttatgcttggaaggttaattttggtatatatgttttcatagtatttattttaaaaaattatattacatttcttctactttttctccacattgtttttctacttaagtatttattgtgctttagatgatcatccccaggggagactaagttagtgctggtagattgtagcaacttcgttaaataaataactgctctgaagattttggaggaggtttttgctgtgctgtagcataggcacacttgtcttttttttttttaatttttaacttcggctatgcttatatagttagcatttctctgcttaaaggttttgtggccttaaaagttctagattgaagatagttgggagagtaattgagttgggaattgtttgtaatgtgaaaaagtattttgtgtttccttcatccagcatgcatattaagtagagcacagaaaagctctacatttgatgatttctttttgtgtaattgcaggaggaaagcagaagtcatgcttggacatggattgttttcattgctagctgaaaggctcatgcttcagacaaatttaatcacaatgaccacatataatgtgctgtttgaggtaggaatgtacttaggatttactcctctaaatttcttattataaaaatgcctcttaacattgtgtaggtaaataagatcat

SEQ ID NO: 35416 - DNA, 1049 bp, Homo sapiens
tttgaagcactggaggttaagaattgaacatatgtcctcttggagaacacaattcaacctgtaatggggcatctggcaaagtgtcatagtggcacagtagtgtagagcatatatgaagctatccagtaagaatatagtcagggaataggctgttctgtggtttctcaacttaccagggcacataaccaactatcaaaagtaggtcaaaaaagacacttttggtgaactaacacctgctatggtataagaatggggaataaggatacatcatttgagatagttatagataatatatattttttaatttctgagaaaatgcagtgaatagcatctatattagtcagaatataggcttttaactgatagaacagagaggcccaaattaacagtggtttctgcaaaacagaaatgtatttgtccttcaggtgaaagtctgggtagcgggctagtgtggcagttctatgattgccaggatccatagatcgatttgctcttttatcttcaacataagacaccttcaattccaggatggctactgtagctcttgccactattctgcatcttaagcagtaggaaggagcgtagctggaaaaaggggtcaggtttctttctttaaagaataatacctagaggttgcacgtatttactgcctgttggtcagaacttggtcacatggctgatcaggaatgcttttcattcaagaaaagctggagagtgagatctttttcctgggctctgtgtgccaaactagaaactctttattattatggaagaaggaaatataacctgggagtcagtgcagtctgtgtcacagctttgtaattttccctcaacttctccttattagtaagtttccagtggctgtaaacatatacaaggtaacattcacttaggaaaggattcctggagaaaaattggatatcttgaggttgacacttttaaaacctgaatatgtttctgaaggatgcagataaataaaagaagcttactcttagttaattttataaataaataggttcagagaaaaaagcaattttgacatttttaga

SEQ ID NO: 35417 - DNA, 1094 bp, Homo sapiens
ccttttattcattaattttgtaagtaacagccatttctcttcttatcctctacaggagaccaattcgttgttattgtctttttgaaatattatgaattaaaggatttaaacatatttgatggcaattattattactttattgaacctcaaacttttatttttggccagtaggcacttcttcaggttgattcctgagtccttttggtacaaccctactagactttgatcatgtttctgctatttttatggcaagatatttcaggctcatattttcatttctagttccagaccttgaaccagctatcataatggcttggctgtgtccccaccaaaatctttcttgaattgtaggtctcatgtgggagggacccagtgggaggtaattgaatcatgggggtgggtttttcccctgctcttctcttgatagtggataagtctcacgagatctgatggttttataaaggggagttcccctgcacacactcttggctgctgccatgtaagatgtgtctttgctcctcctttgccttcagccttgactatgaggcctctccaggcatgtagaactgtgagtccgttaatcctcttgcctttgtaaattacccagtctcaggtatgtctttattagcagtgtgagaacagactcggacagtaaattggtaatggtagggtggggtgctgctgtaaagatacctgaaaatgtggaagttactttggaagtgggtaacaggaagaggttggaacagtttggagggcttagaagaagatagggaaatgtgggaaagtttgaaacttcctagagacttgttgaatggctttgaccaagatgctgatggtgaaatggacgataaagtccaggctgaggtgatctcagatggagatgaggaacttgttgggaactggagtaaagatcattcttgccatgcaaagagacttgcggcagtttacccttgccctagaggtctgtggaattttgaacttgagagaggttatttagggtatctggtggaagaaatttctaagtgctaaagcattcaagaggaagcaaagtgtaaaagtttggaaaatttgtagcctaatgatgcaatagaaaa

SEQ ID NO: 35418 - DNA, 1029 bp, Homo sapiens
ctcataagttgctgattcacttcttttctaccatcttccactgcagtctccaatatgtacttccctttctccaggggcaaaatttcacataataccatagtcaaaaacgaaaatgaagatggatcatgtacaaaacactatctttattgatattaacatattatttggggtatctcatccagtacctgtgggatggtattgtttctggtctgtcaaatatatgactttgaaacattttaacacaggtcaaaaataggaatgtatttaatgaaatctctctctatgacctcttttctccttgtttccagcatacattatcccttgctcatctctctccttcagttaatttagtcactgcttaagaaaacctaggtcaggcccagtggctcacacctgtaacatcaacactttgcaaggccgaggtggaaggactgtttaagcccaggagtttgagaccaacctggacaacttggtgaaaccccatctgtattaaaaaaaaaaaaaaaaattagccgggcatggtcgtatgtgcctatagtcccagctacttaggaggctgaggcgggaggatcccttgagcccaggaggttgtggctacagtgagctgtgttcacgccactgcagtctgccacctggacaacagagtgagaccctgtctcaaataaatagataggtagatggatgaatgattgatatatagacgatagagagaaaacctgaaaagtattattagcagctcatgtatccttctaaattttcttaggcttttataaactaatgtaaatacttgtatgtttcacttgttcattgtacagaaggtggcatgctgtaccccttgttctacatcttgctttttctttgctgataatttttcttatttgtctttctaaagcattttatacagagcttctgtatttttaaaagagctatataagtattctattgcatagatgaaccatggttgtcttgacccctgtttactgggttgtttccagtattttgttattactaataatacttcaataaata

SEQ ID NO: 35419 - DNA, 1039 bp, Homo sapiens
gttttttgagggttttttttgtcacggtgagacattgaattttgtcaaatgctttttcagcatcagttgaaatgatcttgttgtttttgttctccattctgttaatatgatgtatcatattgattgatttgcatatgttgaaccatctttgcatccctgggataaatctcacttggtcatgataaatgatctttttcatgtgttgttaaattcagcttgctattatagtattttgttgaggattttcatgtgaatattcatcagagatagtggtgtacagttttcctttttttgatatgtctttgtctcttttggtatcagggtaatactggccatgttgaatgagtttggaagtattccctcccctatttttcggaataatttgagtaggattggtattagttcttcaaatgtttgttagaatccagcagtaaagccatcaggtcctggacttttctttactgtgagacactttattatggcttcaatctcattacttgttattggtctgtttagactttggatttcttcctggttcaatattggtaggttgtatgttttctgatttgaggttaccatgaagcttgcaaatactatcttataacttattattttaaactggtgacagtttaacactgattgcttaaacaaagaagcaaaaagaaaactaataaaagctctacactttacctttatctccctgctttttaactttttgttgtttctgtttatattttattgtagtgtctgtgttcatcttttagtcattctacttaagagtaatttatatgcccaagttatggtgttattgtgtttttctgtatgcttactgttgccaattaattttgtactttcagatgatttcttttcttgttgcttactaacatctgtttctttttgattgaggaactaacttcctttagcatttcttgtaggacaggtatggtgatgaaacacctcagcttttgtttgtcttggaagtcttaatttcttcttcatgtttgaaggatattttcactggatataatattctagggta

SEQ ID NO: 35420 - DNA, 1048 bp, Homo sapiens
caggaaaaaatggaatgaccaactctttaatatttagggattgattatacctctagttgtggcttatgaatattattcttaacctgtattacttgtgttttgttcatggcttttttaggcaataccttagtctgagggtaggaatatggaagaaaagaaaaatcagagtagtactattttgctacttgttagtgtcttttgaaaatatttagaaaaagttgagaattaaaccagatagttaaaaagtttggcatatctttgggagtttcatttatgctaaattctcattgtcataggatgtaaacgttcacttgaaccgtgaaatttttgagtactctgaggatgtcctgattaccaattaatgcccaagtttgaaatgtctcctactttgaaatggtaattccatcttgactttttttttttttttttggttgttgttgatcattattatttccagaaatgtatcttctgaatcacttcatttctaccttgctcacacaagacccagatgtcttccttggcactgggacctctactgaagactctccctacttcatagaaaaggaatattttcttatttccttctgaacctacttgagatcctctgtagctctgctctggcttctatatttaatgcagaaatggtaaagaagaaattattatttctaatatccaaatttttccaatagaaattatgggataataaataatatttattgaggtattttgtgacctattaagtaccagttcttggtcgtcatttcttcccacttttcttccttgtttactcaactctggatgccatggcccttttgtacttcctaaagcaagccaagcacagtcttaccttagggcctttgaacttattttttcctttgcctagaatgatctcctctcaaatatccaattattgtatgactatcaataagcaattgtaatgtttctatccagaaacattacaattgtttgattttttcatattcatgttttttacagtttcttttcctcagtcatactttctatatctcttttatttccttaaacatta

SEQ ID NO: 35421 - DNA, 1041 bp, Homo sapiens
atgaaagctttgaacaattggatatttctatgtcagtttattgggagtttatgtataaacacctatagacacacacatgcatattttaaaaaactgcatattatggaaatgttcaaatatatgcaaaaatagaatagtataatgaactctggtatccgttgtgcagcttcaacagttgtcaacattttggggatcttgtgtgtgcgcatgtgtgtggggctttcatatgtaagtctgaggaagataaatggtaaattgattgctttacctcaaaatagacttgaaacatttcctttctgattttttgttcttttttaaaatgtcatatgccttcagtgagaaacagaaatttgtggtagtaatataatccataattacttatttgtgtgtgaagacacaacatcttttggcagaaggaggatttgaactcctgttctttagaatgtgctgtgttggagtggatgaccaaacgtgagtcatttgcatttttatcattaaagaaaatccaaattctatagcagcatttgcttatacgcttcctagaactgtagacctggtatagattttaaggtcattggttaagtccttcaaagctgcgtatttgcaggatagtaggtgcctggatagaaggagagagaagagtctgttcagttagttaccctcctcttcaatatcattcgcttgtcaggtagggcaggaaaagttgctgagaatattaggtagcagtttctccccttccattgtcccttaaaatacttttcatgctctttcatggattatctggggttttggccactctagaaaatctttggaagcagctgcgcacagtggctcatgcttgtaatcccagagctttgggaggttcacttgaggccaagagtttgagaccagcctgggcactatagtgagaccctgtctctacaaaaaaaaaaattaaataaaaaattagctgggcatggtggcatatacctgtggtcccagctacttgggaggatgaggtgggaggatcccttgagcccaggagttcgaggctacagtgag

SEQ ID NO: 35422 - DNA, 1027 bp, Homo sapiens
ttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctag

SEQ ID NO: 35423 - DNA, 1030 bp, Homo sapiens
caggtatgccagtgaatgagcagggagttcaagagaagactgcaaaaactgaagcggaggtgatgtagtcccaaagagaaagtgaggaagaatgagagcatgcacgagaagctgccttgtttcccagcactgcccaaagttcagctgcacttcctgttcatacccattcccaggatacctttgtatgctcataataaaaacccctttaatttaattcaagtttaaaggggtttcagttgttttaacctcacaagtcaatgcaataccattagaggaaataatgataacaataccgtaatttagaaatgaaagtcacatacctaacatactcatgttggttttaggactaccaaaactatagccttgattctagaatttatttccatatagattagggtgccatgaatatattgagaaaatagagtagggtagtactttacagtatttatggagaaacaaaagccatgccatataatatgttgtatgaagagggaagtgtattgcttgtcttatgaacactgacatcagatctatgccagtgagtaatagaagactttattgttttgtcttctttcatcaacaaaaggcaaaacacacacagacacacacacacaaaaaaaaccttctttaatgtaggattttctgaaacaacacaaaatacagccagacctataaatatcctatcatttatttgtatatactccctgacatgttatattttgtgaataaatcccaggagtgataaaagtcttaaatcattttctgatactatttaagattctgccccctttcctccaccgttgcttctgatttaactcttccagccatgggatgttcagtgaaagaagacagttcttaaggttctttggtaattaaatcacaattctcacctaatgtgttttgtgtgtgtgtgtgtgtgttttcctctcaacagtcaactgtatgtgaactttttgtgagatagtgaagcacagtagcaaagaactctggccctgcctagagtcagactgtccaagttccagtcctgact

SEQ ID NO: 35424 - DNA, 1043 bp, Homo sapiens
cacagaactctcaaagactgaaaataccaagtacatatgagagtatgtaatttggtacaactgtaaggaagactttattcaggactatcaagataggtatagggacaactgcaatgggattttgcagtcggggagttaggtcgggctcaactcatgggcaagtgggaatttatagtaaaagagcagggcgtgggggtcagtggatagaaaattactgagaggagacatcggggataaaggggattatagctaagttgacctaataggattcttgctgaagtcagaccagggtgatcagacatcaccaagaggatggcaggggattgaacctgatcagatgttaagagtaatctgatattgaagatgaggattcttgctaaactgacttactgccaaaactggattttacaaggaagtacacagatgggactaggaaaagtttcagaatctttgtcagttcagagtagccctgtttgaattaaggatatgtagtatgtgagaacatggatacatctcagaaacataattttggatgacaaaagcaagctgtagaaggatagttacagtataatgccatttatataaagcagaagtcagcaaatgggtcaaatctggcctgccaccattttttaattaaaatattacaggaactcagccatgtccatttgcatatcatcttgggctgctttcacattacaacaggagagttgtaccaacagggaccacatggcaaaacacaaataatacattgtttgttgtatatttttatgactacgtataggtactaaaagtataaaaagatgtgcggaagtcataaatagtgaaattagggtattgattatcaaatgaatgggccaggaaaggatccacagggagcttcaagtgtatcttgactgttttatttcttaagctaagagataggatttgcaatattatctatacttttttaaactcctgggaattagctgggcatgatgactcatgcctgtagtcctagctgcttgggaggctacggtgggaggattgcttgatcccaggagttt

SEQ ID NO: 35425 - DNA, 1050 bp, Homo sapiens
ctgcctcagcctcccaagtagctgggactacaggcatgtgccaccacggctggctagttttttaatttttttttttttgtagagatcacgtttcaccaccttacccaggctggtctcaaactcctgggctaaggcaatcctcccacttcagcctcccaaagtgttgggattacacctggctggcttcttttacttaatgttttcaagagttatcatgtgtggcatggaccagtacttcgttcctttttcttgctaaattacattccattgtatggctgtaccacattttatccatcaccggttgatggattttggagttgtttcactttttggctattacaaataatgctactatgaatatttgtgtacaggattttgtgtagacatgtttgtatttctctttgatataaacctgagtagaatttctgagtcgtataataattccatgtttaaccttctgataattgctggactgttttccaaagcaactgtaccattttacattcctaccagcagcgtatgaggattctgatttctcaacatctttgccaacatttgttattaatattaatctgtctttttcattatacccatcctagtgggtgtgaagtggtatcttattgtgtattcttagtaacttcttaaaattaaatatatacaaattatattgctcatgctttggtgacatctggtcaatggtgagactgagaaattaagcctcatgtgcagtaccttctgcttatgaaacacgtagtgaagagaacttcccttgactttttttttttttaagagacatgttcttgctttgtcgctcaggctggagtgcagtagtgcaatcatagctcactgcagccttgaattcctgggtttaagggatcctcctgcctcagcctcccaagtagctgggactacaggctcgtgccactgttcctggctaatattttaatttttattttttgtaaagaccagatctcgccatcttacccaagctggtctcaaactcctggattcaaatgatccttccacctcagcctcccaagtagctgggac

SEQ ID NO: 35426 - DNA, 1010 bp, Homo sapiens
tgctagttaggaggctgtaatggcaatccagatgctactaacccaggtggggttaataagggttagcaagaattttaagtttccaaatctacccttactttttttttttttggagacggagtcttgctctgtcgcccaggctggagtgcagtggcgcaatctcggctcacagcaagctccgtctcccaggttcacgccattctcctgcctcagcctcccgagtagctgggactacaggtgcccgccaccatgcccggctaatttttttttgtatttttagtagagacggggtttcaccgtgttagccaggatggtcttgatctcctgacctcgtgatctgcccgcctcggcctcccaaagtgctgggattacaggcgtgagccaccacacccggccagtctacccttattttctattaaatgtatttccattaaatgtactttatattttattttattttattttgagacagagtctggctctctcgcccaggctggagtgcagtgatgggatcttggctcactgcaacctccaactcctgagttcaagtgattctcctgcctcagcctcctgagtagctgggattacaggcacccgccaccatgcctggctaatttttgtatttttggtagagacagggtttcaccatgttggtcaggctggtcttgaactcctgaccttaagtgatccaccctccttggcctcccaaagtgctgggattacaggtgtgagccacctgtagcttaaagcttaaagtaagccaaaatgtacttactttaagtcaactttcagaaacaaagttttttttataaaaggatccgtatcttgtaaaagacacagatgcaataaaacttaagttcatttaaatgagaaataaaggatgacttaaagaagtatgaatggaattataccagaaaatctgtggtgaagataatgattgtaattgagttcaaaagttagctctgagtttctggcagcctaggtatagaagggaataggataggttgtgt

SEQ ID NO: 35427 - DNA, 1038 bp, Homo sapiens
gtagctgggactacaggctcatgccatcatgcctggctaaattcttgtgttttagtagagacagggtttcaccatgttggccaggatggtcttgatctcctgacctcgtgatccgcccgcctcagcctcccaaagtgctgggattataggcgtaagccactgcacccggcctaaaaaccgttttctagggttcttttaatgtgttttttagatattcactgcctccttttctaatcagtgggcagaaataagtgggttgaggtatcaaaagaaaggtattccaggtgtagaggacagaggaaataaagccttgaggtggaaatggaatgaagaaatcagaacacttgtctgaataagaagaaaacaaacaggaagtgagttagctgttttggtgatgaattccgaagtcaaaggtaagaaacttgggctgtacctttctcaagtcacttggtaaatagggccttactctaaggacagtgcagataaagaataggggacggtaagacagcacatagcctcatgtggaaactcactgatattcaggatacagcagtccttgtttcactcagctctacttcagtgccttggtgtctgattctttctctctgctttttgttctgactctgctaccatctgactgccctctttgccatcctggccccctcctggcctctgcatattcccatgagcagtggtgtgggattctctactcttctgttctttcatcattcccttgctctcacttcaccagtggcttctcatgtcactgagaatgaaattcagagtccttactgaggcctagtagcttctgcaggacctggcccctgctccctttctttctggtctcagttcatacacctttccacctttgctcacagtgtcccagccacattgaccggcctgttcttcctcacacccacctaaactcagaacctttgtactcgctgtttactcgaccgcaccttctctccttttttagtccttgcttccctcctctgtttaggcctctatcaaatgtcacctcctcagagaaccttc

SEQ ID NO: 35428 - DNA, 1139 bp, Homo sapiens
gatattaaccccttatcagatatatggtttgcaaatattttttcctgttccatgggtttccttttattttttcctttgctttgcagaaactttttagtcccgccatgaattttatacatggattttagtcaactcctgtatcgttttatagtctaagtaggctccacataaagaacagtgtggtgagttatcattgaagtaactggaaagcactgtatgtgttcattatgttctttcagcttgcaagaaatgggcatgctcaccttagctgatggaggcttattggaaggatatacatgtaagttgaaagacatggaaaatatctctgggcccggtggctcacgcctgttatcccagtactttgggacaccaaggcgggtgaatcacttgaggtcaggagttcaagacgagcctggccaacatggcgaaaccccatctctactaaaaatacaaaaattagttgggcatggtggtgtgcacctgtaatcccagctactcgggagggtggagcatgagaattgttgaacccaggaggtgggggctgcagtaagccaagattgcgccaccgcactctagtcccggtgggtgacagagcaagacgtctaaaaaaataaaagaaaaaagaaagacgcaggaagcagtttcagaaggtatttgaaaatgagagtaactctaaaaaactgatagcaaatagctactctggagaacattttttaataagttggaatgactttgttgctccttatggttagtgacactacagtttattgatgtctgcttccatggcttctaaggtactaaataattggctgtcttttgtttttctcacagtcagcctccccaagaaagaggctctaagtaggttggtcagccacaattctgcacaggatggccttttgcagcagggttcttatgcccatttaccttggaggtgtatggcaaacccatagagagctgccttttcaaacccatcccaggtccctttggggcaagatggcagagtcttgtggtacccacatggctcacctagaaatgcctgcaattgcttttgtctgatgggacctagggcctgtggggggtaccttaaggtttctcagaatggaaagagggtaaagttggtaggctccaggaataaactg

SEQ ID NO: 35429 - DNA, 1046 bp, Homo sapiens
gccaccatgcccggctaattttttttttgtatttttattagagacagggtttcaccatattggccaggttggtcttgaactcctgacctcgtgacctgcccacctcagcctcccaaagtgctgggattacaggcatgagccactgcacccggcctatcttttattttctttttttttttaagaaacagcctcgctctgttgcccaggctggagtgcagtggcacaatctcagctcactacaacctccacctcccaggttcaagcgattctcctgcgtcagcctcccaagtagtctcatcctcccaagtagctgggattacaggtgcctgcgaccacgttggctgatttttgtattgttagtagagacagggttttgcagagttggcctggctggtctcgaactcctgacctcaggtgatgtgcctgcctcggcttcccatagtgctgggattataggtgtgagccactgtgcccagccaacgttcagcttttctttattgtccactgaaagctcattattgtgacataagcaattatgttcaaagtgatctcagcaaatcagaggtgagttgatcagcctatgacctatttttaaccagagtgcatcccttcgttctgttttctttccctctctcacactagtcatccagcagttctataacttcactggcatattatattctgaggacagcatattcactgttttcccttaggtcatttcagcttttcatccaatggtgcttagagactaatcctttgaacacttggttctaatcccatctgtcaattagctttgtagcatccagcaatttatagcatctttctgggccttagcttttggtgtattaattgaaaggatgaggcttccaactttacattttatgatattaggagatgagcagaaaaataacttccgacatagtttacagcagtttgcccatgtactaagttagatcttggagagtttctcccaggctccttgtgaactgctccactggtgtgggagaagccaaaggggcaaagctcaagacggtgtctccctggtg

SEQ ID NO: 35430 - DNA, 1050 bp, Homo sapiens
caatgtaagactcaaggtgaatgttctggatacatgtatttgtagaagcaaaaggaagggacacaactggttggaacctgtatatctttaacattaggtggtaaaatggaatatactatggaaataaataccattgaaatgttttatggtattgccaatttaatacatattttatgataagaaagaagagaagaagttcattgtagattccacatgggtaaatactttaaaaagtattccaaatacagctcctcatatccttaatatatctgttgtcaattattatatatttcatgtcttggatcaagttttcttgtttggacaagaaatggaatggcaaaatccagatctttttagctgaaaacctcacctattctctattcacccacttctaaagtggacacaataattcttaaaatggtacttaaatcagtatagatttgcagaaacaaaggcctgcttaagaatgttctttcatttaagtattatgaggttaattaaatgtgtgaaattgtaacattttgaattattcacatggcattttagtttttccttttaagaaccatggcttttctgtgcaggtgttcttcactgggataatgttttaagataatcccctgatgtcatttaaaggaactcttatttctgaagcatgattgtgtgtttttgtgtttttatagtgtatctctttcttatcctcttttggcctttgtttatattctcattttaccactatcagctactattttctattgttgattgtttttattgtttattctattttctattgtgtatttgttttcacataacaaatcaaagcctgtttaatttgtggaagacagttgtcaaatgtgtaatatatccagttactaatttttctctgattgatgctgctcgtctcctttcagatgagtgccttattaaaaccatctaattttatggtgcttactagaaagaatgtagagaaattgtcaaaattttctattatttactcagtaacccaaaatgatgtttctggaataaaattttggcttctcagttagtgacttg

SEQ ID NO: 35431 - DNA, 1060 bp, Homo sapiens
attgttattaaaatgttataagccactgtaattacaaagaattttttttaagttttcattttcatagtcatttgttgattaaacttaccttttccccagggattattcctacccttcctcctgagttattttgcctctggttcatgatggtttgtaaaatgttaattaatttttattttttcctatgcacaccctcagaattctaaatttttaattttgtcccatccttttaaaaggaaatttatccgtcaataagaggcgaaaataaaactcggacacttgtatagccttaaaaaaataatttaaagatttttatcatctctgattaagccaaagaggtaggaatatggttgtatgttgccatgctaacacatgcatgtagtgtgaacagcatatatcattctgatttcatatcacatgatttcactgatttcatatcatttttataagaaaataccaacatgattgaaaattacactattagcaatagttttatcatcattgtagataacctccaaaatgcttattttatatgaaaaggcttatttcttttcagaaggtagttcagagtaagatttactttttctgtggtagggctcattttttccaacgttttggaatacctgaatattctttgcttgctatctaggatatttctcaattttaaagggactctgtagtattgatctataggaagaggcatttcagctttattttagtcaggatattttagagagttcattgtacaccgtttgcttgtttagctagcttatgctttttaaataaaatgtccaaatgttaccgcatgctgtatttcatcaaatctgagacaccatagtttttttagatgcattccaatttcggaaatgttaatgtgaaaaaaaaaaaaactgtattcaataagctaaagaatgttagaatagcttttggtcctgtaaaaggagtaggtgcagtgaagaaaacatgttcttagttaacaggaatagcatgtggaattacccctgcaggtatagtattatatacatttttttcagataaatattctgtagcaaagaaatct

SEQ ID NO: 35432 - DNA, 1040 bp, Homo sapiens
acttttcagcaaggtctgctaggcttattaaacagtcgtattgcttttgtttcagaaaataacatctctaattatttattctacaataaaattttcattaatatgaagattttatacatacccaaaacaccgaccatcataagctctgttggtaaagcaaatttgggaattattaccctcccaaatttagtaatttaatatcctccaaagtctgagttcaatggctatataatgaatttttatttccctccaatatttaatatcttttacttctctttataaaactattagacatgttaaatatgtaatgtagaaaaggcacttgtctttacagtgtcctaaattattagtaatctcacgggtcagaaataaccacaataaggattttaagcatataattttttaaacaaaactgccactttaattcatttttaatatactgctagtattttcccatggctgtaggtattcaaaagtatataatctgccatataaatatatcgtaatttctcactattgttgatttagattgtgacctgctttgaacatcgttatgcataaatttaaccacatcactgtacacagatttctacaagtagttttattgggtcaaggagtgtgaacttctttagattcttgataaatattattaaattttttcagaaaaaattgtatcagttcaaaaacagcatggggtttctaatgttacaagacattatattttaaagcacatttattcttatggcaaagctttgtggactttacttagctgatactgtatcattgtacttccatgtttattattctaggttttctgtgaactgaattttcattttgagaaaataacgatatatgtttttacttaaggcctcataaggaaaatatatcaattgattaaaaaattatttgtcgctcatagtgattttattttttattcttataggagataatatttgccatagacttgtcacctatattattttcaactgtaattttcttctattcttttcatcgttttaaaactgtgatctgtgttttta

SEQ ID NO: 35433 - DNA, 1025 bp, Homo sapiens
attatttaagagacggggccttgctgtgtttcccaggctgtccttgaacccctgggcataagagatcctcctgtgtagctgggactacaggcgtggaccaccgtgcccagctcaaaaagtattttaattatgaggtttcattgtagactaaagaataatcttcacaccaaatggaccattttaaaattgttttatagcattccattgattagttctttatacagatgataaacttcactgaagtatacacaaatatcacaaatagttatcttcaaaatgcttccaaagaaaattgtttcatatgtgtattataatgatctgatccatttttaatgttgtttttgttggtggtagggaagacagtatgaagaaaaaggacataggaatagatcatgatgaatattgttttcactttggtagttaactccaaaattatttctcaagctccgatcattcaccttagccatagttttgcatttctagctgtctgttgggcatcatcatctgagtggtccactgaaaactaaaagtactgtttctttctccaaaccaagtttttatttgcctccccaggttatcttttccctctcaataggtcccatcttctggtcagtggatagaaaagtggcttgactttttcttatcatctgagtctgggcctgctgaataatttaacagacttgatcacttagtctctctttttcttacccgccaggcaattgtaagataaaaattggagggtcagtgtttaaaaacgttaagagcatttttgcttgggcttctgtttgcatcaggctataacgccacgtccttgacaatgagttggcagtatgaataattggatgagttttttaaaatgaatttttagctctgtatagataataacctcaatacagatatctggtgccccatttcccactgataaagccaaacctaaatgagaatgtttgaagtcttccaatatcttaccatagtttttacctggtttcatctcctctcctctctacttgttttgaatcatactc

SEQ ID NO: 35434 - DNA, 1029 bp, Homo sapiens
gaccgaagaatatgataggaccaaataagtagctatactagaaggaagcacatttgagaccactaccctaaacagccaatgactacagaaccagagaaaaccagaatctgccaaatttcagaaataactcagcatctttacagggagcctctacacaatcacaatgagactctgaagagtagcaagtactgattcaaatccttttagctgtggactccactctgcctcacaatcattttagaagagggttttgagctttagaataagcccaccactgtataaaactagtgagtctgttttttaaggtaggattcccatcttagtaatcataattttggcatggcaattattaaatatgaaccacaaggagaaaaaaatgtcctcttgttattactttttaaattaggcattttaatttcatttactactgcttgatactctcttctctgggttcctgggaggtttcatttggtaagtattgttcagtaaaaattatgggacaccattgttttggactgtgctcctgccctaggccccagtggaccagatcaaactaaaatgtagtcattcatgttaactgccacataatcaaatagaaacttccaggaagcagacagatcccaaagcagaccatttttttccctgagaacaggagattccagtctagctgaatcccctgtgctttaaacccttagaaaaagtaaactgaagtaacctgatattaacaaatcagcttttttttcctgttctgtttccttgttcccaccttacaaaacccactgttgtgctgttgctcagtaggacctctcattctaccttgcagaatgggggctgccctgattcatgaaatgcaaataaatgccagttagatctgtaactaaactgttgtaattttgtcttttgacagaatgcagttaaaactcaggtatatccacactgcttttatttcgtctccttcccatttcagaaactcctgtctagatttcttttcttgctctctaaggcaaacaattaccacagttagatgaa

SEQ ID NO: 35435 - DNA, 1070 bp, Homo sapiens
tgatgtctggaatttactttaaaataccttggaaaaaatgaataaaagatagataaagcaatattgctaatatttcagtacctgttaaatataggtgacagtatatatatagaggttcattatactcctttctccacgttttgaaaaatttcatttaaaaattcaaaaaaattctaaaaaatattttttcttttagaaactaacacatgctgaaaaaattcaaattttgttcactgaccacgtttttgctgccaccactctttcaacatttaaaaaatgttcttaaatctttaaaaattcgatttacattttcattaagaaaatgaggcatttgctggccatttcatccttcctcttgtattttttctccttacctgctgccaccgtttactagaaaaatatttctcttgttttttctgtaccttctccttgaaatataaaagttcagtgaaggcaggagagattttagcccgtttttgtatggctgcatcttccttatccatacctgcatagcatgtggtaggtgctgagtaaatatttgaatgactgaatgggtgactgaatagactgaatgaaccagagttgtagaagacatggggtgacgtggggtttggctaaggacagaaccaaggagaacccctttgaaaattcactctgtgggatttacaggggaaaatgtgggctactacataagaaattaagataagaaatcatctttcctgtttgactgtaaagccttaatatttcaagcatttaacatattctcagcataaataattaagtttttttcttcttttttctgaaacagtctcactctgttgcccaggctggagtgcaatggtgcgatcttggctcactgcaacctccgcctcccaggttcaagtgattctcctgcctcagcctcccgagtagctgggattacaggcatgtgccaccacgcctggctaattttttgtatttttagttgagacgggggtttcaccatgttggccaggctggtctcaaactcctgacctcaggaacccacctgcctcagcctcccagagtggtgggattacaggcgtgagcca

SEQ ID NO: 35436 - DNA, 1032 bp, Homo sapiens
tgtacatgccttagtttagaaatactttattgctaaaaattgctaataatgatcaactgagtttttagtgagttgttctaatctttttcctgctggagggtcttgactcgatgttgatgactgctcgccagtcagggtgatagttgctgaaggttggggtggctgtgacaatttttaaaaataagacagcaatgaagtttgttacatcaattattctttgatgaaatatttctctgtagaatgtgatgttgtttaatagtgttttacccacagtagaaattcttcaaaattggagggcagttctctcaaaccctgctgctgctttgtcaactaagtatgtaatattgtaaatcctttgttattatttcaatgatgttcacagcatcttcaccaaaagtggattccatctaaagaaatcactttctttgctcttttttataagaagcaacacctcagccattaaaattttattttgagatttcagcaattcaatcatgttatcaggctctgcttctagttctcttgctatttctatcacatctgcagtgatttcctccactgaagtcttgagctcctcacatccatgagggttgggatcaacttcttccagagttctgttaatgctggtgttttgatctccactcatgaataatgaatgtttttgaaggcgtccagattgatgaatccttcccagaaggctttcaatttactttgcccacatctatcagaggaattcctatctatgacagctatacctttatgaaatatatttcttaaataataagatttgaaagtcaaaagggcttctcaatccatggcctgctgaatggatgtggtggtagcaggcatgaaaacaacatgagtcttctggtatatctccatcagagctcttgggtgaccaggtgcaatgagcaatgtcagtgagcaatgagtagtattttgaacggaatcttttattctgagctacagtctcaacagtggacttaaaatattcggcaaaccatgttgttaaatagatgtgctttcatcaag

SEQ ID NO: 35437 - DNA, 1045 bp, Homo sapiens
gaaaacatgtttgcaaggctttttttaaagaatgcttatggatttagtcataataggtaacaactgaaaacattggtatggctgggtcaagttggactaattcactgtagcccagggtcatgtaagaacatggagttttcaaggtaggcatgggggtggtattgaggggagggtagtaagcataaaagacagtgctcagaagaagataagggtgccaggtttcagttccagggatgttcacagtaaggattacagtgggctaaattttaagattaattttataaattctaaacacatcctgttgactttaactgcaactcttaaaatgtatcaataacatgactttataattcctggaaactgatattttcccaatactttgaagaggtttaaaaatagttgactaatattagaaccaatatttcatgtattgatttttctctttaagtgacagttagtttagaaaatgctaaacttaagttagcagtatagagtaggtatatagttatactgagtatgaatgtcttggtaggcttggaagcctaccatttatgtcctcttgaggtacctgaattaccaaaagctttatgtattctgaagttattgaaaataagagcttttgggaattcaggtagttcaggagtgacttttctaaaaaacagaactgagcaccatacactacttcttatagccttttaattactgccaattgcctagaataaagttcaaattcgagggcaacacaaacatggccctttgtgaactgacagacatttcctaataattccttacatacatgatacccttgagccttacagaattaagaatttctgaatttaccttggtgtttgatgcatctgtgtttctatacgtgctgtttatttacctaaaatagactattctctatttagcctcaaaagtctcatggaaggttttaaaaaatcctgtctaagctctgttaattatattctttatactattatatttagtagttaatattataaactaccttacagtaatttttacagatacctggcttactccc

SEQ ID NO: 35438 - DNA, 1029 bp, Homo sapiens
ctgttgtaaaaattttggcaggaattatataagattattcatgattgttatcgacttatctttattccttcatttttttttaaagcaggaagcaataatagtttacgttcgttaacctcaatatctactctaaaacatgttgtttttcttgttattaccatgaaagtctgggttaacaggagacgagactagcttcttcacagatacatacattaatttgacattatagaaaaatgagactgtatcctgacttgccagtttggttttgattggtggtttcacctttttttttagactcaggaaaacggtggcaaaaatagtataaagggtaaattctcatatgcccttcattcaagttcccaaaatttaacatcttatgcagtgacagaaaaattatcaaaatcaggagattaacattcatgtaatactgatagtctacagactttattcagatttcacccattttctcaccaatggcctttctctggtccaggatcacaatatgaaattattcacgtgttgtattttagttatcatgttttcttagttttctttaacctgaaacaattccagtctttctttgccttttgtgactgttatactttggaagagtactggtcagtaattttgtggaatattgcacaatttgtgtttgtatgttttcctatgattcaattaattttaagcatttttgattaagaatactgcaaaaatgattttatgaatcttatttagaggcacatgatgctgatttgtccagttatcagtgatactaattttcagttcctttcgttaaggtggtatcaggtttgtccactctagttgctttttttcctttgtgattcataagtagtgttgattcagattctaggttaagaaaaggaaaaaaaaaagtatcctatgggaaggtacttaaaaataagtactttgggaccaggtaattaacatttctcaccatactctaccaatttttaacttccttgctgttttttttttcttttttttttttgcagtggcacgatcatgagt

SEQ ID NO: 35439 - DNA, 1357 bp, Homo sapiens
gacagagaaggctgcttcccttgttcacagttggtgtgtgtctttgtgtcccatacaatggaggggatatccctgtgtaggcacagtagtgctgaacatgctttttttttttttttccttttaaactttttattaaaaaaaagcaacttggcatttaaaaaaatgtagacatttttgcggcttgcatttagtattgactttaacaggattaaggattgtgaggaaggaaatatatattcacacttttttgtgttccttagttggaattctgcaccttcctagtagcttctctgacttcttaacagtgattattcaaatggcagaaactctggggaagagatgtttcaacaaggagataggtctaaggtgattctagggtgaaaatatagggattggattatatgccatatggaggccttctcttgtcatcctccactttccacaacattttttgtgcagtcgaagccatgttcagatgaattttagaaggcagccacttatagttaatgttatttactagtgaggacagtgggaagagtggtaacttcatgtactttgccttggcaacttttggattgatagggaattagagagccttgagggtatatgtttgtgtgtgtgtgtgtgttttagcacccaccagatgaccccaaaggccatgcataggctcatttcattgtactttggagatggttcttggagaagtcttctggtgcttctgacatctcattgtgtagagaaagagttggcaaactatttttgtaaagggccagttagtaaatattttaggttttacaggccacatgatctgtcacaactttcaattctgttcttatagtgtgaaagcagctgtagacaacaaggaagtgaatgaatgttgccgtgctccaattggcccataggccgaagtttttggactcctggtatagacaactgccaaatccaccaacaaacagtatgagctttattacactacaaagccaggactggctatttttggtggtctttgttttctagatgagatgtttttctctgagttcatttaaaatgattctgcataaagcacatactctactgtacaaaatacttttgccttcatggtgatgaaaactatggattgagggtcggggtgataccatctttaaagggatgcagctaaaaagtagggactacctgcatttcttatctaaagataaccacagttggcatttagtgatatactggctttgtatcatggccaaaagtatctgtaaagaagcttgtgggcatacttttgaaaccttctgaaaataaatgtaaagcatttacttcgtgtgtaaaattagaagtgtctatggttggtttgaataatatgagt

SEQ ID NO: 35440 - DNA, 1046 bp, Homo sapiens
taattttatcccaacttcctttgttatagttgctgggaaatgttgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagacatgaagcaaactaataatactttattttaactcacttttctatttttagacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccatttatttttctcagg

SEQ ID NO: 35441 - DNA, 1003 bp, Homo sapiens
cacatatattttcactaacgagccaataatgagattcttgttgcctataaaatgcaagataagctcagtagccaagcatccatgcatagctttgtaggtaataatgaatactcatatgccttcattcagcaaacattcttaagtacgtataatttttcaggcaatgtgctaggaattcaaagacagtaaaactgttgcaggcctagttatttattatctggtggtttaggcagacatgtaaatatcactaagcttgtaaaaatgatggaaatgttagaagcagtatctgagaaacatgtcctctgtctgtattaaggcattggtccacagatggagtggccagtgtaacagggtagaggacaaaaggcttagtatgtaaagaaagtacagggaaattgggtgtttctagttttagtaagttacatccactcttggaaacattctgttagtatttgaggaactgcttaatactgacttgaaactaatacccaaatataatggaaattaactttactattctgggctgctttaataccatgtgggctgtgatcaaatcaaatttgagttacgtgttattaagcagtatttattgtagaaattaaaaacaaagatgagcaaaacttaatcaaatttgtataatatcactgcctggagataataaacatttggtgtatgttttccttcatcattttattttaagtgcatgtaaatgaataatacacagctactaaaagaagttgatttttcattttaataggggttgctttgacagcagatactaagatccagagaatgccaagtgaatcagctgcacagtccttagcggtggcattacctttgcagaccaagtatgaaatattataattacaaagatcttaaaagcatatttcactgttcacattttttctttttaaaatttctttataactattatatgacattttcctttatcaggactttataacaatttaaaataaagggttagttttgcagaatacatgac

SEQ ID NO: 35442 - DNA, 1022 bp, Homo sapiens
agatgacaaacaaaataaacaagttcttgagacacagggtcagaaattaaaactattcaaccactctaagcccaggaactaccatgaagagttgggcatgtgagattgtaagtgctgaatttgagagagaatattaattcagagtctttctctaaagaaaatattaatatcaaaggcacattgatgcaaccccagcatcttggcccctgtgtcagattaacaaggtttccttggagcattaacctactttttaatttaagaaaaaaataaaaggttataaaaaaggcttatcaaaactatgtctaatggtcaagatgattaaaatttaatagatttgttataaacaaagatttgagagacagatttaattggcctcctgctgtctttattaagacttgttgtttgagatattaagtctcctctctcatagaataaatgtttttttttccctttttaaagaaatcgttatcactttggctaaattatttgcttattttacaaggacctgtggttctattttgtgatatcaagtaacttttgatatttgacactttaaaatcatattcaaaatttttgatctcatttttttttatattaagtctccagaagttcagaagacacatattcagcttatttgctataataaaatcatgcaggaaggattgcaaaatatgaaatggtgtttaaccttctttggattataacatttatataaacgtgtgactagtatatgatccaaaattatatgagagttctgtgattctgatatgtatttgcatatgtcatcagtaataattatgatattacataaaattgttgtatttcatagaagtaaccaaatttccttatgaactgtttcttcattcgtggcttttctaagacttttgtcatccataattgttgtttaactttgataattttttttttttttgagatggagtcttactctgtcgcccaggctggagtgcagtggcacgatcttggctcactgcaacttctgccgcccgggttcaaatgattct

SEQ ID NO: 35443 - DNA, 1047 bp, Homo sapiens
ctataatggattattttgttcttcagcaagcaacctgatttgaaaataataatcatatatgtacataaatttatagtgttctattttctctttaggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataatgatagaaattattccttttgtggatgattgtgaatctagattcaggtttttaaatgaagggtcgctgggaagtgcgcatatattattccttctgaaactgatgtttagctcaaagcagttgcatttgtactgtgctagttagaattttcatcagttgaggcagtagctcagtagaactctaatcatcaaggctttttatttaagaattttgccttatgttttaatatgagtgtactttatctgttccaggcttatgtgataatcataggtactttataatgagtccacctctgaaatttttctttctgaattctatctcactttattatttcagtgataccaaaagacatcaatgtcacagtagtgatatacttatgtattagttatggaaattccacaggagttcaaggtcattatcactataattattttcctgactaaagccataaaggtgatttaggcaatt

SEQ ID NO: 35444 - DNA, 1251 bp, Homo sapiens
ataatgaatatcagaggactaaagataaatgtatatgtgtatatttatatctagccatatttgtgtctatgtatatatacatatatatgtatatcactctattattttttccactgtagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagtattcagaactttgcacatcttaattattttaaaacatttgaaatccaaattaatgattaaccatatttttatttattttcaaatattcacagtaagaaaattattctgaactttttcaggcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggtaatccaaaatcataaatattttgatatattttaaattatagtaacacttcaggattttataaaatttatttacttgaaatttagtaatgcatttcaatttcattactgtcaaagatgtactagggaatctttattatgtattttcctttaactctccagtgttttatactatgctctataggaatgaaaaaaaggaagcttttttcaagcaaaaggaaaaagaaaaaataaatgagaaaagaaaggaagaactgaaaagagctgagaaaaaagataaagataaacaagctattaatgaatatgaaaaatggctggtaggtattatttgtcaatgcactttcgtctttttcatgtaccttttgtgtcttttctgtccctaattctaattctatttgctccagacctactgatcatttctacctggaatctgctttgttgaattcaagctctcctcctgcatatagcatattttctttgacttagtcatttctattaatgtttctactattccctcaaacacccaggctgaaaacttgttataatcttcttccttacctgcatccccacatttaccatttactattcatgcccattcttcctttgctgtgattctcacatctaacatagaaagaagacaagtttactattgagggtactacgtggtggaacttggtcatgacaaaaagtaacactgaacttaa

SEQ ID NO: 35445 - DNA, 1025 bp, Homo sapiens
aaagtacctggacaggtccattgccgctttgttgattatgaggtttagtaacgtgtacagggcttggtactcaaaggcttgatggatgagcctcctcattttatagtggtagaaactggggcaagattttgttttgtttttttatttttaacattttttttttaatattataagagttcacaatgttgaagagttaacttcttgtgactggttactttcaggatgacaactgtttctttactttgttttttttttgttgttgttgttgtttggttttttttttttttttagatggatttttgctcttattacccaggctggagtgcagtggtgtgatctcgatctcggctcactgcaacctcagactcctgggttcaagcaatcctcctgcctcagtctcctgagtagctgggattacaggcacgcgctactaagcccggctaatttttttgtatttttagtagagacagggtttcaccgtgttagccaggctggtctcgaactcctgacctcatgatctgcccacctcggcctcccaacgtgctgggattacaggcgtgagtcaccgctcccaacatgtcgggatcacaggcgtgagccaccgcgtccggcctgattattaaccatcatttatttgtgccttactagagctctgtatagagaagagttgtgggcttcatctggactcttcaggacagagaacaaaggggcataggcacaggagggaagtatggtagcacccagagagatagataaagccatggtcatttttttatacacacactttaagcattttatttttcagcagaaaacaacagccttgacacagatgatcactttaaaccatcacctcggccaaggagtatgttgaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttga

SEQ ID NO: 35446 - DNA, 1031 bp, Homo sapiens
ttaatgagtatatcagtttatattaagagaattagaagttatagccaccatacaaattgagtcaatgtatatttaccctctttttctttgcctgataagctgggcagggggtggatgaactgaagagtactttaactcacaacacttcagtgaacttcatcttcctttaagttgccgcctgatttgttctatcacttctatgattttacattttaaaaaactatgtataatcagtgatacttgtttgaatatacaagtgaatcttgtttattcttgttattaaattatatacaaagattaataatatagtatagtatgtaagtattatagccacattataacccccactgtgtgtttttcttaatggtgattttgtaaatgacttatccagagttcagacggcgtactggccagcatgccctgtggaagggtgtagggtttctgtggggaggggttagaaggacacttgatgcctgaggtgctattaaggaatgcatgactgattgccaaagtggttattaattatgcaggatatggtgaacaaagcagcacagtgaatattgaagtgagagggggaaaagaggagggaggatattttttttcatcccttctgacatatgccagtaggttatttcactgttaatatcatgtcaagaaaagtcttaactgaaagccaaatttgcttttatgttcaggttaagaaaaactccaaccaactctcaaacaaggcttcaaatatattaattcactttctttcctaggaaaaaaagcagcatgcctggaataaaaatacttagagcaatataataacaccaatcctacaggaaaaacattagtggtgggatgtactcaagattttttaaaatgttaaattttcataacttattgcattgcattcccctattgttaaaccaattctaataagtcgacatttatttgaaaacttacttaaaaatagatttgtatttacctcgagaattaagagaaaatttgatgcttagaatttttttgtatttagagactggaagagg

SEQ ID NO: 35447 - DNA, 1058 bp, Homo sapiens
cttgaatgctgagttgatcatgcaattcagtcacccagcttaactaatacaggattcactgtatatgtgtgaaagttgtcagattcataagacttgtgatgaagtaagaacccaaaggttgattgaaagtgccatccatcctcttggctaagaaaagtcctgtcaccagggttgacctattatcagagatttactgtgactgagaccagacaccacatctgggagactttaggccaaatgtatgtcattggttccattattgaaattaaattgaccacatttttaaatgattgtttaatcatttaacaatgattggtaaattgtcaatatggacttcaatgggctattgtcaactctcctggactctattgagccaggctttgtgtggcaactacattgacctattctgggctgtagataatggagacatgtggggagtaaaggcataggagttcttgtaattaaactatgtttaggaaaacaataggcttttggactggaagaaacaggagagaatgaaggtagtgtcctacattgcctaataagtgtaagttggtgattttcatttttaagattgctttctggagaaattatatgaattttacaatctcacaagctttgttttttctgtgtttaaatttacgttgacaattaacctgccatttcttcagccgtcctttgtcttggttccatatatccattcatctctctacttacagccacattcattctactcttaataaactgtctgcagaagggtgagatctgatgagttagaatttgacaagtggttatgctgttaagccttgcagaatgttttgaattatcattgtgtactcctaaattacacccctccctccatgcaccccctccaccccccacactttgctaacagggtgcaatccatcaatcttatctgtgtaacagattaatgaaagcctaaagcaagaaagtgtgcctcctggacagcagacttaaaagttcttgaggcctttgctcaggggcaagggtccctccaagcccctggatcatctctgatgcttttatttttctctttt

SEQ ID NO: 35448 - DNA, 1050 bp, Homo sapiens
tgaaagaaaaagttctatccacaggtacatattacctggatacatacccatgcacaggactaagaagtttgaatattacatcacaaagaagaaatatagttcagaaagcagcattagatatttaggctaacgttatgccttgccaggtaggaattcgtcataattatcctagaagcattcatgaaccaaagtcagctggagtatttcacccacgcaaaagaccacctactgtatgtcacacaaatattactctgtaaatcccatatgaatacacttgtcaaggttgggtggtcttactgaagatttttcacttcaatgacatttgtataacatgaaaatattttacttgaacttcactggattttttattttctctttgatatacaagttaaaagagaattttcatctcatggtatattacagataaatatttcagtacaaatgaaataaactttgtacttgctgtcatcacagtttttatctttagcacttacatagttacatattcttcacatttgttctttctgtgactgtgcatttcatgttgttgtttttccttacatctataattttagactttgagaactagaagctaccctgattatctttagaagactaccagaggagtaaagcagatgccctagatctcgttcagatttggtacctaaacaaatgctaaacccatttttcctaacacctatttaggcagtttttcatcatgctgtactgcacctcttgtctttttttatatataaacataatcttgtcaaaaattgcaaggggtgtaagattttgccctacttgcaaagtagtaagtaatcctatcccttttgtggatgctaatgaagacaggagacttctgggtcagagacaaaggacttcattacaaaagtagcagtcactggagtattattagcactttcttgtgctttctcctagagttccagttcccacaggttaacaccaagagagccatgtgacaccagctacccatattccttcctgattacaccttcttgtcactgcaaatataatcattgtcctaaattt

SEQ ID NO: 35449 - DNA, 1035 bp, Homo sapiens
tttagtcaaaagattgacatagaatacaatgtaagcatttttaagaaaggccaacaatccctatcaacatgcagttgtctataattactttacaagtgttatgggtgatacatgttaaccttctataccctggatatttatatattaaggacagtaatcttaactatttcaaaatatgtttttgaaatctttcttaggttgtcttatacttagaacattaaatgtaagtttaagaataattacctaaatattgtactttttcttcacataaggtagattctgtgatgagctatatttttgttatttttactttttggcactagggagagaattgtcttaagatttttaagtcttggagaaatttgtttatcttaaaatacttcggtcagagcattctttgattagaattatgaataactacacaaaattcaaagttaggtaatgaatgccaagcttagtggactcaattttcaacttaaagaattgattttcttaacaatgtattgttttagttgcggaataatgaaatagcaggatacttaggacttgggagacttactactatagatacagtcatacttcaaatttattgcgtgtttgcatgcagacagtaataaaacaggtggtcaataaagggagtgtattagtccattttcatgctgctgataaagacatacctgaaactaggaagtaaaaagaggtttaatggacttacagtttcacatgtctggggaggcctcactatcatggcagaaggcaagcaggagtaagtcatgtcttacatggatggcagcaagcaaagagacagagagcttatgtaaggaaactcttgcttttttttttttttttttgagactgaggctcgctgtgtccctggctggagtgcagtggtgcgatcttggctcactgtaacctctgcctcctgggttcaagcgattctccttcctcagcctcccaggtagctgagattacaggcacatgccagcatgccccactaattttgtatttttagtagagacagggtttcaccatgtt

SEQ ID NO: 35450 - DNA, 1051 bp, Homo sapiens
gttacaggtgtgaaccacttagcttggccatgacctaaatcttattacacaaaatgaaatgtcagcaatttgacaaaaaaaaagcatactctaaattattgctgaagtttatattgttatagacattgatatttaaattgttagaaattaaaggcataaagccatatatgctgcttttaaagggtgcacaaatattctaagcctccttttaaagaattattatagtctacaaaattttaaaattttcattttcattgatcagtgtattaaatgtaatgccaattatttattttaggccattgatgtaatgcaatgcagttacattgatggaattcactgtatcttagtaaaatggaagagacaagatgaaataagcacacatatatcttctgttatggagtagaactgaggctaaactgtgtagtgtttggatattactaaatgcttaggtaaagtgtgtgtgtgtgtgtgtgtgtgtgtgtatgtatgcacatacatgcacaagtatatttttctccccatattctatttctgcctaggttacgacattcattctgaaatgtctaacaccagaaacattattgttatgatctctccaaatatgaaaaacaagtaaaagaagctaaagggcaaaagtagggaatttacctatgtaataattgagtttatattaagagtttattttatggaattagaaatgagtttgtgatagactggatgccatgttgtatatgtatcttgttaaaacttgtttgtaaacaggtttgaaaacttgatccatcgtgcagtagagtcacatattcattaatctttttgcatgttcaatgaaatgctttctattgaactagtttcctattatgtatatgtggtatcagtgtatttggatatagacaaattgaatttcacaatgtgttttaaatatttaaattcttctttttacttttgaaaacaattagcaaatcagtatacaaataccagtaaaatgtgttcaaagataatgtggacaaatacaaatattgaaatttttcattacttttacttctgcatcttt

SEQ ID NO: 35451 - DNA, 1055 bp, Homo sapiens
ttgttacctttttagagaaattctgtcttctgactttttaactatagagttctttcaatttcctatgcagtggaatcccaattattctgcagcctcatgctgtcaattttatcttctatttaacatatttcctgttgtgctgtctgcctctgaactagaggattaatcagtattgaatacataatttttgagtttgaaatattgctatatattttgctcggattaattgcattattgctgaatttttaaaattgtattataaactcctattgtatgcattatagtagtgatggtattaaccttgctgtaatggattattcataatgaacaatactatgatgcaatgctgaaatggtatatgacatatttatggagagagacttaaatgctagtctatagcatgaatctgggggagaactggataataaaattgcccagttaggaagttagaatgataatctagatgataaaatcctacattatgtatttagactataattaggctatttgtttctgaaaaggttttgaactgtccagtaaaaagtcaagattactaagataaaatatagttaatcaaaactctaaagggggatggttaatacacttaaattgttgctaatatacttacagtgatgaagtaataaatttaggcatggatatatttttagccatggaataatgaatgtgaatagctgatcaattagtataaccattattttgaggcacctgatacttatcagtcaccttggaagatgtcagggatgaaaggtgaatgatacatggttgtgaactacaggaaacacacagtctaaggagaggcttcaaattctagttgtgtgagagaagaaaactaataaagagaaaaaaattatgtaacctttggcatgctttttgtggatgactttaacatataatgtgtgtttatgtataatatgtctataaaattcgtattttctaagataaagttttgaatttctaaattataattattttgattgccccttcagtttcttagtgtgtgtcattgctggtcaatgaagcatactaacagacca

SEQ ID NO: 35452 - DNA, 1065 bp, Homo sapiens
tggggatggcttgctgaccagtagggaatttatccctttctttggctgtcattctatcatttacttgactaagataccaagtatctccaaactctcaggctgcagctaaagctgcattcctttcatcaaaggccagggtttgatctaacagtagcatgacatctctccaagtgagatcgaaggtttgccctagacccggtaggacatctatatacctatcaggatcatctgaaaacttccccaggtctgccttgatctgctttaaatcagagagggagaaggggacatgtacccaggttgggccaaattcccctccccctacagcttgaaggggacataactgatggtccggggggatttgtggtcctttggagatttctttgcttatttctttctgagcaggggagattagaggaggattatcattaatagtaaggggagctacagggaggctaggatatgggggtaaactgagaggtcctcctgtgggatgtaaattgcaagctttgcatagttgtgtattctccttcaatgaaaagaaagctaggacataaggtatttctctccatatttgccttcgctcttacagaaaaggtcaagctgcaggatagtattgtaatttgtacttccctcaggtggccatttttctccatcagagagagaatattggggccaggccatagtgcagaaaaaaatgagctgcctctttttcagggtttgtgggtcaaattggccccaatggcttaggatgcatttcaagggtgagcctgttgatgcctgagtgtttcccatctgaaagacaaaaccacccacagttttggtttgttttgtttctccctctgcctaagaacctgcaatggtccctggaccctgctgatcagaatagttgtgcttaccgacgcagcagcagaaacaacccctgcccaagaacctgcaaccatccctggaccctgctgattggaatagtcgcactcactgacgcagcagcagaaacactagttttcctcccaggccacaaagaggactgaggaaggttggatttagtggcccttactgacacattct

SEQ ID NO: 35453 - DNA, 1045 bp, Homo sapiens
gaataccgatgctatttttgttgcggaccagtacttgtttgtccttaaatactttatgcctctgaactttcatagaatcctttatgaaagttaacttcatcaatagacggttaatattaatagagccacagtgctaccagtagcaaactaggtagaccattatttgttttgcaacaagatgctaagcatggcagactttgaagttgcgtttcatcttaaggaccaagggaggtaactttaaggttgccagtggtggatccagctccgttaggctaagttgtctacagctaatgattgtgtctttattctatatccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgattttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagat

SEQ ID NO: 35454 - DNA, 1064 bp, Homo sapiens
cttctgcgccccagagcgtgcgggcgggaagcgggggggatgccagcagctaaagtgccacccctctctgagggttccccctttagatttagtggtgaggagtcttaaggggttttccttccacccgccccacccctcactggtttctttttgtctcgccttctggtttcaatcatccgcagtaacccgaagccacgcagctctgcgctgcctgttgctggctctctgcctcctcctttcccatcggagaatagttttcattgcatgggtttcggagaatagttttcactgcatgagtttgctggctttctgtgggtacttgagatcaggctgtgatttctttccatgggacttagagcctgctgttctagttggccacctgcccagggacagctgataatgccattgtctgccccaggcctgcttagcgctggacccagcttgaagggtttaggtcacgtggattggcttctttgacggtttagttcaggactcctccctttgtatgattgctagaatgcatacttaggatagtttctgttaaatctcgaatccccagaaactagcaccccacctcccaaccgtaactcacacaccactggaggggagaagacagggaaggggagttttatgttctcttgagtgggtcaagtggaatgaggtatgtagagtgtaacctgggagagttctgtggcctgacctttcctgcagattggaaactaggggatgaactagattatctcattgctccgcaagtatttttttttaaggatgactagagtgcttaaccagcttttatttttgcagaacaaactgattgcaagtaaatatgtagaatgaagtgctaatgtgttattgaggaacactgttttattttatatcattggtgaagaaaacgtttggctgaaaagtgaattttccaccaggagctgagtgttttctgcatttgtgtgtgattttttaatgttatttgtcagagctcagagtttctgttctttgatctatacattttcattgtttaaagtgttcacaggtcaatgcccatgttacccaaatagcagtaa

SEQ ID NO: 35455 - DNA, 1022 bp, Homo sapiens
aatcacagtgcaaaactatgtgcaaaatcagtgtaaaaatctagctgtggatagaggaagaagaataaacagtttgtatccattttcacagcagtctcttatttaataacatagtttttaatatccagagacagagggattctatctttctaataacactttttttgtgtgtgatactgggggtaaaagcctgaaagtttggaaagacatttttatgttatagaattgatgccactttatatagctgctctctgacaaggaaactaataactgggaatatttggataagtgctgatagacatataaattacatctttcagcaagaaagtgttccaggagaatcaacatacttttctaatatggctttaccttaaacatgtcaattcatctgggtattttattctaaaaagaaatttaaagcattaattgagggaaaagggggcatatttttggataaagtgtacttaattttgtttaagaactacttctgtcttatacatggaggtggtttgctaagttggagatggaatgagtagttctagactttgactgaaataagtgagtgatggaaaaaagtgtgttgaatattgtaacataaatcatgcaaaactttaaacttctattgattatatatttctcaaaactgcaaggtgggcatggcattggaatgattaatttagaaatatattttccagacaaacacatttaattaaatctttttgggtatgaaatgcatccttcttccaactctacatctaggtaatgtcatgactatgcacatttaacatttacataaatatgtttatgcttcagagcttttcatttgcttgtattattactcattataattttcaaatcatatcatctagcaaaccattttaaattaaaaaataatcaatggcaagtgattgtgttttctggttctcaaaataatatacaaaggagagtagttttaactataattaacttcaggttgcccaagagagtaagagataattagtttgtattgtttatattccttt

SEQ ID NO: 35456 - DNA, 1045 bp, Homo sapiens
tgtgagagcagtggctttgtctgttctgtttaacaatatatttttatctcctagaaagctactcaataaatatttgtcaaataaatgaatagcatcccacatgtccatctatgggattttgattccaaatattatataaggagccttaaagcacattttgcacatacctaatgggactgaagagttattttaatatcatcagatgaaggtgcatacattctactatatttcctgtggatctacaaatatgtattttcaatatattttgtacaatactttttatgagacatggctaagaaattgcaacaataacatatggttttccttttctatttcatttagaatatttttaatcaatgaaagaggtgaatcaatcagattctggcaggaaaaataaatggtgtatgcactttgagcaatttcatgaaagtttaaataaggaactgtttatagaagtgtgaacagagcctactaacagtaaggtcccattctcaattttaggcctgaaaaagctaaagaaagcagctgttataagaacactgagaaacagagacatgagaagagcacctttgacagaaaatgtgatgttagttcaagggatgcagccaacattcagtaatgcttccaggtgttgggggagaaatagcgctatctctatctaattcatattctgtctgtatctctatctattatctatcccatctcactctccctcctcctttgatttcttgcttatttccttgcatactgaactctaccagaagtcagacgaaaaggcagcttctcagagtcatttcattcatacgagttaataaaagatctggaaaaggccccaacttgggggataaacacatcaattgcccagttcatcctgtacagtaattttaggaatacattgaaagaaatttacaacatttggtttatcagatatcacagattaggcgggagtgagattagttgaggagaaatatcccggaagagatagagcacctaaattaaatttgagggttgcccaaacagttctcacttttattactgttcacgt

SEQ ID NO: 35457 - DNA, 1048 bp, Homo sapiens
ttgcactagagctgcacatgcatcttatccaagacatggcgaatctgaaagagaaactcctgtaggggctgaaagagctacaggctcagcagaagccccctgtcaacaaagtaagctggaagagccaaatatgacatagctcttcccggagccctgtgcggaactccagacgccttaccaagctcatgcaaattttacctgtggccaatatttgcctaaaagtgtacaaagaattgtagtatctagctctagtagttaaatggcacagtacagagctactatagacttcattcattcctacataacttgatttatcgctttaaattctctttggtctcagttataaaaagatgaagatagcagggtacgtcttcatgtgtcctctgtattttgacatcctaaccttccttactatttctacagtgccacagtttataacagtaaaattctgttctataaccataactgctgttttagattacatcctatatttaaatgaattgaatgcgctctgtcagcagttgttaccatagtacctctattaatttattttgcattttaacttcttccttgaatacatgtttcaaagaaagatcatgtggatcacttttactaagttgcatacattaaaaatatttttctgcactctttaaatgtataagacagccaggtaatcctttcttccttcctccctttctttctttctttcttcttctttctttccttctttctttctttctttctttctttctttctttctttctttctttctttctttctttctttcttctttccttctttctttcttcttctttctttcttttctttcttttctcttttttcttctttcttcttttttctttctttcaggttcttgctgcatcacagaggctagagtacagtggcactatcacagctcacttcagccttgacctccctggctcaagcgatcttcccacctcagcctctgagtagctgggactacaggaatgtgtcaccatggctgactaattttgtatttttttctagagatggggttctgccatgt

SEQ ID NO: 35458 - DNA, 1101 bp, Homo sapiens
acaacaatgcgagttatttgtaaaattggtttgactaggttaattgcaaaattacatctcacctagttcatggtgtttgttttttccaggtagcttgaactggatcattaagtatcttgggatttaattttgtaatatttgttggtgaaactttgtagtctagaattattgcctggtattgatcatagattaaaattagaaatttgtgaggtttaaacttaaaaagagaaaaaggagaaacattgcgtgatgtgaaaatagaaagcttgcataaaggaaaataagagaaattatgtgctatgaaatgttgggctgcataaaggacctaaaaattacctacggttgtatcatgttcatcttcatagccatttttaatatgccaccgtatactttatggttgaataaatgtatttaatgaatggaaatttgaattaatttgcatataagaaacatgaatttttctctgattttaggagtgatagcaaaatactaccagagtaatctctctgaaataaactattcccaattaaaatccttacttcctccctcctgctcttaagatgatgttcaattatttaaaatggcacaataaggttctttgtaagcttctccaattttattttttctggttttgccatgtaagaagcagcagctttcactttgcctttcagaaccatttttcttttttgtatatactgttctatcatgcctctgtgtgtattgttcacattttctgaaaattccctttattttcatagctaactcattcaggtatttctgttgggttatccataccaagaagtctatcttttccttttttctctttatccagcactataataacatagcattaagtcgtagcacttgttcattgtacatttaatctgttttctcagaaaaaggagtcttctatctgatctccatactttctagtgtctttcagataccagatttaacctgagttttaaaatcttatcgtattaagatcagtaataagaaattatgcattggaaggcatacaattagttcatgttttcaaattagatttcagaatctgaagtgtatggattcctggttcatggaggatttgatctagaatgt

SEQ ID NO: 35459 - DNA, 1050 bp, Homo sapiens
gttgcagtagaatatttcatgcctgtttgatctcccatcatatatgaaattgtattgcatcttggtctacacttagtaattatcaattgaatatattgttttctaggcataagttggtttataaattttgtcctgaatgcaggcctcttttaacttaggtttttattactatatgtatatttggaactattaaattctattttagaatacactttgatagcacttattaacattcttcccaaagtgcttgttatttaagcaatggtttgtatacttaagatcatttttcattaatattcactagtgttcttcaaaaataattaatactcagggttttttaaattaaagttttatatcttacagaatatttcaataaagcttacatgaggcatgaatgatttcataaacatgaaataaatactgttttattcagtagagtatccatttatgtcctgtgtatatacatatataattattattacacagaaacattcaattgtttagattcccccattcctcagtagtttctaataagtgaattctgctgattgctttagaagataaagacaaatatctgttaaagagcaatggaactagagaatgagcatatacactttagctgaaagcaaagtagcaccagagagttaatggttgaatgtcagatgaatggtgtactgcacataagaagtgataggattgagtggaaggggaggtaataaggatttctgaaaaatttaggctaatactctgtggcattttacaattatttggcagtctttttatcttagtgatataaaatcagtgtcttaaagttgatgaaatatgcactcaattaacatgaaagataggcttaaagttatattcattgttggaggtttcttattgagatggactatagttttatatttaagcaaattaaattttgaaagtattatgaactttgtttctcttaacagtaattttagagaaaaacaggataataatgtattcatttaaaaaagaaaaatatcaagacacttcaaagaaatgttgaccctcattttttaattg

SEQ ID NO: 35460 - DNA, 1032 bp, Homo sapiens
ggaggttgcagtgagccaagatcgcacagctgtactccagcctgggtgacaagagtgagaatccgtcccccccccaaaaaaaaaaaatcctcccacttcagtcagcctcctgagtagctgggattatagatgtgcaccacaccaccacacgtaacttttattatagtatattgctataattattctattttgttattaatgttgttactctctgtgcctaatttataaatttaactttattgtagttatgtgtggataggaaaaaatatagtgttcgtagggtttagtactatctgtggctccaggcatcacctgaggtcttgcaatgattcccctgcagacctgtggctccaggcatcacctgaggtcttgtaatgtttcccctgtagataaggggaaaatactgcatgtaacttacttgtttactttgtctgtgtctcctgatagaatgtaagctctatcttttgcttactactgtgtccttcatacatagaacagtgtctggcacaaagtaggcactcaatatacgttgatgaattaatgtcactaacttcagtgatttcactactggaattgtagtagaaaaactatgctcacacatgctcaaagcctgttcctgtaatccagctgtaacctgggctctgttttcactttctgtttatgatgtcctgaactgagagattatttttttaaggtcttgtttaaaagtttatgtctaggatacactaaaaaataacaacatatcagaaataaaagagataagactgctagtttttataatcactgctatttactattgtccaaaagtgcccatcaatacagttggataaaggagcaggattaatttgtgcatgggatggttatatattaatatctagaaaatttaagaattaaccattagacatctagagaatttaagaaaaaccattagaaagcaagggtggcagactgtaaaacatgaagataacaattttcttacataccaaaaagaaccagtttaaaatacaattggaaaggtaccattgccgattg

SEQ ID NO: 35461 - DNA, 1047 bp, Homo sapiens
attcccagtagatcatactttgtccactcacatttctacatggctgtccattcttcatcaaacctaagcataagaatagttttctctgggtctttcatttcttttccttttttttttttttttttttttttttgcagtagggtcttgctctgttgcccaggctggagtgcagtgacacgacctcagctcactgcagcctcaacctcccaggctcaagcaatcctcccaccttagcctcccaggtagctggaactacagatgtgtgccaccatgcctggctaattttttatatttttttatagagatggggtcttgctatgttgcctaagctggtctcgaccacctgggctcaagcaatcctcttgtcttgacttcccaaaatgctgacattacaggtgtgagccactgcacctggcctgggtcttcatttctgaaggctctgatcactcaggaaattacaagtgttttaggagctctgtgtaaggaaccagacaaagaccaactatctattggacaaagaccatatatgtatttctcatcacatgctgtgttttatgtttctcctcctcaggcaacacagtgcttctcctcatactgtgcatgcagcactccttcccagagcctggcagattgtatcttgacctcattctggccatcttggcactggaactcatctgttccctgatatgtctcctcatttacacaggtgagaattacaacgagcctgttcttataggaacttcgaactgcttcctttcctcccagtttaaagtatagcccattagcgacaaggaagttctctgtgtatctgagtggtgaccacatgcagacttctttaatttcaaaccaacaggaaggtacagccaccaccagtgagaccccattcttttaagattgtgtcattaataaatttttgttaatgcaagtgaaacttttccattaaaacaagacacaaactttttgggctgggaatggtggctcaagcctgtaatcccagctctttgggaggatgaggcagaaggatcacttgagctctggaattcaaga

SEQ ID NO: 35462 - DNA, 1049 bp, Homo sapiens
ttcctacttggaggaggcagcgagaaaaagaaaaagaaggaaaaagaaaaaaaaattttttttgaatccaggctgggcatggtggctcatgcctataatcacagagctttgggaggccaaggtaggaggattgcttgaggccaggagttcgagaccagcctgggcaacatagtgagttcccccatctctaccaaaaatgagaaatttagtgctgtaacaaatgagcaccaagttaagttttaaaaaaaaaaagaaattcctgggcgtggtggctcacgcctataatcccagcactttgggaggccgaggcgggtagattccctgaggtcaggagttcgagaccagcctggccaacatggtgaaaccctgtctctactaaaaatacaaaaattagctgaacgtggtggcgggcaactgtaatcccagctactcgggaggctgaggcaggagaattgcttgaatccgggaggcagaggttgcagtgagctgcaatcataccattgcactgcagcctgggtgacaagagcgaaactctgtctaaaaaaaaaattaaggccgggcacggtggctcatgcctgtaatgctagcatctcagcactttggtaggctgaggcgggaggatcacttgaggtcaggagtttgagaccagcctggtcaacatgatgaaaccccatctctactaaaaatacaaaaattagctgggtgtgatggcaggtggctgtaattccagctactcaggaggctgagaatcgcttgaacccgggagatcaagattgcagtaagctgagatcgtgccactccaacctgggtgacagagtgagactcgatctctaaataaataaataaatctctatttcaaaataaataaataaataagtaaaataaaataaaataaataaattagtcatgtgtggtagcctgtgcctgtagtcctagctacttgggaggctgaggtgggaggatccacttgagcccaggagtttgaggctgcagtgagctatgattatgcaccacactccagcctaggtgaaagagtgacacccccctct

SEQ ID NO: 35463 - DNA, 1058 bp, Homo sapiens
atgcctataatcccagcactttgggaggcagaggcgggcggatcacaaggtcaggagatcgagaccatcctggctaacacagtgaaaccccgtctctactaaaaatacaaaaaaaaaaaaaaaaaaattagccaggcatggtgatggacacctgtagtcccagttactcaggaggctgaggcaggagaatggcaatgaacctgggaggcgaagcttgcagtgagctgagatcgcagcactgcactccagcctggatgacagacagagcaagactccgtctcagaaaaaaaaaaaaaaagagagacagaattggtttatgatatagatagctctgaattctaaataaatagtttatttcggatcaaattccaggattttatgcctcaacccatttccagaaacttgtaaaattagtaattcttaaatacttaaaaaatttttttcccttgatttcacaaatatggccactcttcccaaggggaaaaaagatcgcttcttggccttttggctaagatcaagtgtagtatctgttcttatcagtttaatatccgatacgtcctccatccaaggggggaaaagactatcagtgcaatgattgaaaaccttacaaagaacgaatcttttgtaaaataacctttcttgcaaatctgcctcacaagggaatgtggtggtttgggctgcggattcagacataccagggttgaatcccagctctgccatatgctagcttgtacaaccttgggcagttaacgtaatttccctaagccttggtttcctcatctgtaaaatgaggataataaaaataagattgctgtgaggattaaataagctagtggtttataaagcacctagaactgtgtctgtagagagtaaggattcaataacttagctcttgttaatattataaattctaaagtaaaattttgctagaaaatctaggttaatttctaggtcgtcacaatgaaccatatttatttcaccttataaaacccttataaatagagtttataaaactgttttataaggtgaaataaaagattcatttcaaatatgtattt

SEQ ID NO: 35464 - DNA, 1027 bp, Homo sapiens
actggactaacgtaattcagaaacactttacgaaattaaaagttgaggacagggtttaggggtagcatgcaaggtgagagttagaaataaaagtggagtattttgaaaggggaggcatgaggaaagaaaagcagttataagttttgaggcaaaaatttggcaactgagtttgttttcctataaaactaatgctatgttagagtttaatgtaagatggttgtagttctgctccctgaagtggcaccttcttttgataaatgaagagtagcaactcattaggaaataaaaagagtggtgacaaagacatgatctcctttttttttttgatggtttgcacaattaaaaaaaaataaaatagtattcaaagttagtagttaccaaaaccagaactcttcacaaaaatccatactcagaggcaaaccttaaccaataaacaatttgtaacaggcctcctgcactaaatacttcattgtatacacactcagcccaactgtacaaaaaacattactgatctgtttactctggctttaacagtaagtcatttgtcatttaaaaacaatattcatgtggttgggataaaaacatctcaaacatatacacaagcatctggaaggtaaaattttccagattcaatcaccaccaaatcccaagaggtctctttttttggctactgaataatcttgaaagcatccttcccttgatatgctattgcaggtcaattctgtgagcagatttcagaaactcaaatttccagagcacaatattgattaaagagataaggtaccagaatcaaccagagaatttaactattacaagtcctcttattctactcttctcacattcagtgaaatctgatggtaactaaattccacaaaatttcagagtgagcaaactcattaacatgttggcatttaaatatcacttatattcaagaatgtaatgtattaatatataaaagagcccaagatatacaaactgagcttttgtatatcaattctgttttccttttactgaattttacggtaaa

SEQ ID NO: 35465 - DNA, 1024 bp, Homo sapiens
ctttcattttatgccactattaagctttttatttcattgagtacattgctctatgcttattttataaatttgtattttttggtactatcttgttctttcattatagtttccattctttttaaaattgtttcaatctttttaaagttattttagaggttacttaagattgttcaatattgtgcaatacttggccttctgtttttctgtttcttgtactatgactcttaatatggtttggatgtctgtcccctccaaatctcatgctgaaatgggactcccagtgttggaggtggggcctggcgggaggtgacgggatcatggggtggatccctcatgaatggtttagcaccatccccttggtggtaagtgagttcttgctcaattagttcacatgagatctggttgtttaaaagtctgggacctccaccacttctctctgttgctcctactcttgctgtgtgattcacctttttcgccttcgccttcaccatgattgtaagcttcctgaggccgcaccaggagaagattctggtactacacttctgtataccatgcagaactgtgagccagtaaagcctattttcttttcttttttttttttttgagacggagtctcactgttgttgccctgagctggagtgcaatggcgcgatcttggtcactgcaacctccacctcctgggttccagcaattctcctgcctcagcctcccaagtagctgagattacaggcgcccaccaccatgcccagctaatttttgtatttttagtagagatggggtttcaccatgttggccaggctggtctcgaactcctgagctcaggtgatccacccatctcggcctcgcaaaatgctgggattacaggcgtgagccaccatgcttggccaataaaacctattttctttataaattacccagtctcaggaatccctttatgcaaaaacggcctaacacaactctcctcatggttatttcttcacatattattacctttatataaggcaactttttgcttgcttctaag

SEQ ID NO: 35466 - DNA, 1015 bp, Homo sapiens
cttcatgtaacagcacttttacagaatttacctacacaataatcagtgaaaaagcaaatctgagtgtagtttgacaatgactatgagggtagatgacagtgttgttttaaaaaccaggtgtgtgtgtgtgtgtgtgtgtgtgtgtgtgtgtgtgtgtgtatatatatatatatataaatataaaactttatatataagcaaattctttggttcttggagtccatgctgctgttactatttctctatgtaacactaggggccactatacacacaggaggtcgaatgacccaaaagagctaataaaatctttttctctctttgccaggttagtgggagaaatgaaagatttctgtttctgttttgctaggccttataaccatgtcctcattggctattttgatgatacaatctattttttcaatactttattttccgtattggttagtaatgtagaattagtttacatttgtaagtctgatgttcattctgtcagagagcaaggattcacagatgagcctaccagcaaccacaagctccaggctgaatgagttctgtcctgctcggttggtagctatacatgtgtagatgccggcatcacgtgacgtgactggctctatgatcagagagtgcaccccgttctcacgcaccagcatcttgtgagcactgtcagggcgtacgggctttccatctagttgccagcttagatctggggttggtaacccactgacctaaatcataaaagaaatacatgtaaatttttgtattaaaacagagtgaaatcactggtagctaagaagtctgcataaattcctccttcagtagtacaagaggtggcttttttttttttttttttttggacagagtttcactcttattgcccaggctggagtgcagtggcacaatctcagctcactgcaacctctgcctcccgggttcaagcgattctcctgtctcagcctcctgagtagctgggattacagatgcctgccactatgccagcctaatttttagtatt

SEQ ID NO: 35467 - DNA, 1022 bp, Homo sapiens
ggtcttgattctttatccagtttgccagtctgtgtcttttaattggggcatttagtccatttacatttaaggttaatattattatgtgtgaatttgatcctgtcattatgatgctagctggttattttgcccgttagttgatgcagtttcttcatagtgttgatggtctttacagtttggtatgtttttgcagttgctgggaccaattgttcctttccatgtttagtgcttccttcaggagctcttgtaagtcaggcctggtgatgacaaaatctcttagcatttgcttgtgtgtaaaggattttatttctccttcgcttatgaagcttagtttggttggatatgaaattctgggttgaaaagtcttctctttaagaatgttgaatattggtccccactcttttctggcttgtagggtttctgcagagagatctgctgttagtctgatgggcttcctcttgtgggtaacctgaccttttgtgatcctccaaaggaggatctttctctctggctgccgataacattttttccttcatttcttcaaccttggtgaatttgatgattatgaatcttggggttgctcttctcgaggagtatctttgttttctctgtatttcctgaatttgaatgttggcctatcttgctaggttggggaagttctccttgataatatcctgaagagtgttttccaacttggttccattctccccgtcactttcaggtgcactagtcaaacgtaggtttggacttttcacattagttccctaattcttggaggctttgttcattccttttcattcttttttctctaatcttgtcttcatgctttatttcgttaagttgatcttcaatctctgatatcctgtcttccacttgatcgattcagctgttgatacttttgtatacttcacgaagttctcgtgctgtgtttttcagctccatcaggtcatttatgttcttctctaaactggttattctagttagcaatgcatctaaccttttttcaagcttcttagcttcct

SEQ ID NO: 35468 - DNA, 1022 bp, Homo sapiens
attattttttctttttgttaatagccattctaactaggatgagatgatatttcattatggttttgattttcatttccttgattagtgatgttgagaattttttcatatattagttggtcatttctatgtcttcttttgtgaaatatccgttcagatcccttgcctattttttaataaaaaatatttttgctgttgaaatgtttgaattctttgcatattctggatattaatcccctgtcaggtgaagagtttgcagatattttcttccattgtgtaggttgtctgttcactgtgttgattatttcctttgccgtgcgcaagcttttggtttgatttaataatatttatttatattttagtttcctgtgcttttgaggtcttactcataaaatctttttctagaccaatgtcctgaagcatcttctcaatgttttcttctagttgttttgtaattttgagtcctacatttaggcctttgatccattattttttctttttcaattaggatttgaatgtggaattttaaaatttcttttttctttgttttctttttctttttttttaaattgtactttaaattctgggattacatgtgcagaacgtgcaagtttattacataggtatacatgtgccatggtggtttgctgcacctatcaacccatcatctaggttttaagcccctcatgcattaggtatttgttctaatgctctccctccccttgctccccaccccccaacaggccctggtttgtgatgttcccctccctgtgtccatgagttcttattgttcgactcccatttgtgagtgagaacatgtggtgtttggttttctgttcctgtgttagtttgctgagaatgatggcttccagcttcatccatgtccctgcaaaggacatgaactcattcttttttatggctgcatagtattctatggtatatatgtgccacattttctttatcgagtctatcatttatgggcatttgggttggttcccaagtctttgctactgtaaatacggctg

SEQ ID NO: 35469 - DNA, 1050 bp, Homo sapiens
gaggtgggtggatcacctgaggtcaggagttcaggaccatcctggccaacctggtgaaaccccgtctctactagtaatacaaaaattagctgggcatggtggcgtgtgcctgtagtcccagctactggggagcctgaggcaggagagtcgcttgaacccaggaggcggaggttgcggtgagcctagatcgcaccactgcattccagcctggtgacagagtgagactcttgtctcaaaaaaaaaaaaaaaaggaaaatacatgtgtctaaagacagaaaactttggacagcgagaacccccatgatattgttcttaagctgattggattgcctgttgattattgtggctcttcactgtaaattaagtttcatttatagtttgttggaaattctgcagaggctagtatcaatatctgtgttagctgcttctccttttattcttgcattccttctggccttctcattcttcttaaagatgagaggatatgaaggaaatattgctgacttttaaaataaatgtggtaagatgttatggcagagaagactgtatttcactgtgtaatttcacagtgaaacatacataatacaaaattagttttgttattccaggccttcattacagactatctgaaggtagtactgtgtgcattttttcaacaactttttatctgaatacaaaaataatatatatatctgttgtagacagtttggaaagagcagaaaaatataaagaaaataaaaatcattacctgtaattctagtatctaatgataatcactgttaatattttggtatatagtacttttttcagtcattagtataagttctttgttgtgtttttaatagtggtataacttaattcatttgtaacctacattttatacacaaatgttactttcagatttaagtatccttctatagcataatttttattttttatttttatcttattcatttatttgtataaatacaaatgaatgcaggtgcagatgcagtttggttatatgcatagatttcatagtgggaagtcagggcttttagggtatctgtc

SEQ ID NO: 35470 - DNA, 1618 bp, Homo sapiens
agtttgttagctactcagagaagatattctaagtgttcttatgtgctgtttggaatgaagttgatttcccactctgcttccctctacaaatataatattaagacatagaaatttgttctagttaaaatcttggtttagctttttggtaagagccttatttcttctcccttagaaaagtgttgggttgtttttgttctttttgagtcctagaaacttacatcaaagagtggacatcttatctggcagatacatcaaatagtgccccatctcacaattgttagtactagtgataggctaaaatcctgatgcctttttaaatataaaggctctgctgtatataaaaatgttgaaaactaaaataatgacctagggatatggaaatgaggtgtttctatttatagtttatagctagtcagaaatcgataaaggatataatctttttaaaaaaattgtttaaaaatttttttgagatggggtttcattctgttgcctaggttggagtatagtggtgcagtcttggctcactgcagcctagaccttctgggttcaagcgatcctcctgcctcagtagtagctgggattacaggcataagccaccacacctggcctatatctttagagtttatcaaatataaatcctcattgggcaggagccatgcatttacctttttgagcaagagtgtccctgttcctaaagagttcctataaaaattgaactgggtttttaatcacatatatggaactaaactagaagtatctttgctctaaattggtttaatgcttgtcatttcagttatcttttcgtcgagttaagaagtgataactttgtagccaattggaaacctctgactgtccaggtgatgcagtagcatcatttgttggacagtggcatctactggtagtctgtaaattttatagcctagtttgaaaggcattgttaatatatacctagcaaaaaggggagtagagcacaatttccagaattttataaatgaagtgaaagaatgatatgggggagagtcctttggggccaaggagagagagcacagaccggaaagtaatacaagtagtaagaagggtgtgtgagttgtttaaggactattaatctctctcttcaggtctgtgatacatgatatggaacctaagagaccatttatatgtcatgtcctgggttgtgaatatatttataaatgaagatcacgtggttcataacctttaatataaaatgacatggaagttccatacagcccagagtaatttatcattagagactagctttacatttttaatttaatttctgataaattttatttaatttctgataaagtggggacagatacatgagttttaaaaagctacagacagattattagggcagtaaaactattctgtctgctactgtaatggtggacacatgatattatgcatttgtccaaacctgtagaactgtacagtctaaagagtgaacccttagcttgtgaagacaaaatggtattaataaatgaatacataaatatataaaataaagagtgaaccctaatgtaaactatggactttacttaataatgtatcaatattggtttatcagttgtaataaatgtgccacactaaggtaaga

SEQ ID NO: 35471 - DNA, 1035 bp, Homo sapiens
aaaagaaaaaacaatccagaagcagcattgttgttatcttagcactgttttctctttgtgtatgctttatgcaagctgattgatttttagcgttagcctagatgaactatctgtggaataaattatttgtggtttggaactacatgtatttgcttccttctcttttcaggattggaatactgtgggtaatgaagggttaattttagttcatgataatacaaaagctgaatggtttcggggaatggaagtgtacttagctaacaataactcatgcagcaaactttctggcatgtctcctacgtgtagggactgagctagctccccaaattacaggaatgaataagatatttctgcacaaggagctaagtatagtgaaaaagactgacatgtaaacaaataattgcagtgtcatatgacgaatataaaatagaggtacatatatggtgctatagaaatgttgaagaaggaaagaatgcttaattttgtctagtttagagtaaatagttgtcaaggcagtagactaaatagtgggaatccagtttgcatactaaggggaagttttaagattgttatggaagtgtggttgtagtctttctttcttaaagattttactttccagtgcagttttttttttttttttttgaaagtggtggttttatttatcactccccttttttgttgagcatacaacccttatagagcataatatatatttatatattatggatttccagtgcaatttatactacagataaaaacctgtagctgaaaatgtggccatttaatagagtggcctttatgtatatttagcagatttgatggtatgaatatgcatcatttgtcagaagcaaagtgcaacttgaaatagtagaattaaatcagttctgtggattacttaccaactttattttagatagtaatttcaaccagattcttcaacagatcttgtaacacagctaacaaacatcacagttaacaaatatgtgtccttttatgtcagttttcctggtcaccttcaaatggagtttccaatta

SEQ ID NO: 35472 - DNA, 1033 bp, Homo sapiens
gctgtaactcaactcaaccttccaaccgttgttctttattttgagggcccacatagaaaatgcagatctcctttctacatggtgccctgaggtatttgcaggtgtgtccccttgtgtcttttctctaatgctatacccttgaagttttcttttcctattcctcatatcacagatttcaaattttcccttattaaatctcctacctcatttagtgttccaagtccactaaagagacttctggttgatataaatttagtaattccatgattgttgtcacttaatcatgaatcttcatgactagagtgtctttagtatacatttctccatcacatctacaaggatgtcctgggagaactcaccagatgccacattgagattcacctgccttttacatcatcctcccatccacagagttctccccattgctccatcatttctgctgtgacttattgttagcgagtgtctcctggaagagttttatttccctttctaaatgttcataaatcttttgtttaatactgttttagaatttcccagatggtctgcaaagtgctttggtgtcatgtgtttgaaaattggggccgggcgcggtggcttacacctgtaatcccagcactttgggaggccaaagctggtgtatcacctgaggtcaggagttgagaccagcctggccaacatagtgaaaccctgtctctactaaaaatacaaaaattagctgggtgtggtggcacatgcctgtaatcccagctactcaggaggctgaagctggagaatcacttgaaccagggagtcggaggttgcagtgagccgagatcacaccactgcactccagcctgggcaacagagtgagactctgtctcaggggggaaaaaaaaaagaaaactgggacttgcacatgcctttccttgcctgttcagttgaccctcatcccagattcaccagattatcaaaggttattggttgcatttcttctgctatttttctctgtaccctggagtgaattcagcctgttaagagtaatcatttgatctct

SEQ ID NO: 35473 - DNA, 1071 bp, Homo sapiens
gctttaagtatccagggtaggggaaatacttgttcactgatttattagctgattacacatcactgtggaatttctgtcagtgtgtcatttcacattgacaaattttcacttagaattaatgacaattccatgttcataacctcctgagatacatgtatatttcttttatagtatccctacatctggtaatcaggttgtagaaaataaaatttgtcattggaatgatacttttggctaacagacatttctgatttatggtgtgcattcagtgaacaaatatgtaatggaaacatatatataaaacttcatgtattgtcagaaccagtaaacacagtgaagtgaactgagaccaatttaaaaattatccattggtctctctccccagcaccatgaatagactgtacatctgttgctccaaaagtaataggtatttgtacctctttatacttaattttcagggttgaacttttaaatttgtatgcacattcactgttcacagttgggaagggtttttcttcctttgcggttgctgtcttctctgcctaggcctttcatcctccaggaacttggtcacatctattatatctttactgttttgcatgtcagttattccctttcccctggctatcctttaatataggaaaatgatcagctttttacgctccccaaaagcctattccttgactacactcccctcaaattatgattctaccttttttcttacttctgctaaacttctcaagagaatcgcttacccctgctctctgcctctgctttcttactccctgcagttagtgttagcctctggtcactccagtctctgaaattttcctcctgtttgctacgaactgacttttcttagctcttgtttttgtcattttgtcctctcaataacatctaccactattcttttttaaaaatatattttttaggccgggtggtggctcacacctgtaatcccagcactttgggaggctgaggcaggtggatcacaagttcaggagttcgagaccagcctgaccaacatggtgaaaccctgtctctactaaaaatacaaaaataagctgggcg

SEQ ID NO: 35474 - DNA, 1063 bp, Homo sapiens
gagtaattagttgtattcactttctagaatcaaccatagacaaatcatgggagacatttctctggctatggatagagtgtgttatcagccttaacaatgggaaatcaaagggctcagggagcacaagtggccttaaaggtgggggtgctagcttcctcttctagggaatgagagaattggaaggtaatgtctgtgttccaaagaataagaagtagaagtgtaggtacatagtttgaagttgccaaggtgacccctggaggagctaagaataacaatgctaactttattttttaactaaaagcctttcctcttgagaataatgatagcagaagggcacaataataacctttgatctaataatcaaagagttgattgaactatataaaaagatagcatcatttatacttttggatatattttttcctttagatgtattattttcctttaaaaattaaaaagttaaatcaatgtttataaaagaaatttagggagattgtgggtaagttgggaagagggaattactgtgttgcttagcatccaaatttccctttcaaacctgaagtaaataaatttttgtaagtgaaatttaaagacattgttgagaagtcagtaagggagaattactcgttgcttagcaccatactttcatctgtaattctgactgaatacattggatctgcctttgagtagcttttttttctttaagcactgtagactatgtcccatggtgtaggttttcatatcttctgaatgctatccacttgatacaagtaattattgcttttccttctgccagaacaatagaaggaaaaggaaaaatgagcactggctcctgaagttctaaaggcaaaagcaggtctcctctgagctccaggaacggctgtttaataaatatggctaaagactcaatctaaaaaggagttgtttaggtaaggatttagggtagtttatgctccatctattattcagaggcttctttctaatttaagagtttctttttgctttccatcaggaaaacattgagagagctgagattgtaaagatcggttaatgtttatggagt

SEQ ID NO: 35475 - DNA, 1015 bp, Homo sapiens
gcaccattctcctgcctcagcctcccaagtagctgggaccacagtcacccgccaccacgccccgctaattttttttttttttgtatttttagtagagatggggtttcaccgtgttagccaggatggtctcgatctcctgacctcgtgatccgcctgcctcagcctcccaaagtgctgggattacaggcatgagccaccacgcccggatcttaatatgacttgtaatggggatggtgctataaactgaacttaaaggagagattccttattgatatgatgggaatctctcctttaagttcagtttattttcttgacttttaatagtcaaaatgtttgtatctgtagaaattttattgctaacattggtattttctaaaacaacataagtcaacttaaagggtccttttataatagtgtaattctattttttgcacctgaaggaacaggatgttttataatggaatcagaaagaaaataggggatttgatagaaataagtgttttatagttagtctctgagaaataataccagttttataaagtgggatacctatactgcccaaataaattcgttttttttttaacttttaagttcatgggtacatgtgcagtatgtgcgggttacataggtaaacatgtgtcatggggtttgttatacagattatttcattgcccccaaaatttgttaacaataagtccaggcattttccagctaccactctccttaaagctaccatactctctatttagaaaatagggcagtcatcgctcttgctggagaagttatcattcctttacttgcactaatttttctatataacctgcagatctttaaatctttcatctaggtgacactctttccttactagtcaaataaaatgactccagtccccatcacatgtattttgggaggtctactgtcctaagtgtttctgaggattcctggggaggaagcaggcggtggagagtgtatgggtgaaggtatgtgcgaataagcttatgacaggcacttttct

SEQ ID NO: 35476 - DNA, 1679 bp, Homo sapiens
acagcaatcaagccagtgtggtgttggtgaaagaaagacaaaccagattaatgaactagattagagagcccagaaatagactcacataaatatagtcaagtgaccttttgtcaaaggagcaaaaataatagaatggagaaaagacagtgttttcaacaaatggctgctggagtaactggacattcaaatgcaaacaatgaatctagaaacagacgttatactcttcacaaaaattaattcaaaatggaccacagatctaaatgtaaaacacaaaactatgaaactccaagaagagaaaatctggatgaacttagatttggtggtgacattttagatgcattctaaaggcacagtatatgaaagaaacattcgataagctgaaattcattaaagttaaaaactctgctctgcaaaagacactgtcaagagaatatgaggcaagttacagactaggagaaaatatttgtgaaagatatatctgataaaagactgttagctaaaatgtacaatgtacaaagaactgttaaaactcaatagtaagaaaatgaaccattggattgaaaaatgggcaaaagacctgaacagacacttcaccaaagtagatatacatatggcatatgaaaagatgcttcacacacatgtcattagggaatgcagattaaagtgagctaccaccaggtacctattagaatgacagaaatccagaacactgacaacactaaatgctggtgagaatgtggatcaacaggaattctcattcattgcaggtggaaatgcagaatggtacagtcactttggaagacaatttggcagtctcttacaaaacgaaacatactcttactatatgatctagtgcattgcttggtgtttgcctaagttagtcgaaaacttatgtctttacaaaaacctgcacatggatatttataacagctttactcataactgccaaaacttggaagcaaccaaaatgtcctttgaactatattacattctggaaaaagcaaaactatgagacagtaaaaagatcagtggttgccagaagttaaggggcagggagaatgagtaagttgagcacgcaggatttttttgaacactgaaattatgctgtatggttctgtaatggtggatacatgtgattaaacatttttccaaaaccatggcatagaacaccaagagggaaccctgatataaactgtggacttaggttgatgatgcttgtcaatgtaggttcactgattgtaagaaatgtacccctttggttagggatattgattgtaggagaggctgtgcttgtctgtgtttaggagtatatgggaactctctgtacttcctgctcagttttgctgtgaacctaaaactgctgtaaaagagtctttttaaaagggaaaaaaatggaaggaaattatgaaaagggaaaaaacatatagatacttgcttaaatattaaaaagtcctgggattattgtgtcattctcttgtatcaagccagaaagttttactttttctttgtaattgattaaatatttcagagaatcttttagaaattagaaaatagtccaggcgcggtggctcacgcctgtaatcctggcattttgggaggctgaggcaggcagatcacctgaggtcgggagattaagaccagcctgaccaacatggagaaaccctgtctctactaaaaat

SEQ ID NO: 35477 - DNA, 1031 bp, Homo sapiens
ttacattcagatgcttctcagagttctgtttataaacattgtcaggagcagagagtgttagggatcttccacttgaaagaaaaatgacaaaaagaataaaatcactacttgacttgcctgcggttttgtgttcagcctttcgtcttaatgctattgaggattactcttgctcactagagagcacagaatgatgttgtgtcagcaaatcgaaaacagtataaaatgctatgtgcgcctctcatttctgattaactacttgagaccttttcacattaaagtttagttgtgttcaactctttcgacacgagagttcaaagaccatgtacttttaactaaaccagaattgtttgtctgctaaacttctgccttgaaggcaaatttaacctgtgcctgatctttaatctcattaattttaacaaaaatcatgacctcttcaatgactttgtttttggaaattataaatactaacctaatacaatgtatgaatttttagatttttactccggattgcatttccatgtaatttcacattcctgtgtacattacacaccagtgaatagtaacagattgttagtatgttcaagctttgtgttgcatggtggtaactatagagtttgcgggtcagttgtttgacagaggaatccagtacagtgaaagctaatcccattggagctgggtgcccaggtgcccagactgctggaagtggggcaggattgggaattgctaaaatctctccgaaggccaggcaggggttgctctcatggaagaaagcaagtgttccccacccacaacaccttccccactccctagtccacacttgccaaaatatgcactctaaatgtactagaaaaaggaaaatttatcctgtggaggagaggatcaaacagaagttcattcggttctttcatttttgaccgaggaaagctagcgtgaatgtttaatcacagaacttgcgaaggaacatgtatttaaaatgaaatttattcttcttcaatcttcatgtgaagtgtcagctagctgtggacaccact

SEQ ID NO: 35478 - DNA, 1029 bp, Homo sapiens
tctgttttcttgtcgttggtgggtcatatcatcctgcaacttcaatctctccactggattctgctctttaagctctgcaagttaactatttttacttttaagacacacacactcacccaacctaccctcaactctgctactccttcaagctaccatcacttttatcactttccttttataaccaatccttgaaaaatagtgtaggctcatccacatttcctcagactgactcacttcctttaacattgcagtcacctttctgtcttgatgaaactgcagtcttgacagtctccagactctcttagtcactaaatccattggccttttacccagtttaccctcctttacatctgtgcttttaaccctcttgcacacagcatgattcttgaaatgacttcccttcctcatgtccctagcgttctatctaaggtgttttgtgaggtctgccttttctctggtggtgatcctctttccgtctcgtgactttaggggtcaccatcttgctgataactcccaaacaattgcctccagccctcacttgtgctggagctctggttccacaaatccagctgacttttcctacctgtgaagttggccagcattcaaacctaatatgtctgaagccgaagcaggtcatactaccttccttttcaaatcctcttctcctttcatgatgctttgctttggtcatgtccctgtcatccctctgttgcccagggttaaatctcagggtcagctggtcattaactggcactaaccttgtcttggtaataccttttgaattcatcaatgcagagctttgctctctttactcccaggcatgtggtaattggtctctctctgtctgagctggtctccctctttttagtctctcttctttcccaactgctgttggattactctgcttaaagtataaaacccttgggcaccctgttacagaatgagactcgatgtcccttaggctggctttctaggcccccagggaatctggccccaattttccattccagcctcatgtttgacttcccc

SEQ ID NO: 35479 - DNA, 1054 bp, Homo sapiens
tactcatgagtaatactctgtggagatatgctctacattagtattcacttctcactttcttgcctcagcccaggttatttatagggatgttaggaaaacgttctgaaaacagtgatgttaaacaaagttagaggacttttaacacttagtatgcattgtgaccctctaaaagagaggcatggtatacgtccttttccaaatgtatgtggccaccgaataggttttttttttgggtgggggggtggtataccaatttatgtttccaggtgttctaaggaacacaatttgggacacaaaaaaaaagacatcatgtgttgtacaataaagtattatatttagattgctgttttgaagagtcagaaaattcttcctctgattgttattaaagaaggtgacctacaaaagtattggagaattgggttaagtttgacaaaagaactgtttttaattaaattcaaatgttaattattctaggtaagtctcaataaaaaaggaattataaagatgagttcagttttccacaagccactgcactccagcctgggccgcagaacaagatcctgtctcaaaacagaaaacaaaaagcaaaacaaaactcttaagtatgattatattacgtatcaaaccctgtaaactaaaagagctctttcctggtgagactgtcatgcctttttttaaaaaaataaatcaggttaagctgttttcaggtttgcactcttggaaccatctggaatttgtttgtttgtttgtttgtttttcgaagaacagaattttttttgtttttttaaagtaaaattctaacattacaaaattataggagacacttgtggaagtattcattagaattagtctagaattatcaaattagggcagggaaatctaaaaaacttttgggtatgggtgtggtatatgtctgtgagtctgtatgaaaaataaaatagaaagtgtactgatggatgattccatgctgcagtaggcagactaatgtgtcattccctttccctcccctcaagatgtttacatcctaatccccagagccgtgtgttattacatg

SEQ ID NO: 35480 - DNA, 1118 bp, Homo sapiens
tgagttattacttctctcaggagactaagctatctgatacttacaaataagtaacactaggtctacctaacatttccttatggattaagaagaatggcagattttgagaagcaacatgctaggaaggtttggtaactttagaaatgtgccacgctgtggtttctaggtatgctatgaatgaagagctttgtgtgtaagaagtgggaattctatgtgaatatttattatgtaaattctcatgtgttactaggtttatttaagtttcttctttgcgatccaaacttttccttgagaggcaagtttatttttcacattaacctgatatgtaaatttctcagtcacccccacctcccacccctagggcttttttctccatccagtttcatggtatcaggtcagtatttgggcagagggtgtttatcattaacaactagctagagtcatatttttgtttaacttcccctttgctataatccacccatcctgcctgttactgtgggttgttgccagtttaggatttatttaacatgccttatgttcagtgatatatgttgaaatttagaatgtatgaaaaaagagcctgtgttttgcttatgaatacgtcagtccatcagcacgtatttattctctgtccctgaactgaaggtcatcgtttcttggcagcattactagacatactgggatattaagccaaaaaaatagaataggttggttaaagatagattgaggcaaaaattgattcacagtttgatacttaaaaccaactttcctggtcagttgactattatctggcaatcaggcagagttgctaattattggcacccaggtgccagatggtagggagtaattagattacaactatcttatctatcagtagctttagaatgagaatagtagcaattttcatagcccttttcaatggtcatgaaaacattttaaaagctgatcctatggaatattgtatatctgactccagaaagtaaatttttgacacattaccttggggaaaaatatgtgacaagatattttataatcttgaaagagagaagtaatattttagcaactctgtgtcctgtttgttgcatctgggttagccatgaatgaattcattctgttct

SEQ ID NO: 35481 - DNA, 1030 bp, Homo sapiens
tgtcatggaatacctttgagaagttgttcagcccctccctactccctcaactacccacattgcctggcataatttcttaaaatagacaggcatgttataaggaagttgaagtttatgtgacagtataccagatgcacagaaagttctggaggaaatgaaggaaatattgagaggggaaaactactactttcttatctctgacaaattggattgatctgtagctggagtctggagagagtgctttccaggactcagtagtacctaaggcattactcaagggataggtaatgatggacaaaccagatacagatccttacttggtgctttccagggctaagtagcaccctagtaaggcattctaggctttattccaaggaatggcattggcagaaagaattgaaggaagtagtgggagaaagttaggacaactgagttgctccaggtttggtgtggaaagcaactgccagctgtgaactgtgccgtgggacatctttgacatccatctatgaacaagcacctgtagagagctttcaggtccagttatgttcaataatctatactaggtcaaagatgacattaatgcatgtttctgttgaaaaagtttacatttgggggaggtaacacacaagaaacaacaagtaaggcagcagatagtgaagcatcagggggtgggataagatatagaataagtctctatctatgatggggttcttttttgtagttcgtggtccttggattaagtgcatggtcaaagaataccaagtgtggaccagagtggttgggacatgctcccctggcgtgtaaggttcactacaaacactgacggacaaaggagttgttgtcttcgcacagatggggatggggatgtgtattaactcataccggacccaagcaagacatttaatgtggtggtttggatgagggaaatgtttctgtgtgtttcagaatgattgaattaaaacggaaaaggtgggttttgtttgtttgtttgttttggctaaaccatgtttgttgcatgcttgacctctta

SEQ ID NO: 35482 - DNA, 1053 bp, Homo sapiens
ctgtattggtcattagatttattataaataaaaagtgaagtctgcaattacagaaagttattcaaatattaatttatatttgggaatttggtataggctattcatgaagatgaagatgaaaatattgaaatttgttcaaaaatagttcaaaatattttgggaaatgaacatcagcatctttatgccaagattcttcatttagtcatggcagatggagcctaccaagaaggtaagatttcctcacatgtctgtataattttcagtaaatgtgagaaaaacaagatgatacatgtatatgaatcagcttacatcacatccattttgtgaaatctacttgggaactatataacttttaagcaataataaaattaactttgtcatgtacttttactgatctgtcatatacttttactgacttaagtcctttaagtccatatttttaatttaatttacaagtaacctttgaatgaggtttttaaaaatcttactagatagatttttggacagctctagcaattagaataatcctagccgggtgccgtggtttatgcttgtgattccagctacttgggaggcttaagtgggaggatggcttgaggccaggagtttgagaccagcctggacaacatagtgaaaccctatctctacacacaaaaaaatttttaattagctaggcatagtggtgggcacctctagtcccagctactcaggggactgaggtgggaggattgcttgagcccaggagtttgaagctgcagtgagctgtgattgtgctactgcactcagccttggtgacaaagccagaccctgtctcaaaaaagtaaataaataaaaataaagaagattataacttagaataattcatttttttttgttttttttgagacagagtcttattgcccaggctggagtgcagtgtcgtgatctcggctcattgcaacctccaccccctgggctcaagtgattctcctgcctcagcctcccaaatagctgggattataggcgtgcgccaccacacctgactactttttgtatttttagtagagacagggt

SEQ ID NO: 35483 - DNA, 1033 bp, Homo sapiens
gacaagtgtaaagttgtcttcattctagagctagttaacttatttccaaggcatgaccctctagggcctccactgtacatcacaggtgatcttgaggaaacacctccctcccggtcagtttgatcatctcctacctgcatgagctctgagcattgttcagcttacaactccccagctgttttggcctagctttgtgaagtttcattctgcatattcatggcctgtgctcatcaaagactcaagaaaactaccttgcaaagttttgaagttttttttgttttattttaatgaatctctcttttctagttctacctccctggactttgatctttgtctcatcagtctagcaaggctgcacccaaagtccagatattttctccaggcagaaagccagtttagtggtagggtttacttcattcatttcccttctcacagggatcacagtcttgtgctgcttattgtttaatatctaaacacaatgtcatgtattttgtccagttttctagttgtttcctgtggaagttaagtctggccattattactctctcatggccagagctggaagtctccagaagataaatgtgatattttaaggctatgtcctgggccttctctgtttgcatttgcttcccaagtaatctgaccccaaggctttaaatataatttatatgctgatgatactcaactttattactctagttctttcctacagattattcatctatttcatcaatctactagtcatatcaaccaattgtttcctaacttctcttcctaattctgtggctgcctgtgtgaaatccattgtccaaatagaaaccagaagtcttttttagtattataaattatgtcaaatcacagccatgcttaagacttcagtggctttctgctgcttaactaatattcagactctttaccatggtctacaaggtttcatatggcattgactgcctctctgtctgacctcaaaacatttttctctagctcattctaacattttcctttgatacaccagtccctttcctgcagtaga

SEQ ID NO: 35484 - DNA, 1066 bp, Homo sapiens
tacatgaaacataaagacagttttagaataacacagcctattttgaattacttcatctatcaaaactttttctagttataattaagagagtatatgaattttcctctaatttctactttttcctctaatttctactttttcctctaattttctgacttaaattaccaaaaaatcaggtaccaaagaggaagaggatatagttaattatgtgagcagtaatctaaaaatatgacaaataattgagaattggcccctgtctatgttgtctaattaataatatttaaaggttagtcattgctgataatgaaggaagctttgttaacattttataggaataaaaaatttacaaggaacaaattaatgaaaaccaaaaagtaacgaggatgtaatatttttaaaggtagatttaaaaaaataaaattatctcttcctctgtatctatctgcatttaaaggacagtagtttaactgatacccgggaaacttcagaagagatgcaaaagaccaacaatgctatttcagtaagtaaaattttcaaagtttatcaatcattttacttaatgatatacatattaaaatatataatgtcgtgactttcagagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagtatgtatagtagtatattaatatcctatttaggtctagtacatatgtaaacttatagactaaccactctgaaaaaaatgaacacttagaagaattgagagaagctgaaagaattctatatattttccttttgggcgaatagaagtgcctccctctcacagtgaaatgtgaagagcagagaaaactaatcaaactaatcagccttaatagcaaggatttttattacaaaagtgtatag

SEQ ID NO: 35485 - DNA, 1035 bp, Homo sapiens
tagcctggcctaccttaaacatgctaagatcacttacattagcccacagttgggcaaaatcatttaacacaaagtctattttgtaataaagtgttcaatatctcatataacttattgaatactgtactgaaagtggaaaacagaatggttgtatgggtacttaaggtacattttctactgaatgcttgtcactttcacaccattgtaaagttgaaaaagcataagtcaaactatcataagtgggaaactgtctgcacacgtaatggtatgttgtaaccttttgtgactggtttctttcctgcactgtaatgatattcatgcaagttgttgcatgtataaatagcttgtttcatttcgctgctgagtagtactccattgaatggatgtacaacagtttgtttatccatttgccagttgtgggacatttgagatgtttccaatttttggtaattatgaatagagctgttttgattatttatttccataggataaatacccaggagtgggtctgctgggtcatattgtaagtgtacatttaacttgattttttaaaaactcttttttccaaaagtgtttcaaacattttgcattcccatcagcattgtactcgaattccagttgctctgcatcctcatcagcatttgttgtcagtgttattttagccatctaaaccatgtataggaatatgtcactgtggctgaatttggatttctctaaatgttaatgatgttgaatgtcttttcatatttgccatccttatatccttttagagaaaggtctttgtccattttaattgtatgttttcttattctttagctttgaaagttctattatatgttctgaatacaagtcttatattggataaatgatttgccaatactttctcctagtctgaaacttagcttttcattcccttaacagaatcttttgcagaggatgaggctttaactttgatgaagtccagtttgtcaatttttttgtttggatcatgcttttcgtgttatgtctaagaactcagcttatccaacaatcatg

SEQ ID NO: 35486 - DNA, 1008 bp, Homo sapiens
atccatgaagaaaacagatgcagatataaataataacatgaatgaaccttgaaaacagtgttgagcaaaagcaagatacaaaagaatatatattgtatgagtccattaacaaccccaaagttaggtaaacagtatataaaagaagaaatgtaaatatctaatatataccattatgcatttcatccatgtaaccaaaaaccacttgtacccctaaagctattgaaattttaaaaattaaagtcattttattaacacattaatattacatgtatgtaaaaatcatagctaaaattgttgtatgtatatagttgaactgtatatataagtacaaaaataatctctgaaggacactaatgaaaatattaacagtggttaccgttactctggaggtggagagcaaaatagaccctaaatttttaatcttgtttgaattttatatactgaatatatattgtgtcactaatttttttaaaaaaattatctccatcattgggcttttcaaatgatagtctatgataatattggaaaacttaaacatccatacctgaacacaaaactgtttagttgatgattggggaaggacccttttccacagtttctttgaatctaatgtttctctttgtttaacagcatatcaaagactacgatttttttttttaagataatgtaatttggaagagagttatggaagtattgactttacctttttcttatcttaaatttctgtaaatttgggattttcaaataagtgcctcaaaatctttatttaatttgtagttttactttttgtccaggcccatcaaactccagagaagagagtgaatactggagaagaaaggaggaaaatatctgaggtataaagacatctgtctggttattttaaagctttgcaaacataattttaaaaaagaaacaaaatcttactataaagcctccaaacctttccttatttctttcaaacgaatacctataacttctttttttttttaaaaaaaaaacctcattgaa

SEQ ID NO: 35487 - DNA, 1027 bp, Homo sapiens
gtcaccacaggaagcctaggactccagctttccctcactgcctagactctcctattgctgtaagactctggtcatactctgatctgcccccacccctgcatagttttctataggttggtgcaaaagtagttggggtttttgtcattgaaagcaaaaccgccattacttttgcaccaacctgtaatctcttccagaaaactctcttatagtacattcttggcaaaatccactgtattttaaacttctaaagatgtcttcaccttttttgcttgaaaacctggtttgtccctgaacacactgttctgcagctgtcttacatgctggctgttttctctaatcccttaatattattgggtctagaggtaggatgaaggaaatgtttcccttgcttctcattgccagactctccctgctgcctgatcctgccattctcctcatctctctaccttgatgcttttgctaccagactgtatcacctactgctcttctgtgttaggatcatctgtagacacttgtcttttttttttttttttttcttttgaggtggagtctccctctgtcgcccaggctggagtgcagtggcacaatctcagctcattgcaagctccgcctcgcgggttcacgccattctcccgcctcagcctcctgagtagctgggactgtgggactacaggcgcccgccaccacacccagctaattttgtttttgtatttttattagagacggggtttcaccatgttagccaggatggtctcgatctcctgaccccatgatccgcccgccttggcctcccaaagcgctgggattacgggcatgagccaccacgccccgccaacccttgtcttttgaagagtttaacacctgactcactgtcactccttccaatattgtcataattctttacagttttagtataaaaaaagatgatacttcctatagaacatggccttttgttttcattttctttctttctcttttcttttctttttgagaaagagtcttgctctgttgcccaggctagaggaca

SEQ ID NO: 35488 - DNA, 1046 bp, Homo sapiens
ggcgggtgggtcacttggggtcaggagttccagaccagcctggccaacatggtgaaaccctttctctactaaaaatacaaaaattagccaggtgtggtggcgcacacctatagtcccagctactcaggagtctgaagtgggagaatcacttgaaccggggaggcggaggttgcagtgagccaaagagtgcgccactgcactacagcctgggtgaccatgagattctgtttcaaaaaaaaaaacaaaaaagaaatttagaaaaattataataataaaatgagagattgtaaaaaaattttttttttaaagcatgcagtaatagcagatacaggaagcagctgctattcctagtgctgaggcagagtacccaaagaagacacaaatttttaaagaaaccctaaccccatcgcgaaggctgagattcagaccttactgggtagggtatggcagtagctcactcgatggccccacagtctggggctggcaaagaggaaagtgtccactgtggagctgacgaaactccctgcgaaactgcctggagtgtcagtagaatgtactgggaagccacttgaggagccgttgaactcactgggaagcctgctggggtgccagtggaacttatctggtgctgctctagctgggatgctggctgaggcaccagcagaattctgtgggaagctcttcttgcaggtgctgctgaaactcacagggaagctggtaggggcactggccaaacactcctggaaggtgcctgtaggggtgagtgctgctgtttgtcccacttgctgcagtaacaggaagaaaggaaacacactaatcaggaagagaagcttctgcctttgcagtgaccctctcagttttactgacaaagcttaatattgtgttagcaatcaaagaagaaatgtttacaacgtccagctctagcatcacaagctggacaatgaagagtagatttggagctgaggggcaatatggtaactggcctgctggttttatctatctttaaaaagatgtattcaaacctaagtgggccaattccatcttat

SEQ ID NO: 35489 - DNA, 1023 bp, Homo sapiens
tttcgaataagtaaaaattactcttattttttgagggctgatattaatttacagataaccaagtaaactttgctctagaaaacatattctaattatttggaagaggattgtgtttctattctatattggtaggaaaagaactatttctcattaccgatattctcagtttcaatttatatatgtttcctatatgttatttattttctggaatttagtttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcaggtaagttctttttcctttaaaattaaacagtagggttatgttgcttagctaagacatggcctccagtgttgaggagaacacatctggatcttggaggaatggtgtgcctttttcaaactacattagtgtcactttcctttccatggtctttctttttcttcagacagagtattgctctgttgtgcaggctggagtacaatggcaaaatcatagctcactgcagcctcaaactcctgggctcaagcagtccttctgcctcagcctcctgagtagctgagactacaggtgtgcaccaccacactcagctaatattaaaaaaaaattttttttagagacagtctcattatgttattcaggcttgtctggaactcctggcctcaggtgatcatcccaccttggccttccaaagtgctgggattataggtgtgaaccagttcgcccagcctttccattcttatataactgttttcttaatgtttgctttccagttatgcgttattcctctgttctctggatttctaactgtaaaatcattgagcatttctgtgcttcactctcctcacctgtgagcaaagggattattaaatgtatctataaggttattgtg

SEQ ID NO: 35490 - DNA, 1105 bp, Homo sapiens
ttttgctcaccttcctcttgcagaccactgattcttagatttagtcttttggggtaattttctgtatttcgtaggcactctttgttcttttttcttttttccccgactgtattttcacgtagccaatcttcaagcttacctatttttccttctgctgggtccattttgatgatgagagcctctaatgagttcctcagttcaacaattctgagttcagtatttctcagttccaaaatttctggggttttttgttatttttattatttcaatctctttgttaaatgtctctgataaatttctgaattgctgttctgagttaccttgaagatcactgagttttcttaaaactgctattttgaatttttggtcaaaaagctgacaaattgccatcttgttaggatcagtcactggatttttgctttgtcattttggggaggtcatggtttcctgttggctattgtttcttgtatgtatacatcagttttttgcattaaaggattagttatttattctagttttgtttgtttgtttgatttgtctggcttgctttgctttttattggatatatttgcttagtaaatctctattgttgggtcactgcttccttgttggcatcttccaaggtggcaccttaagtccaggtttagtaaataattcgagaacagcctgtcccaaatcagggaggtcccaaaggatttattccattggcatgagatggctagcaaaagaattatacccaggaacctctggaacattcctcctgcagtgtggtgctgctgaacagtcactctgttttggcatgcctttcgctgagttacagtgcagagtttccagggcttgggatggtagtcctgcctcccgattttgtctctgcctgtcctcagggatgtttttccctccaggcagtcatgatgcttccaaagggttaaaggcaaggacaggtctccagccagggaaccaaagatggtggggaaaactcttggccacctcaatctcactttttccagtgtagaagccgtgaattagggggagtttttccacgtgcttggtgccaggcagaattgggaggaggggtatcatagatgctgaagtatgcctttcttac

SEQ ID NO: 35491 - DNA, 1027 bp, Homo sapiens
ccattcaggctgctataacaaaataccacaaactgggtaatttatgaacaatagaattatttctcacagttctggaagctaggaagtctaagatcaaagtgccagcagcttctgtgtcaccatggtgagagcccttccttatagacagagccatcttgctgcatcctcacgtggtagaagggagaacctatgtcctcacgtggcagaagggccaagggcattccctcagccctcttttataagtgcaccaatcccattcaggagggtggatccctcctgacctaatcacctctagagaccccacctgttaaaactatcacattagtattaacttccaagtatgaatctgggggagcaccaacatttagaccatagcacactctatcactagaaatcgttaaactttatagttttattgactataatgcatgcttaactatccgcttataacaatcttcaatgaaattgtttcttctcttccatgtgtattgtagctgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctgggtaagtatcaatacttaacataattttattggcttattttcataagaaatattctaaggcccattgataaagaatattaaagaaatattctaaggtccattcataaatattctaaagccattgacccatttggtcattcaatgaccaaatactcagtcattgaatactaaccaaatgagtattcaatggttaggaaggtctggggaaaggttttcaaaggataattaagaacagaaaggatattgaatgtttaacactcctcagtgattgcttctcaatcgcaaatgaccaagaaggcttctagaaggaaataccattagagctgagtccaaaaaaatgagaagatgtccaggtgaaacaaaca

SEQ ID NO: 35492 - DNA, 1032 bp, Homo sapiens
acctcacagtttgccctaaaatttttgggtttaaaactatatcacatccatcacaaagttggagatcagaaaaagtgccttgataggccattgggaaaccatctgccgactttcaactggcttccaagaaagtgcaaagtaaaacattttattggcttgtagtgttaagaaaatgaggctgtaaggcattaagtcaaccacaacaaaccagtgattttgtttttcctctaatacctaaacctggtccaatatatctagtgaaatcttttacttctttttctttggcaatgaaagagaacatgctttcatgtaaaatgacctctgaaacaacagtgcagtaatgtggccagagcagtgtgtttagagtctgaaaatcaagagtgaccttgctatgtaatctttgacaactctcttactctctgggtgtcctgtgagttggatttctctttctgtaaaatatacacggccttttatctactacagtaggaatagaaaaaaaatttgagaactctcttagcattgcattttttgggtatgagaatttttaattttttaagagtcacagctcatttactttcagattgtatctgtgttgtggtttcattttgcagtctctgcatatccactattttagctactgatattattccaaattattttttgtcaccaaaaccaaaaatagtaggtcctgaatagccactataggtctttatgtttttctttagtgtagtacctctagagagcagtttattttaactctcttcttttctagattgttcatgttggaaggcatactttctgaactcttctcaagtgatgataaaatggactagttgataaatctttctggtacaggttttcaaaacttccatctatccactgtgctttcatgttaaagaaagaatggaaacatcatctctaaaacaagataaacagctctggggctgaggaggccagcctgctactgggtagttttgatatcagaagtatttcaaaacctctcccttgtggaggatgagttatatacccacc

SEQ ID NO: 35493 - DNA, 1084 bp, Homo sapiens
tggtatttattctcctgatcagaaattagccaaggcagcaacttgggagtccttttattcctttttaaaaagacattcaaatgatactgtagattcctttgactttatttaaaattgcatttttatttttatttttataaaggaagaaatcttgttgatattgttagaaactacatccttactgcttagaatagtgcacattataagtacctcaaaaatacatatttttttaaatgaatgaatctgcatttctgctaaaagtactcattaactgcaaggtcaatgtgaattaacagtctgatgtggctctcctaaaacccaaatgccattttaggctgcaataatggaggtgtcagatccaggataaatgaagaacataattcattctactcttagttttttggagtataacacttagttaaatatagtaccacacagcaggaaagactgatattaatacattttagtgcagtgtttctaactttctttttccatcctggtgaccccagaaaatggtaatatttgtaagatacaaatgggtaaaaaaggctttgcttatctcagggctgggggactaagacgctgtcaagaactaacaaatttctcttagttgctctttaaatgttgataatgagagaatatttttatgacaaaggagagagacttttttattctaaaaaatctgtaatactcaggaaacaacataaaatgattataatgctttctctcatgcacaccccaatgccatgacactcacagaaaataatatgttggcacacttgtaacacccagtttgagaagctgtagtctattgtgtcagtagaaaaccagctgggatgggcgagggaaacagaagccacagaattagtcattatacaggccacaattaatccagcacctctaatgtaaggcactttgcatatatgaactcattaatccatttatcaataaaatgggatggtgttattttctctgctttctcattaaggaaacagagacttagagacatttaatattgtatctaggtttgtgtaagtgctttatggtgagctggattttgaatctaggactgaccccaaatccc

SEQ ID NO: 35494 - DNA, 1024 bp, Homo sapiens
atgactttttgctccagtattcaacaacaaaatcgtcattaccattacttcatagcgtagcaacagtggtgaaaaataactttaacttctattcctagggaatgaaaaccctcatgggcattattagaatgtaccaataaacatttcccaagtgcattccttgggaatacacagttaaaaaggaattcttaagtctaatttgaacatgatagattatgattagttggcttatttacagcctaacttttcaaagccgttaatactttgatgtacatcgtgactatctaacaagggggatgttatatgcaatatatatctaattttgtttgacgtggtgttcttttttgggaggaggaaggtaaaaacattccagggaatacattttgaaataacctagtatagattatctgtaatcctactgtgtataaataaatattttagaatggttgaaataccctgttgttcacttgcagttatctgatgtaatcttctctcttatcaaagtctgtgggtctgtaattgttttctttcctttggtctgatagtacttactacaaaacaaacaaacaaacaaaccctgagagttgaattgagtcttgacagactgagagatttttccattttatattttgattaccatctgatttggaaagggaagtattactttggacagtaagggtaaggcaataaacctgaaagcaatattgaattcaaataactgcctgtacatattgataaatatatctgtgtcaaataatttgtaactaatagaccattcatcattatttacttggtatcgcattctctgtactaactcttttaaatcttagtacctcctgcaacacagaagtattcctaatgaaagctgacaggccactaagatactttttactttagaaaatatactaccttttgaggttttatccttagttctatacatctagaaatttggctttatctttctactgaaagtgaatctctcaggaataaacttacaggtagtagaatgtgaaccaagttgaca

SEQ ID NO: 35495 - DNA, 1035 bp, Homo sapiens
atagctaatatttaataatccaggcactgttctaagcatttcatatgcagtgtctaatgtcaatatatcttaacactagttaataaatattgattacagctttttaataaatatcaaatgttctttgactttacggtcacactatttagtcaagggccattgggttcaaactctacaggaaactaagagaaaacctcacacaaacatccagagaaaaaaagaattgtcatgtaacaaaatgaggtagtcttccatttcagttccaagaaagattatgaggtgggcagaagggagaatgagccaaatgatttctccatttttctagttaaaaatttatttttcccacaataagggcatttaaattcaaatttttggaaccacagactgtacatttgagtggcagtaaggaattatatttatttttcttcaaacacctttcaatatttcaatattcaataatagaattcattattaaaataaggattgagcaatgtttgaacaatggaactcttagatatgacactgaatgtggtttgtcaatttaaaaccaaccataggctttgagaatctctgttttaaatagtaccaatgtattaccaaagccagattcatttagtggtttattgtctcagagacgttattttagtttttcatcaagttaaaaaaaaaaaccattttacagtgaaaagaatgctttgaatattagtcagaataattgaacttaaagcattttaaatctctgctcaacctttcacagtagaaagttgtaattgagtcataagatctagaattcagaaaccacccactcagattgtctccatgaattttaaatatgtataagggccaggagtttttcaattgaccatcataatgagtggccaattgacttttggtttcccaatcagatgacctgtgttaaagccctggctccttttctccaccttcattttctctgtaacttaatctgtgttattcaaccatatttttttcaaaatctccattttgagaattaattttctctaccattatctttgg

SEQ ID NO: 35496 - DNA, 1068 bp, Homo sapiens
tttctctgtcaaaatataagaagatcccaactaagacatttcattctagagataatgttaattctgtgtctgaaacatttgacgtagaataaaaggcagtttctaaaccgtgttcctgcctgttagtcctatgcactgggctaggttttcatgatcttcttttccacatctcctctctgttctctgacccagggactacgaacatttttccccctcactttttatagttaatgcgatatttggaaccacaacttctttaatctgttaactctccttacttgtctatattatgaacattgtatcacaaagatgactgcattacataatagaggaatatgtcgatatttacttattgtatataataatgtgtttatccataaagacaagatgaagtgttaaaggaagctccaaattaagattaagaaaaatgaaagagaattataatggttttggattgagtgagctcacataagaaaaaagtaatatacattataaacatttcttagacagtatttgaaagggaaatctgacttgataaaaatataatcatatttttaaccacctagttaacttatatttgttttattttattttttagaggcagggtcctaccctgtggcccaggctgcagtgcggtgatgtgagcatagctcactgcagcctcaacctcccgggctcccgtgattcccctgcctcagcctccccagtagctgggactataggtgtgcaccaccatggttggataatttgtttttttaaagtgtctgtaatggccaggtgtggtggctcacgcctgtaatcccagcactttgggaggccgaggtaggcggatcacctgaggttgggagttcgagaccagcctgaccaacatggagaaaccccgtctctgctaaaaatacaaaattaactgggcatggtgacacatgcctgtaatcctcgatacttgggaggctgaggcaggagaatcgcttgaatccgggaggcagaggttctagtgagctgagatcatgccattgcactccagcctggtcaacaagagcaaaactccatctcaaaaaaaaaaaaaaa

SEQ ID NO: 35497 - DNA, 1082 bp, Homo sapiens
acaattaaaatacaatttaaaaatgaggccatggaaccatccaaagttcaagcacataacaaattcaaaatatgccccctgctaaatttttgacacaattaacaatttgaaaaactcacgtgctttcaaatatttccatgtggtttcttagcaggctgtatcttgccttctaccctgactaataactgttacaagacaattctacttggtgataaaatttgttttggcagacctgtggcatgagcaagtatagaactgacctaggaattgccaagccagatcagtccactagtttttcaaattgcatatactgacctctgagaaatcagtatatgaatatacaatgttttagggaaaaagacctatttataaatactcaggataacattattttcacaaaagcacattgcttcatcactcagaacaatatacagttgatttaaaacctgatatttcatgatctgaggcctttctcttagcttttcctagtttatgggagaataaattatttgaactgacaccacatttgaggccagaggaagaagcagactaatgtttactgagtgccaaccatgtctgtgccaaaatttgtgcggaatgcatttgatcctcactaaatccctgatgaataggtattcttttcctcatttacgaatgggaaacagaaccttaaagaggtcatggaggatgaacagggctggctgagctgccatttgaaactctgattgctccttacagaacatcatgcggaccaaaccaacagagcctagagaatggcccgaaggcttgtgcgcaatgagaaataatccagctatttgttctctaagcctgttgaataaatagctaattggtttgcaccctttccagcctgcttcatagaagcagtgttatgatgaagagcgcaggtttaagaaccagaccttctgggttctagtcccagctctgccgtttactagctgttacctggaacaagtcacttgttctgtttctgtgtttctttagctgcgaagtggggataataatactatgtacctcacagggttattttgaagattaatgaattaaagtgaggacataaatgc

SEQ ID NO: 35498 - DNA, 1051 bp, Homo sapiens
tacagatactacagacattaaaataacaataaaggactgggttccagttccacatgtaaggagtttggaaatcaccattacttcctaacaacaaataacaagctgaacagattgaaaaatcaacactctggatctagatgacacagggcaaactgttgcctccaacactggagagacagacaggtgaaagcagggagttagtcttgccagatcaaagactcatgaggataagaaaacctgaacaaattgctggaggcttgatgtggacaactctggggaccaaaagctcgagagaaaccgagtcacggggacaaggcacaatattcaccttcacaagttcaaccagatggacctggttcccacagtaaatatcagagaaaaattccattgctcttctggcagggagaggggaaaatgaaccattttgaaatacatgagagcactttgttcttaacaagatatttcctaaggagaaactatttaaccagaaccaaatgtgctgggatatgatcagaacctaactgatctgggggaagggaaataccccacttcaatcggctgtagcctttcatgtgggataaggaaaatacaaaccacaatagccaatacatcactttgaaggaaaagaataaaactgcaggactgacccctgacttcaacacttactacaatgcaacactaatcaagacaatgcaatattggctaaagaatagatcagtagatctatggaaatagaaatagatcaatggcaacaaatagtttaatggaacagaatagagagcccagaaatagccccacataaatactgtcaactatatttgaacaaaggagcaaaggcaatataatggagcaaagattttttttttcaacaaatgtgctggaacaactgtacatccctaggtaaaacaatctaggcacagatcttacattattcacaaaaacgaactcaaactggatcacagacctaaatgttaagtgcaaagctataataatcctggaaaataacatgagaagaaaaactagattaccttgggtatggtgatgacttttt

SEQ ID NO: 35499 - DNA, 1035 bp, Homo sapiens
ataattgattggtgtttataaaagttttatgtatactgtatttgataaaccatgtatttactttaattattgggtaccaggtttcatatatgtccattggataaactttttgtcttgtttttgtattctataacaatgacttttgtgtggaaatattttgttgtgatattaatttttgattagtgatattaaattagctatcaacttttccttgattagtatttacctggcatatatacttttccatttatttagtttcatttcttttaatttattttttcatttttttggtttccacacttgtatcttataagttgacatagacagatttccaaaattcaattagaagcaagtttaatcttataacacttatttagatttctgagaatttggctttatttctgttgtcttattggtgtgtgtttgtgtgtgtgtgtgtgtgtgtgtgtgtgtgtgtgtttactgagttttacctttaccattttcctctttttttttctctgttgtatttcgttgatcaaatgtttttaactctctttttgtctttttattatatgaagttcttatacctttacatttttaacatgcacaaatgatgtgacgcagtcttaatttaatcaatatctccatttgattctggaccgtagaaggaccttttggttcagtgacttcatcatacttgtgtagttatttcagtaaggttctgtgagttaggaactccttcagggttggttagtctataaatgtttcacactctttcttgaaaggcaatttagcctgctttaaggttctagcttgacagttattttctcccaacattttacagacattatgtcactttctgttggattacattgctgctttgtaagtcttctttcagtctaattataatgctcttatggatactgtgaattttttctttagttgcttttaaggtcgttttgatatctagtaatttcctataacgagtacagttgtagaaacccttttattcaccctgttactggtagactgttcttcctgcatctgagacag

SEQ ID NO: 35500 - DNA, 1031 bp, Homo sapiens
atatatgtgtgtgtatatgtatacatatgtatgtagacacatgtgtacatgtatctgtaaaatatcactcaaagtcaaatatcttttatgttagctcaagtctaagaatgcttgacactttactgaaagcagatattttaaatgaaatttgacttttgtcttctttataatttctaataatatcggttgcctgtcataaactgaaaaacacatttgctatcttaggcagaataataaatatgggttgtaaatagtgtctttcatggataattaaactttttttattaagaatgataatagagtttactgtaaatgtggctatcttcccattacttatatttttgaatgtcattggaaacattgaaaaaaatagtgtgctactccctaactttacttcttttactccatccacatagaatatagtagaaatctctttcaagttttgttttctattattttgagaaaaatattctcttcacatgtatttccccagaaggacattctctgacataactatagtacaatgatcccattttggcgtgtgatattgatactatatatcacgttatccatggtccatattcgctttggctggctgtcccaattttttccttggttcctcactcactccaggaccctccactggacttgttatcatggttctctagattacttcaatctgaaagagtttctcaaccattgtttttaatcttgagatttaaaaaaattataggacacttattttatggaatgtccctcagtgtgggtttgtttgctgattcctcaagattaaattccagttttgctttttctgcaggaataccacaggaacacatggtgctattcccagtgcatcacatcaggaggcacgttgttgtttgtcctaaaattgcaggtgttaatgttgattggttgattaaagcttctccagtgtgaagttattccttttcccctttgtaattagtaagtagtttgtggggagatactttgagatgatatataaatttttttctcatcaaatattcacctaa

SEQ ID NO: 35501 - DNA, 1050 bp, Homo sapiens
attaactaatcagtgttatttgtttaaaaattttcctgaaacactcagttgtttttggtgccttgtcttagttgatactcaatttgtaatctttgaaataatttaacttcctcattaactttacattcgaatgaagtttaatttttttaatttttataaatttatagattttttatagatttagggggtacaagtactgttttgttacgtggatatactgcatagtggtgaagtctgggcttctaatgtaactagcatccaaatagcgtacattacacatttagtcttctaagtctccagtgtctattatttcactctctatgtccattacttatatgtgggaactaagtaatatgcacccgtattacttagttataagtaatatgcacccgtattacttagttgtacgtaatatgcacccgtattactgagttgtacgtaatatgcacccgtattactgagttgtacgtaatatgcacccgtattactgagttgtacgtaatatgcacccgtattactgagttgtatgtaatatgcacccgtattactgagttgtaagtaatatgcacccgtattacttaattataagtaatataacttacaagtaatataagttatattacttataacatatattataacttatattacttataagttatattacttgcaacttatataacatgtttcttataagttatattacaactaagtaatatgggtgcgtattacttacaactaagtaatatgggtgcgtattacttacaactaagtaatatgggtgtgtattacttacaactaagtaatatgggtgtgtattatttacaactgagtaatatgggtgcgtattacttagttcccacttataagtgataccaggtggtatttatttctgtttcagatggggttttaaaaagttttacaattctttatagagaaactctactatggaaacactaaattaaatatttgtttgtactaaacaagaacatgatgcttgttcatctcctttaataaattcaattagattacacagcttatctagtgata

SEQ ID NO: 35502 - DNA, 1044 bp, Homo sapiens
ctgcagacaaacagactttgtcagggaattgcaccttttctggggtctgtatcctttactttcctaactgaggctgtattgtatttgcaactttcactgaattccccaggagcgctctgcgctgctcaagcacaggctctggcgtccatctctgtaccgcaccctgtgttcttcagttgggaaaaaaaagggtctgtcggtatcgagtgatgcctacacttggtaagagcagtggatctaacaatcggaagatttcttcttctgacagcttagtaatttagtagaagcggtgacaaagaaaaataaaatcttgcttttcttttagttgcaattccttccttttaatgtgaccttttatttcaacataagaagtttgttgtggcttcgaagatacagcttgcttcaattcccttctcccttttccttttttcactcgtgactgtgttaagcttcacaaccctgcatatgaccctttaaatctaatttgaatgaggaaagaaataagcttagaaagaatttgtcttccaaagacagcaagaactctgtccaactctttctgtgtattccttgtagccctctattttataaacgtttgtcagtaaatacatatgttataacacacacacacgaacaaaccaaacgtattacaaagtctattgttattgtttaccagtaacttttttttcatttcccctgctttttgaattttgttcttttccatggaagttcactttactgtgtctctgaaaactgtagggcatttggctgctgtgaggggttcatgtgtttgctgcaatgagagtctgaccttcaaccctcagtttccttctctgttacaaagcacaagtctggtgtgtttctgtttaaaagccaaaaaatcagatttccggtgaaaacaaacttgtttattgagaggtggcaaagtgcaagggcaaaatagttttatttccagataatttgccaaatatttttcagtaggagaagttttctttgatgaaaaatgtttttagaaaggagaaaggaaggacacagtggaatatttcg

SEQ ID NO: 35503 - DNA, 1032 bp, Homo sapiens
gaggcggagcttgcagtgagccgagtgcagcttgcagctgcactccagcctgggcgacacaggaagactccgtctcaagaaaaaaaaaaaaaaaaagacgacatatttaagccacaaatgtgttaaaaattgtgaagtaataaaacctggtaaaaacatcagtgtgaagcatggtaggtgacttattaaaactggataacacaaggccaaattagaagacagtctaaatcactgaattttcaaacacaaatagcatagtttttttttattcctagcataccaaaagccttgaaagccactattactatggttttggaaagaaaaatcttatctttttaacggtataagcagatgaaaatcatttaaaatgacctcagcaccttttacagagaaattaatttagtgttatttttgggtgctttttcttgatagataactaataaactaattttcacactgaagattctatgattacatttacagtactttatctttgattaataaatcttttctgttgaacaaagatacatttaaacctatgatagattaagttatctaatactaaatcagtgcaataagaactaataatgttttagaataaggtgtaagtgtttaaatatttctaaaaattagttaggaactggtgagaaatgcaattctagaggcattagtgcaatgctgagaagtctggattttttggttgttttgtgcccattcatttactcgctaaataaattttgattgaatgaccatcatatacctactatgttccagataaactgttagatgctgaaaatataatcatgatcaaggtaaacatggttagttatatcacagatgtttacaggctaatggggaagaaaggcaagtagacaactgcaactcaggtattggtattccacatgacccaataaatcttgttactcacccaagtttggattgtagacaaacactctggcagatggagctaaaaatgttagctgcttttactgatgaggagttttgaagaaaagaactttagttagtctttcc

SEQ ID NO: 35504 - DNA, 1056 bp, Homo sapiens
tcagattcagaaggcttgggcttgagagctggacctgcaattttaacatgtaatccgactgatgatgaggcaggaagtctggggcatgcaacgagaaaaactgactccagaatgcctttctttcaagctgacttagccactcattacagctgttattccttcacttgtatcgctaatcgctaatatacaggcgtaccctgtcttgttgcacttcactgtattgtgcttcgtagatactgtgctttttttttttttttttttttttacaaattgaaaggatcaagcagcaatttccacttccaagtcttattatttaagaactatatctcacaaggcaatagctgccatacatagtgattcctctaatggatctggacaaagtcaattgaaaaccttctggaaagaatttaccattctagatgcccttaagaacattcacgattcataggaggagatcaaatatcagtattaataggagtttggaatagattgattccagtcttcatggataaccttgaggggctcaagccttcagtggaggaagtaactgcagatgtggtagaaatagcaagagaactagaattagaagtggagcctgaagatgtgactgaattgctgcaatgtcatgatgaaacttgaatggatgagaagttgctttctatggatgaataatgaaagtggttccttaaaatggaatttacttctggtaaagatgcagtgatattgttgaaatgacaacaaaggttctagagtattacataaacttagttgataaagcagcggtaggatttactccaattttgaaagttctactatgagtaaaatgctaaccaacagcatcacatgctacagagaaatctttcatgaaaggaagagtcagttgatgcagcaattatattgccttaaaataagacaaatgcaattcattatcttattgtaagaaattgcccaaccaccttcagcaaccaccaccctgatcagtcagcagccgtcaacagggaggcaaggccctccaccagcaaaaagattatgacttgctgaaggctcagattatta

SEQ ID NO: 35505 - DNA, 1091 bp, Homo sapiens
gtttaaaaatgatgttgaatatgatttagtttgacagatattatgaaaagtttaatgggagtggtactgaacctgtcttggaggaatgtgaaacatttggaaaggaagtggttctaggtagaataaggagctccttctcatggcagtaaggaggtgtgtttggggaacagtaagacatggagctggattgacaggatgggatttgattttggagagcttttaaaagcaatgataggaggtagggtgtcatggaaggtttttgagcagggaagacataatgagattagtgaaaatgttgtttaaaacagaattagttggagaagacagatccagttgtcacagtaatcctgggataatatgatatatgcctaaaccagtttgggaataatattatatgatatatatgatatgataataatagaatatgatacatgtctaagccagtggaaccggagagcaaaagattgatgagagataggtcaagtgaaaaatctataaaattaggaaatggagcaataagagaatgaatagaagattttgtctagaaatttgaaatcttgaagactggggaagcagtgggttccttgatagaatatttaaaggataaacccaatggtttactttctgcatgttttggacaagaaattaatttcatatttgaaatgttattaagaagtgatagcaaggccgggtgcggtggctcacgcctgtaatctcagcactttgagaggcaggacgagctgggtggatcagttgaagccaggtgtttgagaccaacctgagcaacatagtgagaccgtctctactaaaattacaaacagtagccgggtgtggtggcacacgcctgtaatcccagctactcgggaagctgaagcacgagaatcgcttgaacccatgaggcagaggttgcagtgagccgagatcatgccactacactccagcctggacaacagagagagactcagtctcaaacaaaaaggaaaaaaaaaaagaggtaatagcaagacatctaaacacaaatatttagtatgttaggaacacataatgagaatttaatcagaacacaggaacaaaaaggaaaacaaagatga

SEQ ID NO: 35506 - DNA, 1067 bp, Homo sapiens
tcctctccctacctggtctgagctgccacagggaacaaatgctctgttctgcttctctataaccatgtatttgacagcagctgattctgcctgcatccaggtcccacaagcctgtgactaggagaggcttcattctacacctggagttgaatactaggaagatgcttgcccatggacataagcaccttctcaaataacaactccatcagtgacagatttgagggtttttttttttcccaactgctttgatcttttgtcttactgagaattgtttcagatctcaggagggaagggagcatgtttttgagactctttatagttcaacagagtagcttactcctaagacctgttcatgataagcggggccagctttgcattaactctgtcatctagctgcagtgatggttagtaatagcaggaagtaaaatattcataaggtctgcaactatgtgtataatttcaacctttgcttatcacagttcacactgtccataaatgcacatgctgttctcctttctccacctcccgaggtgggataagtgtctgtggagctcagttctaacgttgcctgcccatcccccgccttccatccttaggtatgtgagggccgccctcttcctttcattgtgttctccttggagacttcacaggaatccacaccatctgctcacagccccatcctcaccttggagtccccatctcccactcagcagtacacttttgcaagtttgagttaatctaaaacagaatatctcaacctccacattatggacatttggaaccagatacttctcattgtgtgagactgtccagtgcactgtcgcatgtccagcagcggccctggccttcacccaccaggtatcagcaatctgctccctcccccaagttgtcagcaccccaccctgtcccctctccctccagtcgtgacaaacaaggtgtccctagacattgtcaaatgtcccttggggccaaatttaccccactgagagccacaaatgtagagtaatctttcagtgacttcattagaacagacttaattcctttgatatgcaaacaactgaggacat

SEQ ID NO: 35507 - DNA, 1056 bp, Homo sapiens
gggattacaagcacgtgccaccacacctggctaatttgtatatttttagtagagatggggtttcgccatattggccaggcttgtctcaaactcctgacctcaggtgatctgcccatctcgacctcccaaaatgctgggattacaggcgtaagccaccgtgcccagcctaaacccatgttttaaattaatgcaatgattgtattagcctttcaaacattaagactggcaaaattgttacaactatggagttttcattgattcatcctactcaccatcttttcctttaatatctgaacaaaccccaactctgttcactgttctccctgtgagtagactaatggaacaagagcaaacagtaacacaaacagacgctaacacaagttcatgcagaatcaataaaaatcagtacaacagaagataagtctatgtgtttttgatacatacgattaagcatgtgcctttttaacaatttatataaaacctaaaatatatgtatttctgatttttacctgtagtactgaagaagttacttaataacgttgaatataaaggccacttttacttaaccaccttccattcactattaactgctgtttccaaagtgtaagcaaatcagtctctgtgtacatagtcaagtgtatacaagcgtcaggcgtaacaaactcaagatgaacatgacagttcaaagatatttgggacaaaattgttgaagcatttttacccagggctctgtagctctgacaatgaaagaatatagttgctcttccagctgctattcagacagaaagcttgggcaagaagggtctgtatctatgttcttcataatacaattacaagtttgaacttcagataacatcagcagttggcatgtggaaaaccaaaaccctattttggtatttatcaagattgttaatggagtcaggtttcccttatttgtttctttaatggggtacagaacatcctgttggataacccgctgagtgacatgacgatgctctgaaggaatgcatgagagcttgtggtacctgccttgaaacatgggtttcactaatgctg

SEQ ID NO: 35508 - DNA, 1041 bp, Homo sapiens
gctgtaccctgcaaatccacaggggtggagctgcccaagaacatgggaacctacctcttgcatcagtgtgacctggatgtgagacttggtgtcaaaggagatgattctggaactttaagattttattgccctgctggatatcaaacttacatggggcctgtagcccctttgttttggccaatgtctcccattcagaatggctgtatgtatccagtgcctgtaattccattgtatctaggaagtaactaacttgcttttgattttacaggctcataggcacaagggacttgccttgtctaagatgagactttggactatgcatttttcagttaatactgaaatgagttaagacattgggggactgttgggaaggcatgattggttttgaaatgtgatgatatgatatttgggaggggccagatgtagagtgatttggcttggctctgtgtcctcactcaaatttcatcttgtagctcccataattcccacgtgttatgagagggactcggtgggagatgattgaatcatgggggtgggtctttcctgtgctgttcttgtgatggtgaatgagtcccacaagatctgatggttttaaaaatgggagtttctctgcacaagctctctctttgcctgctgccatctacgtaagatatgacttgctcctccttactttccgccatgattgtgaggcttccccagccatgtggaactgtgagttcttcattaaacctctttcctttataaattgctcagtctcaggtatacctttataagcagtgtgaaaacagactaatacaatctcactggtcagaatttagtaacataatttcccattagtttcgtggaatgctgagaagcataatagtttagctgtgaagaagcgtgttaatctaaaaatcaagtttttgttactaaagatatggaagatagacactgaaagtcaattatcagccaggcgtggtggctcacatctgtaatcctagcactttgggaggccgaggcagtggatcacctgaggtcaggagttggagaccagcctgg

SEQ ID NO: 35509 - DNA, 1005 bp, Homo sapiens
aaatacaaaaaattagctgagcttggtggttcgtgtctgtagtcccagctactcaggaggctgaggcagggagaatcgcttgaacccaggaggcggaggttgcagtgagccaagatcaatgccattgcactccagctgggtgacagagcaagactcctgtctcaaaaaaaaaaaatctacttcgcagttttcaaatgtgcactctattgttattaaccttagtcagcatgatccgcagtaggcctctggaacttaccctcctgcctaactggaattgtgtgtcctttgacccgcatctcgccaggtccccctccccccagcctccagtaaccaccattttagtctctgtttctgtgagttcagctgttgtacactccacgtctgataacaaattcttacataattaatgcaggtttgtgaaaaccttagttaaaaaactaatgaagacctgttctgtctttgttccgatgaagaatttacttaaaacggtatcagaggctaagtggaactatcccttatttggaacagcttatgacttaatgtgttttacactcgatttcctgccgtaaattgttaataccctctcaaagccgtgtaggagactcaccaatacctggagctggagcctatgctgacgatactgcaggggcagccgcagccactgggaatggtgatatattgatgcgcttcctgccaaggtatgacttcttagtttgtgaattttagagacctttggagaagatatttttttcttttaagatagaaaataatttttgaggctgggtgcagtggctcacgactgtaatcctagcattttgggagactgaggcaggtggatcacctgaggtcaggagtttgagaccagcctggccaacatggtctcgaactcctgaccgtttctactaaaaatacaaaaaatttagctgggcatggtggcacaagtctatagtcccagctactcgggaggctgtggtaggagaatcgcttgaacctgggagacagagg

SEQ ID NO: 35510 - DNA, 1175 bp, Homo sapiens
atatgggtgctaaatatttatcaaatgaataaaggaggaaatgcagattccagttattcatggtgatgttgggaagtactgaaagtcctcttaaattcaaatatcagaaatatgctctcccatctaataaatactttttgatggtgctggtattaatattcagatatgatatatatttaatatttatttttaatattaatattcatatatatatattttttaacaagaagctttacattcttcatcttgtgattttttggttaaaagaaaggaagtctgtttataatgctgtgcattatttctataaatcgccctctgtacacagggatgtcagatgctgcccaagagaatctgtttcatatggtaattttcactaatgaatccagacctatactgttaaattttgccccaaactgcctgggatgaagtagaggaagctcatggcagtgagcgtgacagttcttagaggacgctatcatagtgtttcataacagatgcagaggctctgcagttctgaatattaataccagcaccatccaaaagtatttattagatgggagagcatatttctgatatttgaatttaagaggacttccagtacttccgaacgtcaccatcaataattggaatctgcatttcctcctttattcattcgataaatatttaacacccattatgttcatggcatcacattagactctgggggagttacaaagaacctaggctgggctctgccctcaagggggaaataaaagaaacaattacatgtaattgtttttaacaccaagcagcgtgaaacccagctctggagcagcctggtcacaagggggagaagaggtcacgggagcccctccaaggccagcgcacatgtggccataccttgtgccttcccaagcccgggccctcgcacccttctcttgtctttccttgtcctcccatgccgtcagggtttatgagacctgcaagtctcggggcatggctctggtcactctgggcagcgaagatgattctctgatgggctgtggtcagtgaagcacagcttgtttgcctcttttgattttcctgcaatgccaggagagattgctcagttttaggcaggactgagatctcctaaaacatggaatttgtagacaaaaatgaatacttcctaacatttcctgagagagcttttggtc

SEQ ID NO: 35511 - DNA, 1046 bp, Homo sapiens
ttatatttatggctttttttttttttttttttttgagacagagtctctctctctcgtcacccaggctggagtgcaatgccacgatctcggctcactgcaacctccgcctcctgggttcaagcaattctcctgcctcagcctcctgagtagctgggactataggtgcttgtcaccatgcctggctaacttttgtatttttacattttgtatttttagtagagacggggtttcgccatgttggccaggcaggtctggaactcctgaccttaggtgatccacctgcctcggcctctggaagtgttgggactgcaggcgtgagccaccacgtccggcctatggttgttctttaatgtgcttcgataaataactcagatccagtttcctcttattctttgctttcttctattacattttcctcatgttcaggccacttattcctgaggttttccctttagctttagctctattgctgtgaaattggaactttagttggtagcataaaattattttctaagaagattgctgttgattgctattagttgctgttaattaataaaaagcattgctgatttaggttctgggtttttttgtttgtttgtttgcttttgtttttgtttttgcttttgttttgagatgaagtcttgctctgtcagccaggctggagtgcagtggcataatctcagctcactgcaacctctgcctcccaggttcaagggattctcctgcctcagtctcctgagcagctgggattacaggtgcgggccaccacacctggctaattttttgtatttttagtagagacagggtttcactgtgttagccaggtggtctccatctcctgacctcatgatccgcctgccttggcctcccaaagtgctgggattacaggtgagagccaccgcacctggcctgtttttaaattaagaagattcaggcaaattgtttttgtgttccaacagtaaacaagctgatgcaaaagaaatgactattaccaaaatggataatcttttcttacatttttcctcatcctcagtagtattaaatat

SEQ ID NO: 35512 - DNA, 1016 bp, Homo sapiens
cattaaagcattttttattactttattacataagtaatacacattattgtagaaaaaatttaaatagaaataaaaagatatataaaagtcactacaaactggagataactcttctcaatatctaaatatactccaagatgtaattccattttagcagttcttttgctttaagaaaacactttggctaggattgaagtacaaagttaggccaggtgtggtggctcatgcctgtaatcccagcactttgccacgaggtgggcagatcacctgaggccaggagttcgagaccagcctgaccaatatgatgaaaccccatctctactaaaaatacaaaaattagccgggcgtggtggcatgtgcctgtaatcccagatactcagaggctgagacaggagaatcgcttgaacccggaaggcagagattgcagtgagccaagatggtgccattgcactctccagcctgggcagcaagagcaaaactctgtctcatttaaaaaaaaaaaaaaaaaaaaaaaaggacaaagttaagaaaatatcagattctgtagaaggaatattagaaatctgagcaatatcaccctgtacttggagtttatgtgttagactgcacagatttaactggtgtatacagtcaatcctactgctttagattatagtactattcagcatttaggatgactactaaaagcaaaatatgatcctaaaacgttttaacgaagggaccgtgtgaatgactgggattgtagtgaagaggaaattcggtataataagatctcatattttcataaacaagaaaaaaggcaaacgtaatatccccttagctatcccaaagagaaaaaatagcacatatggtatactttgcatattgctgaccagaaaaacattcaattttccctggttagttaccatagttacatgagccctttataacatcaagagggggaactaggtcacagttttgaaggagtttgaattatgcaattatgttttctaaaagcaggggaaagggtttttaat

SEQ ID NO: 35513 - DNA, 1080 bp, Homo sapiens
agtatttggtgaataagatgaatgtcagagtgttcattatactatttcagtttttctttaagattaaaaatgtttaaataaaaagttagcagagcggaagaaacaagggcgtctttattcagaaattgttagcagctgaagacattcctgtcccttatcctttgccttttccttttttctctcagttttaaatttcattttcttgactcttggggttgtgcctcctaggatttagcagttggataacttaaaacaaagatgaggtgtgtcgagtttgtgaattatttttgtccattctctttctgtatcccacggataagttgatgtcttattttcatcctcggaaaacactaaaaaatacctaagatgtaggcgtggtactagaaaagctggtaggctggttagggacaggacatgggcataaactgaacctatgaagctatactaggactaaattaaagtcagactgtcctgagactcccttcacccctgctcagtcctagcctgtgtcactggacttttcaaaatattacatttctgatctgagcatgagtattggaaagaattcacccttttgaagattataatttagttttctgtctttttatcaccttttacaagcctaagatttccccttctcttcagataggtgaaaatggtgatcccaaagccttcttaatagagatttcctggacagaaacatatccccaaacacctccaattctatctatgaacgctttttttaacaacaccatgtgagtagtgtcttgtttttactgcttttcatttcactctctgttatacttttctctcagcaaggtatttttgttgtgcattgtagatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcagtgagtatgtgattatttttttgccggattcttttgttgttttggttttgctgttagcaataaatttgtactacttaatatatattcaaaa

SEQ ID NO: 35514 - DNA, 1111 bp, Homo sapiens
gcattctttttaaaactgtggtaaaatttacaaaacaaaatttaccattacaatcatcttaaagtgtataatttggtgacgttaattacattcacaaggttgcctaagcatcaccaccatccatctccagaactttttcagtatctggatcagaatctctatacccattaaacaataactgcttcccgcagcccctggcagccagcattctactttctgtctgtgaatctgaccactcgagatgtctcatgtaagtggaatcatacagtctttgtctttttgtgtctggcttattttgcttagcagaatgttttccaggtccacccatgttgtagcatgcatcagagcttcattcctctgtaagactgagtaatattcctagattgtgttcgtccattcatctgttggtagatactgggattcttattaatttggctattgtgaataaggctgctgtgatcattggtataaaagtatctgtttgagtccctgctttcagttatttcaattctgtagaatggctgggtcatacggtaatcctatgtttaacatttgaagaaccaccaaattgttttccatagctgtaccattttgcatccccatcagcaatgcacaccggttccagcttctccacaccttttaccaacatttgttattattatctttttgttttgatagggccaccctaataggtatgaagtggtagctcacgatggttttgatttgcatttccctggtaattaatgatgctgagcatcacttcatgtgctcctagccatttgtatatcttcttaggaggaatgtctattcaagggctttcttcatttttgattttgttgttgttgagctgtaggtttgagtcattcattttgtggttttgaaaatgacacactagtaagtctgaaaaactaagcttctccccattacagtatatgtagcatgtggcaaaaagttctgttttagaattttgagatgctgtgaagctgatgaagcacactttgaggaattaacttaggctggagtgaagtaaatcagagcgcatgggtaagtgagaatcagatagaatctcgcaccatgctggaattgggagtttctgtagcaacgattgcct

SEQ ID NO: 35515 - DNA, 1031 bp, Homo sapiens
cctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaattaccaatgtctttgagttttttgttgctgttgtttttgatgttgtgccactaattggaagttaaaatgtttttaatcagaagcttgatttggaagagtcaaagaggaagcaccagaaccctagcctagttttttgaggtggtggcagttagatcagggcagacagatcgcttatgcttcccaagtcctcgcagaagttcctgaccctgaaatgaccacaatgccaggaagatactttgtttgcatagatctcaggccttaaatatgaccatatgtgtgaatttgaaactttttccacaagataagtgtctaatgggaagaacaacctaagaggatatacaacaagccgttgatgtttactgatggcctcctctgggcgctgggattttgacagaggaatttgctgtctttttacttcata

SEQ ID NO: 35516 - DNA, 1033 bp, Homo sapiens
taaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccaccacgcctggctaattttttatatttttagtagagacggggtttcaccgtgt

SEQ ID NO: 35517 - DNA, 1031 bp, Homo sapiens
cttttattattattatttttagaaacagccttgctgtgtcacccaagctcaagtgcagtggtgcgatcatagctcactgcagcctccaattcctatgctcaagtaatcctcttgcctcagcctcctgagtagctgggactacaggtgtgtgccaccatgccaggctacttgtttttactttgttatagagatggggtctctctgtgttgcccagactggtcttgaacacatgatctcaaccattcctcccaccttggcctcccaaagtgctgggattacaggcgcgagccactgtgtctggcctatttcactttagaagtaaattgaatgccacatgcgaagtttgttaaatttttttaaaaaaggaaagaaaacacaaaagtaaactacctagtcgcatcagaaatgccatagtcatttttgccattttttcattcattagaattcagtgcattatgttattttgttatctctgcagtaactttctatcatgttatttattttctttgtcttatttaaagcttctgagattatggatttttgtttccttccctgaagttaagtgttatcattcctatatagtactaagctgtctacagaatagtgggagtctgccctcttgagttgggaagatcctagtttgaatcttggctgtgcgactttaaagttcattaacttctcttagcctcagtcacctgaactctgcagtggggatccttatgcctcagagtgtcattgggaggactcacgaaaatacgcttgtactttgagttcagtacctagcctgtatgagccagcattaagagggacagtcatcacgcagcgctttgcacacagctctcacgccacatcctttggctactgttttggtaaatctttactagtaaatgtttcttaaaagcatttacattcatggacatgattcagaaactaacagttgttttttaggtctcactttgagatttaaaaacccttagggcagagaccagattttatttcttacctcagagtttccctgtaggacaggaacc

SEQ ID NO: 35518 - DNA, 1050 bp, Homo sapiens
cacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatatgactggattgtatattacataatagtattgtatcaattattttaccatagaatgtcttcagtatagacatttagttgatccgcccaatacattatttatgtaaagaatgtccttattcagtgcagtggcacgtgcctgtaatcccagctactggggaggctgagacgggaggactgcttgaggccaggagtttgagaccagcccgggcaacatgatacccccctgtcattaaaaaagctacagaatgtcttattctttccgctacgtgcttaaatattagatgaagggttttgatgtctgcagtttaagagagtcatcaaaaataatgcgtatgtatacagtagagggagaaaaccaatgtggccaagtgttaacaaatggcagatctcaatagagg

SEQ ID NO: 35519 - DNA, 1043 bp, Homo sapiens
tgaggtcagaagttcaagaccagcctgggcaatatggcgaaaacccatttctactaataaagtacaaaaattagctggatggagtggtgcatgcctttaatcccagctactcaggaggctgaggcaggagaattgcttgagcccaggaggtagaggttgcagtgagctgagattgcgccattgcactccagcctgggtgacagagcaagactccgtcttaaaaaaaaaaaaacaaaaaaaaagctagaaggtatggaaaagaagataaaatcatctgtaattccataacccaaaataaccaccatgttttttggtctatgctgttcagtcctttcagtgagctttaattaccctaagtgagatcatatacttattattaagtattcaacaatgcataacattccattcatggatatgccatagttaatctcttactaatcaagaattgctatttaaaaaattataagtgctttgatgaattttgttgtagctaaatatttgtgcattccttagatcatttccttagaaaaaaactgctgataagaattctgggtcttaggcgggcacggtggctcatgcctgtaatcctaccactttgggaggccaaggcaggcagatcacgtgaggtcaggagttcgagaccagcctggccaacatggcaaaaccccatctctactgaaaatacaaaaattagctggatgtggtggcgcgtgcctgtaatcgcagctactcagaaggttgtagcaggagaatcaccttgaacccgggaggtggaggttggagtcagctgagaccgtgccactgtactgggcaacagagtgagactctgtctcaaaaaacaaagaattctgggtcttattggtgctaaaattcttgacatataatatcttttggtcaagttcttaatatgtgattaattcatttgggcttaattgaataaataatttatgctaatgtttgaaaactttttgaagtataataagttgtccctgccaccctgtcttcttcacctttccacctgctaaacatacacacaggtaacc

SEQ ID NO: 35520 - DNA, 1028 bp, Homo sapiens
cgcatataattctagcactctgggaggccgaggtgggcagatcgcttgaggcaaggagtttgagaccagattgcacaatctggcaaaaccccagctctaccaaaaatgcagaaattaactgggcatggtgggcatggtggcacacacccgtggtcccagatacttggaaagctgaggtgggaggagcatctgaacccgggaggcggaggttacagggagccgagattctaccactggactccagcctgggcaacagaaccagactccacctcaaaaaaagaaaagagaagaaaaaagagagagagagagagagagagaaggagaccattaaaggaaaatactgaaagctccattatttatttgcctagatcagttaaatcactacagtagaacaggaaatggtatccaagtgtttcttctgtgaagtattcagtcactagtgaaatctcttttactttattgtgtcctggaaagctaaaataaattgtacatcacttattttaaaggatcagtatatctcgaataggccaaattgctaatctgctacttaaatgtatgaaacattgattgttacaaatcatatagtttgatattataagaaaataaatatgggaactgttgaaaatcttcacatttaaaactattatagcatattttcttcataagatttagttcataataattgctgatatttactgagcttttactaaacactaggcattgttctgagtatcttccaaatattaacttattgaatcctgacaacaattctctgaagtagataactatttttatccacatctcacgatgaaaaaactgagggttagacaggttaaatatttagcacagagctactgagtatgctgctgagccaagattttaaacctgggtagtctcttaaactagaattagacccttaatgaacacgtaaactcagagctaaaataatttagaaagctattaaaattattaagaccattttcaaaattaaccctccttatgtgtcattaccagtgttttcctgtgta

SEQ ID NO: 35521 - DNA, 1067 bp, Homo sapiens
aaaacaaaaatcctttttcctttagctgggtctgcagctggggctgtaaggcagattaacaggagaaaaggcatacgtattttatgttaatttttacaatgacacagggctttcctagaaaagaagtggataggccagaaagtttctatacggtgtttaaaagatgataaactgtggagatacgacatgaagagatcataaaaccaggtggagggttagacctctagggattgaaactatgggacggtaaatacaggcataccttggagatattttggttgcttgcagaccaccacaataaattaaatcttggaataaagcgagtcacatgaattttttggtttcccagtgcatataaaagttatgtttacactataccgtggtctgttaagggtacaatggtattatgcttaagaaatgtacatacgttatctaaaaaataatttatggctaaaaaatgctgtcaatcatctgagccttcagggagttgtaatttttttttgctggtggagggtcttgcctcactgttgatggcggctgactgatcagggtgctgagtgctgaaggttgggatggctgtggcaatttcttaaaataagacaatgattaactttgctttattgattgacttcttttcacaaaagatttctgtagcttgtgatgctgcttgacagcattttatccagagtagaacttttttttttttttttttgaggcggagtcttgctctgtcgcctgggctggagtgcagtggtgtgatctgggctcactgcaacctccgcttcctgggttcaagagattctcctgcctcagcctcccaagtagctgggattacagacatgggccaccacgcccagctaatttttttttatttgtagtagagatgaggtttcaccatgttggtcagactggtcttcaacttctgacctgaagtgatccacccacctcggcctcccaaagtgttgggattacaggcgtgagccacagcaccgagcctcacagtagaacttctttaaaacatagtcagtcttctcaaaccctgccgctgctttattagctaagtatac

SEQ ID NO: 35522 - DNA, 1054 bp, Homo sapiens
ccagtctttagcctggatgtattttaacagactatgttgtaataaataattatttaaaaattagttctcttactctaacaatttatattcatttttctctgttcccttccagtttctacccagatacagacgtaaacgaaaataaatcttacttggttttagttcagttttcaccatctttgatgttagtgaattaaaccataagtgtttggaaacttttataacctatatataattttccatgtttaataacatctttatttattgactaggaatctaaatcaccaacattttttctttttctgttgattctgatttattttaggagttacatgatcttttcaatctgcctcacgacagaccctatttcaaaaggtctaatgcttatcactttccagatgagccatacaaagatggttacattagaaatccacatacttaccttaatccacctaacatggagactggtatggtgagtttaactaattatttatgggagtcactggatcagtaatgttattagttgttttttgttggtacccagtaggagacttgattcattatgtattcattcctaaaacatgatttatcacccatctctgttaacagacattgcttaagatagcagtaattaaaaatggtctagaaaagttagtaataggtagatataccacatttatcttactaaaattctcttatttctttaaaggcttgtcccattttttttcattctgaacctgagaaatcatgctaattaagggcatagtctacccaaaccacactgtaggataaatctttttttgtttttttgagacagagtctcgctctgtcactcaggctgtagtgcaatggtgtgatctcagctcactgcaacctccgcctcctgggttcaagcaattctcctgcctcagtctcctgagcagctggggttacaggcacctgccaccacacctggctaatttttgtatttttagtagagacagggtttcaccatgttggccagtagctagggttacaggcacctgccaccacacctggctagtttttgtatttt

SEQ ID NO: 35523 - DNA, 1048 bp, Homo sapiens
gaaacttttgttctactaacagttctgggtctgagaatgtttctaaatggaaaacggctatgaaatgcctcccaaaggctaagatataataatccccagttgtcttcacccagcttctattaactgttcctactgggaaatcattgtgatagctacagtgaggtgatcatagaaataaagtgagtacaataaacattttagtaatgagacagaagatccaggacacaagacaacttattattttagcaatttttatttattcagatgaacttgtatcttccttagaaccgcaattagatagctagaataagcaaataaagaaaaagcaaatgaattactgatccctaaataaagcattagaaataatctagtttcttcctggagcagtttgagatttgatagtagtatgtattgttctgctctaatagaaactcacaaacatagcaatgacaagttgacattaaaagccataatctttgggtatatagggactagttcttttttatataagctctgacaaatgctttttaattgattcttcaattattctaaatactggggtatacactgtgaagtattaaaaatatacatcatattgtacatatcctcaagagcatccagtctagttgggaagacagacaatacacgagtaaataaacaaacataaaagtacaaataactttcattaaggaaataggatgtaatggtgaaaaatgatgaggggaggactagagaagctacttcagatgtttggcgaagtctttctgagagtgcagcatttgaacctagacctaaaggttgagaaggagtgaagagtaagggaagcatttcaggcagaaataagagtgcatgagaacccccagaaagggcacaagcttggcctacatgaggaactaaaaggaaatcagaatggccacagcaccatggatgagggagagcaggaataatgtaagatgatatgagagaagtaggcaaggtaagacccatgtgaggtctagacagaggtgtatagttgggatttgcccagaaaaattgggagtaggtatac

SEQ ID NO: 35524 - DNA, 1028 bp, Homo sapiens
actggcagagaatccataggtttgctaaggatacagagccacattgaaaaggtaaactgtgaaaatcccattcatctgtcaataatctgggagggagaaaatgataagaggggccagtgagccatgataaagtggggcacaggtgaccatgtgaggccagtacaagtggctgtggggaagaatccactctgaggaaagggagagagcagtcataggtggggagcagataatcttgcacgagggagagggagacagagggggtagctgcctaattctcaagggccttttgatccttttttatctttaagataaaccttgctatgctggagattacttaggtgggccaggatttcttgaaaccaaaactttactgaatcacctcttcaccatctgtatgccgtgcatttgctgagtaagttttgacttttaaaacaaaatactaaatattactgcatcttttgcaataataaaatttacttttacttctcaaagtattcccaagatggaataatagttcatgaactctacaaccataacatgctgaaaaatcacagatttagttcattctatgccaaaatatatgggtaaacatggaaaaactcagctgatgtgtaaggatttttctactcagtatcgaacatctagctatttgagcacatgttggctgattgtcacccgcttcgtccttccatgctaagagtgggtggcaggagaacaagctggacggtctaagcccacactcacaggaaattgacccatgacctcgtgagtccagttgcaccttgtttcaattgtatgatggttataaaaaatgttagaaactggggcaggcacggtggctcacgcctgtaatctcaacactttgggaggcctaggtgggcagatcacgagatcaggagttcaagaccatcctggccaacatggtgaaaccctgtctctactaaaaatacaaaaattagccggacgtagtggtggacacctgtagtcccagctactcaggaggctgaggcaggagaatcgcttgaacc

SEQ ID NO: 35525 - DNA, 1023 bp, Homo sapiens
gtagtatagtctggtctctgacagtcatattttggggtggtataatctggtctctgacagtcgcattttggggtgatatagtctgatctctgagtcgtattttggggtggtatagtgtggtctcagacagtcatattttggggtggtatagtctggtctcagacagtcatattttaggatggcatattcagaggcctgtcagtttcctgtttccaagatgctgccatcagcggatccaatcttcactgcctgtggcagagtggaaactagcctgggcgtgagggcatgcaggcagggcagcacagaagtgaggggagggaagatccgggcggaatgcaccctccccccgccccactgcgtcctgcaccatcctcacagcacttctaaaatgaacgctttccctgccttcttcttcatcctaaatgacatactgagcactgcttcgtctttataaaacagatctttctttaagtcttgttcgtgctgcagatacaaagcaacttttatgcgtgacctaccctagtggccgcctacgcacagccctgtgcgactctggagatggcgtgcacgccccccgtgtctgctctggacccctggctcacgccactcggctcagaccccatgctctgctcagtccatccagcctaagccaattctgtggcagccagccatgaaaacggaaccctctgcagcctgtgtcttgcaggaaggctgtttactctttctgcaaaaatccacacaagtggcacattggctttctttgtggtcagacccttcattgccaaaatcttcagcatttttctggcttcccttgtattctttatttcacttgaaaagggggtgggagtggtgagacattaatacaacactgtagcctttttcttagagtttcaaattgctaaaaaaggaaagaactcctgatttcttcctttcacttaaaacctgtgagccagtccctgtgtgtgtgtgtgtgtgtgtgtgagccagtccctgtgtgtgtgtgtgtgtgtgtgtgtgtgtgag

SEQ ID NO: 35526 - DNA, 1086 bp, Homo sapiens
ggattttaaagcagcagttatgtataaaattttatttaactttattagacattgggcttgttattattgtgtcactgagcagctcttttgaattgatctctgttaattcattaatttgtcgaacgagctcagttaaaaatgacaaaggatcaagttgctgtagactgtttgatgcggtgctgactgtgttctagatggacacttcagttgtgcaagtaaataatgaaaccagatagcttttctattatagatactgcaaaacaatattcttcagtaattcattttagaatttcactgccctaatagtactgaaagtctgagagagaaaaaatgcatcacaaaactatggtttcataaactttggcagcagtttaccccaaattgttatttgagactactgtgaggtatgtcgtatcaagtgttttgctacagatgataaccatgttttcttgtattttaaaagtctgtagcaaagtgtcacatactagaataaattgctgatttgcaactatatacgtaagacaaaaagttatctggatatatttgctaatgattcttttcattaagcatatttggaaaacaccaaattatgtttgtcattgttggtgtatgtgtgtgtgtgtaaattgtctccaaaacgttacccaagtcatttatgtgtaaaagttctgagttcttatcaaaatcacatttaaatagtaaagataacatttaggccagtgttccaaatttcagataaccgaaacttaaaaaatcaaccatgctcaactgagcgctttttgcagtttattttacactcttttcttgatgcttggtatgaattactatgttgctaagtgtacacagtatgattcctttgttctttatggaattttatgtctttatttctgtattgtactatatttgaattgtatgtcagcaaacatagtgaatagaaaactgtgccctttaaaaaattgccatgagtagctcacctgaaaatcaagtatgtaactttcaaatattgaaatgattttccactaccatcagatagttagaatattgccaatgaaacagctactcataaagatcaaagtaaaataccca

SEQ ID NO: 35527 - DNA, 1004 bp, Homo sapiens
gttcaagccatttgaggatttctggaatggatggtaatttgaaacagtgataaggatagctgattcaaatataagttttggtatgcttattaaaagttttgatgatcttcagacctctcatttcagctaaattaattttgttggctttaaggatgaaatgttgggaagaagagaatggaagaaatgacaatgtgaaggcatctaggctttgaaccatcactttcctttggaaagcttggtataattgtggtgatttatgccaccttcctctcctcaagggactgtgttgacatttgacttcccagggaataaattaaaaatggctaacaatctgcatggcggggacagtggacagccacagccgacgcaggctgcagacaaccactggtatctgtggtgccaacagaatattcgctctactcttgtccacaatttgataatagaagtgaagctaccatatcatatcttctgagtaaatttgatagcataagggacgattcccgcaatggaacgctaggattagatccttgctgtgctccttctgatttcagaaatcagtgaagctaaataccaaacttcattttccacatttgttgaattgcaggtaatacccaaccgcttagcctcataagagtgttgcaatgactgtagtgaagtggcgcatatgagaatactttgaaaaggataaaacacgtaatactgtgttggcttgtttgttttctgggtacacctaacaagggcgtgctctgtttgctggaaatcattgcactatagacctatgattcgtgcatttttctatatgtacattatacttaaataaaacttattttacaaaatatcaggcaagaatacaatactatcttgcctattcaaaattcaattatctggcaatctaactgaggtagagtacagccaataaatggaaattagcaaaaatgacaggctctcacctacagcggatttgttctaacttagagtgccacaaaactgtgatactggtgtct

SEQ ID NO: 35528 - DNA, 1044 bp, Homo sapiens
taatatgcaactacaggtaattgtgtgcttgagttaacttgctttttcctccgagcaatgcattgaactggtttgttctggtgggaacctgtggacactttgttcttaggatgctggatgttcagacctctgagtgatgattagatgcttggttctctgaagaaactagttttttatttggaggcacttttgggagaaggggcggggaacgaaacgtgcacttaacatgtctgccaagatcaatattttcgttttaaccaggtggttaagaaaagctctaattttgcttagctccttttggggaggctcacccctgccctgcctcccccacccgcccccagtagtgcttttacggtttgtagtttgagaattagttagttaagcacttagtaatatgaattgagtttgagtcagtaaattgaataagctcacttcgtaggtgattgatataaactggaggaattctgccttcgagaagaggctctttccttcctagcaataaaaacgactttctctggaccaaacaggttgtgagcactgggttaattgaatcctagtgcagccttgtgctgtggcgccgtggtcaactcgccttacagaggagaaactggggctgcagattgttcccagggactgtaggtgtgagcccggttgaattcccagagctggcctccagagctcgccctgcttccttgctgtcaacacctgcagcatttgggaagtttgaatcctgcagaacctttaaaaagtgttcacggctgggcgcgatggctcaagcctgtaatcccagcactttgggaggccgaggtgggtggatcgcctgaggtcaggagttcgagaccagctggccaacatggtgaaaccccgtctctactaaaaatacaaaaaattagctggatgtggtggcccacagctgtaatcccaactacttggaagcctgaggcaggagaatcgcttgaacccgggaggcggaagttgcagtgaacagagattgtgccattgcactctagcctgggcaacaagagtgaaactccatctcaaaaa

SEQ ID NO: 35529 - DNA, 1050 bp, Homo sapiens
tgagccccggagtttgagcctagcccgggcaagatggcaaagccctatctctgcaaaaaaatacacaaattagctggggatggtgatgcatatgtgtaccctcaggtacttgggaggctgaggcaggaggatcacttgagcccaggaggttgaggctgcagtgagctgtgattacacgaccacacttcagcctgagtgacagagcaagaccctgtctcaaaaatagaaaagaaaagaaaaaaaaaaagtagaccgggcacagtggcgtacgcctgtaatcctagcactttgggaggcagaggtgggcggatcgcctgaggtcaggagttcaagaccagcctggccaacatggtgaaaccccatctctactaaaaatacgaaaattagccaggcatggtggtgggcgcctgtaatctcagctactcaggaggctgaggcaggagaatcgcttgaacccaggaggcggaggttgctgtgagctgagatcgcaccactgcattccagcctgggtgatgagaaactccgtctcaataaaaaagaaaagaaaagtaaaaataaattaatagatttactatcaatatttagagatagagaaactatataaagatagcaacaagagacagtatgaccttcacaccttcgaagtttatgattaaaagcaggtacttacagctacttgcgaggctgaggcaggagaatcgcttgagcctgggagtccgaggctgcagtgagctgtgatcccaccactgcactccagcctaggcgatagagtgagaccctgtctctaaaaaaataaaaaaattaaaagtacttaaacagtagggtagtgagattttagtaagttagcaaatatttacgattatagagttttataataagtttttaaaatgttaatcctgtctctagcaaaagctggattttatagactgcaaattctcatcctataacattgtcggaagtactggggtgaggaatgcacacctgcacgcacaagaaagtaagaacattttggccgggcgcggtggctcacgcctgtaatcccagcacttt

SEQ ID NO: 35530 - DNA, 1043 bp, Homo sapiens
acaatgtgtgagtgattaagcagccggaagagtggcgaaccacagactgtagtcttggaatgtcgagtcttgcctgtaagatgttaaaataagaatcgttttggcctggcatgatgcataattgtaattgtgaaaaaatttaaagctaaaagtttttttgtttaaattccaataaaatatgtttacgttattcctttgattaataataacaaatatatagctcgattaaaaaagtctctgagacacacagctaacagtgaggagaccacgcatcattatgtggttgtattaaagcactcatcggttggaatctgaggtagaaatggtataatacaaaactttatttcatgcactgttttctaactaactgaagatgttcctaattgactgcttttgtacctttttgcaagcttccatagtgaccgtaatgcaccttgtcaatgctgtggttgacacggtgagcacagaaggtacagttgtaagtgctcgtgcttgtgtctgtgtcttgcagcagccgtgtcgtagagctcggccgcattgctattgcaatggtaggaaaaaacagtttgtggttttgagggggttgagtccttttattttatgcaggtgtgtatatacgtaatatgagtgctttgcaaaaaatatctcaatgtatgttatgtctttgttcctttttaccattcatagtgatttacatgagatctggagagcttatctgtaggtggtgcaatcaagaaaaagttcagaagtaattttacctaaaatttttttgaaacaaaaattcttcttcgtatgtacaggaataagacttgaataatgtaaagctttcataattaacctgtaactgactcttcacttttggtttttccctgagtatgatcaaagaaaagggtgtagagcatggtaaaagaatattttcatatttggtttagtgaaaattatttaatgtgaagctttatctgctcagagttgtaagaaaggacattgagcaccttccccaaattattttaaattaaaatagccctttattagtgcactgaaat

SEQ ID NO: 35531 - DNA, 1108 bp, Homo sapiens
tcccctcttctatttgaacagcttacatttcatacaaaaacaaactttcatagaattgctgtctttgttttttgccataccttccatttttatcccgctgtgtttgaaggagctcattgttgattctgtcatagtcattgacagagctgggtttcagtgtgaattagtgaagtgctataaagaaatttgtccttttctttgatacgtttcttgtgtggagaaatgagtatctaccagttagtaattttttgggaacttgagtaatacaaatgtttttattgaagaagttataaacagtgccatagacaaaggtgattttatttttcttttcttgtaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgc

SEQ ID NO: 35532 - DNA, 1047 bp, Homo sapiens
caaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagat

SEQ ID NO: 35533 - DNA, 1049 bp, Homo sapiens
cgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgc

SEQ ID NO: 35534 - DNA, 1044 bp, Homo sapiens
gtttgtgacctgctggccccattaggcaatgccggataacgtttgagaatcagggtgcttattgtttatgttgaatgtggtcatgaaatcattgttcttctgtcaggcattccatacacagaatacaaatgtgaaatgtttgaaattggctcagtttaagaccaaaccagtctgtgcttcattcatttctgggttgtaactcctgatttgctgtttttaatcccctctgcccaaatgttgtagattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtaagcattccccctcattttcgttgtccgtatgggttacactgaggagaacctgcatacggtttgatgagttttgggcacaagtcaggatttaaaattgggaataagatcgacaggtggagaatttgctttcaactataatattttgattgcaaaatttttcacaatatatagcatatgttaaacttgcttaaaataggtgctctattctaccaagttattgatataaaaataaaattttgtaaaagtttgtcaaagagttacagacaaaagccttgaatgttttggtccagaagcacagcttcttactgtttatttattgatgcataacctatggcacattgttatttttattgatgcataacctatggcacattgttatttttagtgaatatgattggaacatttaaagtaactatgcctgtgtgactgtcacatgtcaatatttaatagggaataagcttacaaattttgattcataccagcttatggtacaaagttatggtaccagctatgggtttttagttttatattacctcattttcaacaggtaggaggattcattagattatttcatcctccagtaaagt

SEQ ID NO: 35535 - DNA, 1062 bp, Homo sapiens
atatatatatatatatatatatatatatatgtaatgaagtatctattaaagcataataccttggctaacaaactgtcaaaattgagtggcttgaaatagctgtcataatttagtttagggttctgctgggcagttcttccgcccttgaaataactcataatttagggttctgccgggtgcttcttccactcttgtgcaggcttggctggtggccagctggtcctcggtggcctcactcacatgtcaggcaatggtggagcagcacgaatgactagaccacgtgtcttctcttccaaccaagtccacacttttctggaacacagagttgctggcaagagccttcctcctgcttcctgttttctgtgtgtagctcctgcactgtgttttctgtcagtgccctacaatctatcctgtcttactgtttctcacatgtaaagtagtctttgccaacttctagccttcatcctggtttcttgcaaacaagactgtcttatctccactttctgagtggacagtacaacacagttgactgaatgcattcatcgctccagctgtgtggaccatgtcacatgactgtcttcacctactagtcctttgatgttcacttttacgtctatctgcttcgcgaagtctactttatctcttgaattttgagaagtttggagatggttttgttactgatttataagaaatgtcaaagagcacaattttatattgaaacatagctgatctgacattctctctgttctaaatgaactcatctctaaatgtctaagtggcgttgaaaggccatgagtggtttttaatgatgttcctcaagtgccataaactttgttactgcattgtgcatacatttctggggtgaactggtaactgctcattggtgagaatatactgtgtctgctgtctcagcccacctacatttatcatagttttattatatagaatgcagtgtttttctggaccaaggaaagaaaaatttctagtttttcttcctttctatttttaattatcagtgcttggcagaagaggaagatgaaacacaaagttacaaaaagaaaa

SEQ ID NO: 35536 - DNA, 1052 bp, Homo sapiens
atgtgtggactctggagccagtcagccaggtttggggttctggcttctctgctaccaaagttggataactgaggatgacttccttaacttttcaggctaagttgttagatgtaaagctctaagatgactaactggtaaggtaatccattaattcattggttactttattacggagtaaataacttcagaccagtgacttttgagccttaagcctctgcttctgaatatggaaaatggggagagaccactgggctaattgtgaagattaaacaatatggcatattaaagcttttactaagtctgcatccagtccgtataaggggagaagagtaatcaacactgaaattgcgtatcttctgaaatttgaaacaaacttccagaagcattgccattggtaggtaaaatatattctctgtatcttaatgcttctgaaggctgtcttgtggatgtagttttatccaattaacaggtgtccagatgataagttttgatacccaagggtgatcctctttaacagtagagcttatccacaaaagccgtcattgacaatatcagtgattctgacagggaagtcagaacttggaatcattcctcaacaaagcgggacaacatggtttagcagagcttaccctgggaatgactctttgcagagctaaagaaatccctgggcttgaaacatgatgcttaaaatctgattatgtacttaattaatactacgttttagtaagtttgcaagtcagaaagcttcctcagctaattttgaagttattgcagcaattttaattaaaagaattgataggtatatgttttaattaaaatgatttaaataggcaatctaaataatgcaaacagtgacagttgtgtttttgcttttccttttgtcattgacttatgatctcattctgggcaatgtgattatagaatttcctagacctaaagctttgtgtaagtagttacctacataaatacttcagtgttagttatcgaagctgccagaatatccattgtcatatatctactcaaatgaaacagaaatacttaaaaatgaaagt

SEQ ID NO: 35537 - DNA, 1077 bp, Homo sapiens
acctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttg

SEQ ID NO: 35538 - DNA, 1190 bp, Homo sapiens
cgtgaccagcctctttatatgtatttttatttctagtttgtaaatcccttgggattgggatctttgtcttttattccttaacaccatgcaaggttctgtctgataaggtcctccatacctgtaggttgaactttttatttgttttgataaaattacaagattattttataatattcaaatttccctgagtattagaactgttgactaaatggagatacttaaagagatagttttgggagaaaattgttttcttattttgtttaaatgataattgttctcctagaagccaaaaatctgtctaatttctgactttatctggagaggagaaggcatcatagctaaagaacaagttagggtggccaacttgaacgtggttcaatatcaattaagctttaattgctttaagcacatcaggtctttttttccccctaaggcaatgacttatggggcagagttggcagtagctaagttaagatactataaattaatgttgtcgtaccaatttcaactgggctgtcaaacccaccctccagtttgctcttcatttacctctggtagcattcacattttgtgaatattaatttgagagtcactttgcaagatgacagtgctgtcctttgtgaagctgtgttgatttacaagatgaatttgttggcaaaggggaacagttgatctgaaaataactgtcctgcttccctggccagacctcagcccagtggacttcgcccaccttcccatttgtcattgttaaaggcaacgttttcttcatttcttcagtttctctcttttctccgccagtcacccagggactgtcctgcagagtctgccaccatgtattaatagactgatttgacccttgacgtgtgttagcttagaagatttagcttttgtgtgtgtgtgtcatcttctcatggaggggcccagggtgacaggttgttcgatgccctgaagataggagacattctgtgaacaactggttgttgacagcagtggtgataaaacattgatatagttggtaaagtttgcttcactgacttagagaggaaaaatgctgtttgacatcaggctgctgaattctggtttttcttttgtaaattgcctttctttggggcttatgttgctgataagtattatacttgatataattattttaatacttttaagtagttacatagagcgaaatgagacaa

SEQ ID NO: 35539 - DNA, 1080 bp, Homo sapiens
ttgagctgtaacagtcaccgcaaaggtctgcagcttcactcctgaagtcagccagaccatgaacccaccagcaggaagaaactctggacccatctgaacatctgaaggaacaaactccggacacaccatcttcaggaactgtaacactcaccgcgagggtccaccgccagggtccacgggtccgcagcttcattcttgaagtcagcgagaccaagaacccaccaattccgggcacagtgcaacttccgcctcctgggttcaagcgattctcctgcctcagcctcccaagttgctgggattacaggcatgcaccaccacgcctagctaattttgttgtatttttagtagagacggggtttcaccatgttggccagggtgttcccaaactcctgacctcaggtgatccacccgcctcagcctcccaaagtgctgggattacaggcatgagccatggcacctggctgcagatttctttgtctcttggcagcgcattgttttttttctgtcttttcacatgccttgtaattttttgttggaaagtcagacatcttgttcaggacagtagagacaaagctagatagtttttgtgtgtggaagtgggtgatctgcgaggcctttagtgtgggcatttgtgttcatctagtgaggagttgggaagggtttgagatttgtagttcctataattatcctccatgatccacagtcttcagattcctctagcaatcctgtgtatttgatgtggggacagttccccaaagtgtttctcaaagtctgctccactctcagctttgggccttccctctgtgctgtgcggtggagagcgccggtctcttatagctcgctcctcagtgcccgcggcaccttgctcccagcagtgttgcaccttgctccccgcagtgctccgtggcaccttgctgctcacgctggaagcttgttagtgcagggaaccgtgctggacacatcctctgctgttctgacccagcctcggtctccacctccgtccttggttcacagaggcgtgaccttcatgagtgtttctcctcctcagctctagttgatcccggagcaatgcattttcta

SEQ ID NO: 35540 - DNA, 1080 bp, Homo sapiens; identical to SEQ ID NO: 35539

SEQ ID NO: 35541 - DNA, 1060 bp, Homo sapiens
gctcacgctgggagctgtagactggagctgttcctattcccttaccagcttccattccagcccacaaggacaaaggcatcacatacatatccactgtggctaacctgtcctcagcagggagtttccccagtactactctcccctctgttctgagcctacttgctcctttgtaatgtttctgctttctgtcccactccctaatagatgatttgtcctctctgcccagccccctagttctgatatttggattgtctgtgatctgggtagtacttagaaggtagaaccaaagccttgttgattggattgggagtttctaacttctattaaaggcactgattaagcatctattatataaagtaaagtaagattatgatccagtaagacagattccacaagtagcgcaggaagaattggtttctagtacacttcatgcttcaggacaggaaatccagaaaaaaattctgtggtacattaagtgtgaactgtaagtttcatttccatgtgaaaaactgtagttagctaaaaagtacatccatgaagaatcctgattaaacttgtttaatcctggttaaactagctaaacaataatttcacaactcaagaactctgtaaaagcatttcctctgaatattttattcagaaaaaaacacagaaagataaggcagaaacaaaaatcccagtcacttgcagtatctgtcggctttcaatttggctctcctgtttaaacaaagaaaaataaaattaatctatgtaaaacatgccatatatattcaactgctactaaatataaaaagctttaaaactgtgtgttcaattttggttattaccacaacacttttattaaaatatgtatacttttaaatttggtttctataaaaaatggattctaatcttataaaagttatttcctaatattcaataaatgttgcctaagggctttttcaatccaaatagcaattttaattattccggaatttaaggctgctctaaatttccatttaacagggtgagaatgctgtattattacaagtgataaaagttacaggacatagagcttatt

SEQ ID NO: 35542 - DNA, 1060 bp, Homo sapiens; identical to SEQ ID NO: 35541

SEQ ID NO: 35543 - DNA, 1030 bp, Homo sapiens
aattaaaatgcttagtgaatgggattaatgcagattggacacaacaaagaaaggatacatgaatttgaagacttgccaaagaaagtcatccaaatggaagcacagagagaaaggagaatgaggaaacaatgaacaaaacctcagtaactggtgtcattatcaagcagtcgaaatgtgtatagttgcattcacagaaggggaggaaagtgagaaaagggcaggacaaataaagaagtattgttagatttttttcaatttgtttaaaaccggaaacacctgaatccaggaagctcgtcatcacctgacagaggaaggaggcaaactgcatgcatcagggaacagtaagaatgaccgatgacttcctcagaagcactgggcttcagaagacaatggaaaaacatcttttaagtgttgaaagaaaaaaattctatatccagcaaaaataaatgtctacatccagcaaaaatatctttcaaacatgaaggcaaaataatgacacttttaggttaataaaagagtagaccagcagaggtgaataaaagaaatgccaaagggtggtctttaggttgaagggaaatgatactagataggtgaagggtacaagaaaggctaaatacgtgagtaaatatgaatgtctttaaaagattattaactacttagatcagtgtatcatggggtttttaatcaatgtaaaagtaaaatatatgacaacaaaagcacaaaatgttggggaaagtaaatgaaattatactactgaaaggttattacattgtttcgaattttaaaatattaattgaagttaggctgtagtgagttaaagatgcatattgtaatcttgagagcaaaaataacacaaagagatacaactaaatattcaagagataaaatggaatccaaaaaatagaggatgaaaggaagaacaaaagaacaaagaatagattgaacaaatagaaattatataacaagatgatagatttgattcaaccatatcaataattattttaaatgtaaaccaaacactccatgtaaa

SEQ ID NO: 35544 - DNA, 1034 bp, Homo sapiens
tatgttgttgaagcggcactgttttctggggtaaatacccggggttcatcatctcacaccaagaagattaaggacatggacgcacatgaggagtgagtttaggagtggaggtttaataggcaaaagaaagagaaaggagaagaactcttactctcaagacagagaggggtgcccaaaagggaaatctggcctgcggcagagagcaccagattttataggcaggcttgaggaggtggtattccatttacatggggcccacagattggttggaccaggtgtgacatttacatagtgtgcgggtcggggaagctggccaccccaccctaatcttatgcaaatgttctttccacttggccagcgccatcttgcctgctccttactatacatgtggctggcaaaagaagggaagacggagctgccattttgaacatgcctagtcccaggtagccttttcttattggcgcaactgccagcattcacctgtatgagcttccagcttgcttgtctatgtctgcagctcgattttaaaggctgctctttgttagaaaagaaaatgatttgggggctgattttcattaaaaggaaacgttactacagactttctttccctcactatctgcctaatttcttcttaactcctatatcattgtttctgcttattgttggtttttattattattattattattattattattattattattataggctgcctctgtgccaaggcccagcctgaggtgtaaccgtaaggtcatttcagttccttctgagcctggtcctttctttgagcatacatggtcattttctaattttccttgtatacatttttttaaaatgtcctagtgtttaatgtctggctcacaaaaggggaaaagacaaaaaaatgaaaggggtggcaaaagggcatcacctctttaaatcccctggaagtcacttcagtggcagtggtaggtggcggccgaacagtgagaaaggtgcaacaatattgaacttgcacctctttgtctgcacctctgtggtcaccagccaca

SEQ ID NO: 35545 - DNA, 1049 bp, Homo sapiens
gccgacatggtgggttggatgggcatgactgcagtggcaaagcctggtcggcctttcagacggctctgatcccattcccgaacctgggctgcacttctggagcggaagccagcctgacgtgctttctgtccctttccagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggct

SEQ ID NO: 35546 - DNA, 1047 bp, Homo sapiens
gagatcacctaaagaggaggaatcagaatttaggttggggaagaaaagggcaagggtttcatttgtccctgtgcttctgtcttctgggactctctgaggggtaagacagtggtgggcacacacagccaaaggaagctggggtacaggggagtgcgactctgagtgtggagtttattacttggcaggaagcacttctagtctttaacacatgcccgtaaatgccattgggaagatttgttaataaaattatctggaaagatttgttgagtaccttttctgtgccagataggttaggttataagcatattacaggtagcctttcactcactgctccagtcagcccttcctggagttccctgtgtctccaccacgcagatgaggagactgaggctaaggatggaatcactgggcgagtcggggaggggttgtgatctggaatctgtcgggtctcgctgctcctctgctgaggtcagccctcactgggagtcactgtgtgagtagttggctttctctgaatccccccagcgggtggatttgggcctggaagacaaagttggcgctcctgtttgtggcttgtaaggagtggttggtgtttccagggaggaatcaatgctgctctggggaacatggaggaggacaactggaggtggcatttctacgacaccgtgaagggctccgactggctgggggaccaggatgccatccactacatgacggagcaggcccccgccgccgtggtcgaggtgatgggcgggaggctctgggtgttctcgtggtctgtttctagtacaaaagaatcctggaaaaaaatgtaagcaattgaggcggatgtggcagccaaaagaatggtgatgagcaaagttcacaagaagagtctttttccgttatgaactatgcattatatgtaacaagaaaacttctctttgatgaagtgttgacattttcataaaataggttactttgggtttgcagatttgtgttaaacttgtttagtgtagattagctgcgaatatcttgactcctttaaggtgttaaggtttttgtttg

SEQ ID NO: 35547 - DNA, 1024 bp, Homo sapiens
ttctggcaaaatctctcttgttttagtgggtactgtattgatactgattcctcgggtgggtaagtccttcttctccacatgatgaaaataagtaactttaattttatacactgtcagttactttaaccattttaaaagttaaaaagtgtcagtacagccaaacaaaaaatcagcaaaactacaggttgggaagaaatattttccaaaccatatgtgtaataatatcttactatctaaaatagcaaaaaaaaaaccctactaaaaacaacctactaaaccctactaaaaaacaaccctactaaaaatgggcaaaggacttgaatagatatttttctagagaagacatacaaatggccaattgatgtatgaaaaaatgctcaacgtcactaagcaccagagaaatgcaaattaaaaccccaatgagatatcatctcatctcgctccagttagaatgactgttaccaagaggacaaaagagcaagtgttggtgaggatgtggagaaaagggaaccctgtgtgctgttggtgggaatgtaaattagtacaactattacggaaaactctggaggttcctcaaaattcataggactactatgtgctccagcaaccccatttctgggtgtatatccaaagggcatgaaatcagaagctcaaagagacacctggaccctatgttcattgcagcattattcacaatacccgagatatggaaacaacctaaatatgtgttggtgtttaatgacaatgtggtgtgtatacacaactgaatattattcggctatgaaaatgaaggaaatcctgtcatgtgtgacaacgtggatgaacccaaagtcattatgttaagtgaaacgagccaggcacagaaagacagatactgcatgtcactcatgtggaatctaaaacagtcacaactcacagaaacagagtaggacagtggttgccaggggctgggggaatgcagactgtggcgatgctgattaaaggtgtaacttcccgttacaaggtgaagttctgaaggtctaat

SEQ ID NO: 35548 - DNA, 1031 bp, Homo sapiens
cagctactcgggaggctgaggcaggagaatggcgtgaacctgggaggcggagcttgcagtgagctgagatcacaccactgcactccagcctgggcgacagagcaacactctgtctcaaaaaaaaaaaaaaaaaaaaaaaaaacagagaagtcaaatggttttttggaatatggtggccctccgtacccattggttccacatgtgtggtttcagccaactatgtattgaaaataaaattgcatccttacaaatatgcagactttttttccttgtcattgttcccttaacaatacagtgtaacagctatttacgtagcatttacattgtattaggtactatgagtcatcctggagttgctgtaaaacttaaacgtaaaacttgaaatgaggatgatttaaagtatagaggaggatgtgcataggttatatgcaaatactctcccattttatattagggacttgagcatccacggattttggtatccgtgggggtcctggacccaacctgccacggatacgcagggacgactgtatttggcatagaggcctttctaatgcacttaccaaggacacctgcagcaggctgtgatccctgagacgagcgtgagtttagtgagggcagagtttttgttctggttctcagctgtgtcccagcacctgggattgtccctggcacacagtagctgcttagaaaagatttgatgagagggtgaccatacatgaggggaaattttcctcagtatcaaaacatgttgaaactcacacacttccaagatgacgtattctcaggtctcctgccgttgccgttctctgccgtatgtgatggtgttctgtcttaccagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaag

SEQ ID NO: 35549 - DNA, 1747 bp, Homo sapiens
agtggcctgaccctccagatctttcttttccagaggacagtgggcgaaaagtagttgctccagtgactgtccgagcagcaccttgagcgacccctctcagttctattcaggcaggaattcagcaagctagatgagagggtgatttagaggcttggcagttccctgttagaatacaccctgcagatcaacagggaaatattacagctacatttgagccttttccctttaaattacttaaggagtttaaacacgctatcaatcagtatggaccaggttctccttttgtaacaggactgttaaagaatgttgttgtttccagtcggatgattcctactgacttggacgctcttacttgagcttgtctaactcctgctcagttcttacaatttaaaacttggtgggcagttgtagcttccattcagcctacttgcagcgcccaggcccaacctcaaattaatataactgcagaccagcttttgggggtcggcagctgggctggtttagatgcacaagtggtcgtgcaggatgatgccgtagaacagcttagaggagtgtgcattagagcttgggaaaaaatcacttcaggtagagaacaatacccttcctttagtgcagtaaaacagggaccaaaagaaccgtacgctgattttatagctcggttacaggagtctcttaaaaaggtgatcgcagattcggctgctcaggatatagtgctgcagttatcagctttcgacaatgctaatcccgattgccaggctgctctgtgacctatcagagggaaagcacacttagttgattatatcaaggcctgtgatggtatcagaggtactctgcataaagcgactttgttggcacaagctatggcaggactgaaagtgagtaaaggaaatactccgtttcctggaggttgttttaactgtgggaagcatggtcatactaaaaaagaatgtagaaaaaaatcagtgagtgagggtgccagatgggggaagaaagaaaactgctaagcctgaaatatgtccaaaatgtaaaaaaggaaaactttgggctaatcagtgtcactctaagtttgataaagatgggaaccccattttgggaaatgccatgaggggcccgtcctgggtcccgttccaaaccggggcatttccggctcaggccactccctcacccctgtacaatgtctgttccccgccacagccggtagtgccacagtagatttatgctgcacagtagctgtgagtcttctgcttggggaacccccaccaaaggtcccagcaggagtctgtggacccttgcaagcagggacgataggattactcctaggcaggtctagtttaagtttaaaagggtacaaatacatagaggagtcattgattcagattacaatgaggaaattcaaattgttacatctacttctgttccctggaaagcagagccaggagagtgcatagcacagctcctgattgtgccatatgtggaaatggggaaaagtgaaattaaatgaacaaaaggatatggaagcacagataaacaaggcaaagcagcctattgggtgaatcaaattactgataaacgtcctacctgtgaaataactattcagggaaagaaatttaaaggtttggtagatgcaggagcggacatttcaatcatttctctacagcactggccgtctgtgtggccaattcaacctgctcaatttaacatagttggagttggtaaagcccctgaagtatatcaaagtagttatatt

SEQ ID NO: 35550 - DNA, 1043 bp, Homo sapiens
gcaagaaggttgtgggaaaatcagcaagctctatggagacctaaagcacctgaagacgttcgaccggggtgagcagacagtgggctctgtgcacactgttgggcccttccttctgcagggtgggctggtgtctgtcccgtcagtgctgacttagttccgtgcttgctgtctggatgggtcctggcccacagctataaagccacaaccagtgactccatggactagcaggcccaggctgacagctcggagggcccatgtgactgggtcccgcctgcccctgatggaactttttgtgtccccaggaatggtctggaacacggacctggtggagaccctggagctgcagaacctgatgctgtgtgcgctgcagaccatctacggagcagaggcacggaaggagtcacggggcgcgcatgccagggaagactacaaggtgggccttctcaccacgcccacctgcacctgccttttcctgccacctggtgggactcagccccacccctgcattttctctgcattttctttcgttgccccaaaagtaaatccaaaaaatgcctttttcccccctggtaactttgatccctgggttctcgccatcttctggatcactgtgaccttttccttgctttgggtcggcatccactgatgccagcagtggcatctccaagccaatgtgctttgctgttagaaggccaaggttagaagtgcagctagagtggcaagaccaggaaataaatgccagtttattaaataacgagtaagccatcatttcaagcctgccctgtggaggaaatgccagtttattaaataacgagtaagccaccgtttcaaacctgccctgtggaggaaatgccagtttattaaataacgagtaagccaccgtttcaaacctgccctgtggaggaaatgccagtttattaaataacgagtaagccaccgtttcaagcctgccctgtggaggaaatgccagtttattaaataacgagtaagccaccgtttcagacctgccctgtggtggaaatgccagtttattaaataacgag

SEQ ID NO: 35551 - DNA, 2160 bp, Homo sapiens
gtgcatatttaatacacagcttgagtattccttctctgaaatccttgggaccagaagcgttgtggatttcaggcttgttcagactttggaatatttgcattatacttactgtctgagcatccctaatcggaagatctgactccatagcacatttcttttgaatgtcatgctggtgctcagaaagtttcagattttagagaatttcagatttttggattagggatgttcaacctatataaatatttactttgaagtagaaaaactggaagtagatggtttaaacataaagtgtcttggtatagacaagggttctcccactttacatgatgggagcatttttgtaaagcactgagaatcttaaagttcacatgccataaatctacttttatagttaaaatttttcaaaaggaacacaagagatggctttttgtacatttttgtgcttaacttaccactgactcttcttttcaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaatccatttgaaatattttactgttgtgactttagtcatatttgttgacctaaaaatcaaatgtaatctttgtattgtgttacatcaaaatccagatattttgtatagtttcttttttctttttcttttcttttttttttttgagacaggatcggtgcagtagtacaatcacagctcactgcagcctcaaactcctgggcagctcaggtgatcttcctgactcagccttctgagtagttggggctacaggtgtgcaccaccatgcccagctcatttattttgtaattgtagggacagggtctcactgtgttgcctaggctggtctcaagtgatcctccctccttggcctcccaaggtgctggaattataggtgtgaacaaaccaccatgcctggccttgtagtttatttctaagttcaaattaatgttggtgcctgagaacgaatggagaaaactaacatttcctcctttttcttggcagacggtttactaggtgagtgtgtccttgattattcaaatcaggggtccccaatccccaggccacagattgttaccagtccatggcctgttaggaaccaggccgcacagtaggaggtgagcagtgggccggtgagctactgtgtgagctccaccccctgccagagcattactgtgaactccgccacctgtcagagcattactgtgtgagctccgccccctgccagagcattactctgtgaacaccacctgtcagagcattaccgtgtgagctccgcctgctgccagagcattactctgtgagctccgcctcctgtcagagcgttaccgtgagctccgccccctgttggagcattactgtgtgagctccgcgccctgccagagcattactgtgtgagctccgcccctgccagagcattaccttgtgagctccaccccctgccagagcattactgggtgagctccaccccctgccagagcattactgggtgagctccaccccctgccagagcattactgtgagctccgcctcccgacagcattaccgtgtgagctccgcgccctgccagagcattactgtgtgagctccgcccctgccagagcattaccttgtgagctccaccccctgccagagcattactgggtgagctccaccccctgccagagcattactgtgtgagctccgcctcctgccatagcattactgtgagctccgcctcccgacagcattaccgtgtgagctccgcccccgttagagcattactgtgtgagctccaccccctgccagagcattactgggtgagctccgcccctgccagagcattaccttgtgagctccaccccctgc

SEQ ID NO: 35552 - DNA, 1049 bp, Homo sapiens
tgtgcaggtttgacatcatgctttgtttatgaagctgtgggatacaaggactctcatacgtcactgtggaatgcagaacattgcaacctcatggaagaggatttggcagcatctaacaaaagtatgtggcatttgccctttgactcagcaattctagactgcctcaaaaaaaactctggcaaaaaaatgaaaggactttactcacagagttcttttcacgcctaaatatgtttgcaaccaagttcttcactgtggcatttgtaaaactggaaacaatcaaaatgtccatcagtaggggattaggaacattaattcgtacagtggggaactcagtaccagaaggagggatgaggaagacctattgataaggggcagagtacatatcatataatgcaaatatatatttgctttttcttaaaacagtacaaagataaaaaactaaagtggttgctgtggaggacaggggtcaatggtggaagtgagactgaaatagactctgaagtaatatctggactttgaaattataagtgttttacatattaccaaactaagttttaagatagtccctaaaattgaaagaatagtatctgaaatgaatgaatctaaattccttggattgtcttctgcaggtgccaaccctgagaccaaaatttggaaggtggccctgagcagcagctgaagggaagcgggaggtaagacaggaaagaggtgagggcacagggtgtctgggagccggatcccacgtgggcagctgggcccgtgctcattgtgggagctggtgcattccttcaccagcccacgctccacagggtcaggatggtcaattccgggcaccccggcctaatccaggacatgctcctgccaccagagaaagcccctaggcagcatcccgggtgctggtggtgtcagaatcaagtttgagtctgaggagtgacctggggctggctgggctaggcagcatcacagggttctgcagcccaactgcacatcaggctggtgacagtcacacagcctattacttcgtgtgtcatcagagcatcgccagaacg

SEQ ID NO: 35553 - DNA, 1040 bp, Homo sapiens
gacttctctgaatagaccttcgagggcactggggggtgattgttggagggcttggggagctcaggcagcccttgtatgggaatgtggctgttacaggaactgcagaaactgggactgggttcctggggaaaggattgggggtgttggaggcgctggccaggggattatggggaggtgttcttatcagtgtgcgaatactgggcgttcaggcagcgggaaatccgggtccttgcgtgttgtgagctccctggaattacgttcttgccagtttcagctcagttgatccccctcccctccgctatcattggacacattttacttcattgaaacctgactgccactttttctgtaatccctcaggggcagtcatcttttctgattctgtgtatagtttgcttttccagatccgtgccatttaagctagaaaaggggtcagttttgagatgttgtgaaaatgttgaaaggcttcttgttattagtgggaagtatctgaagttgccagagactgaactggggcgcggggagcactacggctgctagacactgcctcactgcgctgtgggtgggggggtgctggattcagccttactgcctaatgatttgtgaggatttgtgttttcagagtaacatttttaccttatattacgacatcagttcctaatatgtggcgtgtgggccacagatgctggtgtattatttcacatgcatttctatagattgttttcagggaattcagaaatgctgttatctctacactagtgattgtgctttcttggtttttctcttttcattattcttaaatcctcgttttttttttttttatttgcatctcagttcgtttttactcgggaagtgcaagacgtggctactagaaagagatgtcaagagaacccggaatccagtaggctacaatttggcaaatctcagcttaaaacttcctaaatgttgaccacagtggatgcaaatggctctgtgcatcacctgttaaatatggtcagatgaccatccaggttcaagtggtttgtcaccagggtgataca

SEQ ID NO: 35554 - DNA, 1076 bp, Homo sapiens
tcttgatttcagctgctactaaatatctaccaggagactgcttgagagaattgcctgatgggtgctgagtccaccattcctgagatactttgaaatcagtggcttaacccaagctgtgtatcgggaccctctcaccgtggtcccaatggagtcacttttcttaggcgcccccctttaccttgggctctgagcttcctctgcctttcatctctgtgggatgaagccccaccgcccttcaggatgcaaagccctcttctctaatgtgagtgcagggccaggtgcagtggctcacgcctgacctcccaacactttgggaggccgaggcagggggatcccttgagcccaggagtttgagaccagcctgggcgacactgtgagaccctgttgcctgaattgccctgggagatttcctcagcttgtgctgggggcatgtggccccatgaagcccgtagtcactgttcaccctgagagacgctggctttcgggctcacacacctgctgcggggcagccccaggaaatggccaccccatttctcctggagctgcgcgtgttctcagaaactgtggtggccgttctgttttgtttgcatcttataaacgtttacctgatgacattttcctcttcaatttagctgctagaaaatttaaagtcaggttggtggctcaccagtaatgagagtttagagtagaagtaaactttatgacatagtcttagactcttcactttcttctcaaccaatatgattcacatttactttattttgctgtaccgtgagtgtctctgtgtttcctgaattccttctggaataaggcaggttgttagtaagcacaggtttctggtccatctcacagcctcaggcagtgggcattgctgtcggtgctccctttccgggttacctgtggtagctctcaagttgcagggctgcgatttgaagcctgatttagtacaccgtgtttctgttgtgttctgtggtggtttgctcctcacatgtgagcattcaccgtggccctgtgtttttccaccacacctctgcctggtggcatcctactggatgtctcagccgagccactctgtt

SEQ ID NO: 35555 - DNA, 1502 bp, Homo sapiens
gagctgaatttccagtttgagagatgtgcagatggagacccagtgggggagctgatgttccagtttgagggcccagaagctgatgttccagtttgagggcccaggagctgatgttccagtttaaggctgtgcagctggagacccaggggtgagctgatgttctactttgagggctgtgcagcttgagacccggcgggtagctgatgttccagtttgagggccgtgcagctggagacccaggtgggagctgttgttctagttttagggccatgcagctggagacccggggagtggggggagctgatggtgcagtttgagggccatgcagctgaggacccaggggggagctgatgttctcctttgagtgctgtgcagctggagacccggggggagttgatgttccgtttgagggccgtgcagctggagacccaggtgggagctgatgttccggtttgagggtggtgcagctggcgacctgggcgggagctgatgttctagtttgaggactgtgcagctggagacccagcggggagctgatgttgcagtttgagggccatgcagctggagacccatgggggagctgatgttgttttgagagccgtgcagctggagatccgggggtgagctgatgttcccgtttgagggctgtgcagctggaggcctagcgaggagctaatgttcctgtttgaggtccttgcagctggagacctggggaggagctgatgttcttgtttgagggccttccagccggagacccggggatgtgctgatgttcccatttgagagctgtgcagctggagacccgtgggggagctgatgttccctttagaggaccgtgccactggagagcctgcggggatctgatgttccagtttcagggccatgcatcttgagactcggggaggtactgatgttcccgttggagagccgtgcagctggagacctggggaggagctgatgttcccgtttgagggccgtgcaggtggagacctggggaggagctgatgttgttctagtttgtgtgttgtgcagctgcagatccagggatgagatggtcctgcggttcaaatatgagggtcccggagctggagtctatgtgaggagccaatgctgcctctgatgtcttaggttgtggagctggaaactcgcggaggagtcggtattagtgtttctagttgagggttgtggatctggagatacagtggggagcagtgttctagtttgtgggtcgtggagctggagacccagggaggagctggtgtgtttctagttgagggtcatggagctggagacccacggaggagctggtatgttctagttgagggtcgtggagctggagatctggggaagagctggtgctgcggttcaagtctgagggtctcagagctggagcgcccgggaggagtaggtactgccactgatgtcttaggttttggagctggagacctgtggacaagccaggctggtgttctagtttgaggttcctggagctggaatcctgg

SEQ ID NO: 35556 - DNA, 1044 bp, Homo sapiens
cgcaatgttcagaaaagcaagcaaaagttcaaggaacctgcttggttctgagatggcctcatatcagcttcataaacattcattctacaaaatagtaagctaacatttgaacacaatttccaaaaataaagaatattttctcataaataatgaagtctgtttctcaggcacctcagaagtatacaaaagaatttgagtttgaacagatctcttggaatgtgtttaacctggtatttcaacagacttaagatttctagggtttcacaaaggccagattttatttcagttactcagaagagaaagaaaatgtcttctgaaagaggtgaactcaatcactaccaatagaaaaagtatccactgtattcatctcttatggaaacagaaaaatataacatttccccccttaaaataatatatatattatatatatatatatatatacacatatgtatatataacttaaagttccattgtacgtagccggacaataaaatctggaaaccagcatgaaaccctgttattcacatgttaaaatgttgaaactatgaccaaaatgtgaaaactgctagagctatcagaaagagacaagacaaaaaccttctttcatatgtataaactaaatgtgataatctcaaaaaacttttcaaaattatgattaccttccagtttaaaaactttaatcctaaattaaaaaaaaaaaatctatacacaaaccactgatttgcccagaccaaaagaaagaaagaaagaaagatcagcggtaaggtaaacaggacccagaggagctgatattcacagttcttacgtgtacaactcttccaggaattatccataaagtactttattgttttacaacctgcttttcttgtaaaactaaacgtggacttttttacataaaagttttatacggcgttaaaaccagaactgtatgtaaaatactgcatctaaatgtttctaaatagtcttgttccattggttcatcggtgacttctgtggcttcgtcatcattttccatggatgattctgaaagaatctctccagttt

SEQ ID NO: 35557 - DNA, 1080 bp, Homo sapiens
gtgagtgcttcccggaggtgagtagttaattcacaggagtgactaatggcagcgtcccactcactcctccttccggggtcatggtctcaaggggtcactccatgcactggggatgtcagctcattacagaatgatatattcgggaagtgtctcagttctgagtgcctttgagggaatttgcacttccgttcccacacagccttgcattgtgtgtgttagaggctgtgggccttgggcaggaggggtgagtgttggcacatacctcccgtctctcccagccttctctgactctgactttccctcttgaaggctaccggctctctgaccagttccacgacatcctcattcgaaagtttgacaggcagggacgggggcagattgccttcgacgacttcatccagggctgcatcgtcctgcaggtgacggaatggcttcacgtgggtttgtggtggtggtgggaggggcttgcttgccagcgtgatgcacctgaccttcaatctaaggagctgggcatgtgtagaattagtttttggagcttataaaagtgagtctcatctttggagaagtagccggttagtgaagtgtggacaaacatgttttcctccccttggaaatggcacagagcagcccatctgcaagacgtggtttttcagtatccggtgggttatttacatgtatgttctggtgttgtggttttttttgttttttgttttgttttgttttgttttgagaccgagtctcgctctgtcacccagacgggagtgcagtggcacgatcccggctcactcccacctctgcgtcccgggtttaagcaattctcctgcctcagcctccccagtagctgggattacaggtgacacccagctaatttttgtatttttagtagagacgggattttgccatgttggccaggctgatctcaaactcctgacctcaagtaatccgcccaccttagcctcccaaagtgctaggattacagacatgagccaccatgcctggccaactatggtgtatttttacaaaaacttttattctgagaaaatgggcacgttttctgttgtggtcatcactgtgtcctgc

SEQ ID NO: 35558 - DNA, 1046 bp, Homo sapiens
aagatgatatctcattgttgttttattttgcatttctctgatgattagtgatgtggggtattttttcatatacctgttggccatttgtatctcttcttttaaaaactgtctattcatgtcctttgcttactttttaatgggatcacttgggtttttttgttgttgccatcgttcaattgtttgagttcctcgtatattctggttactactcccctgttggatgaatagtttgcaaatattttctcccgtttaacaggttatattgtcactctgtttattatttcttttgctgtgcagaaggtttttagtttaagacccatactatagtctgtggtgtaatttgaaatcatgtagtgatatggttaggttttgtgtccccacccaaatctcatcctgaattataatcctcaggtgtttagggagagacctggtgggaagtgattggattatgggggcagtttcctccatgctgttctcatgacagtgagtgaattctcataagatctgatggtttgataaatggtagtttttcctgcgctgacacacacacctctgtcttttttggtccttatgaattttaggattatttttctttttctcttttcttctcctcctccttcttctctcttttttgcttcgagatgggatcttgctttgtcacccaggctagagtgcattggcgcatagctcactgcaacctcgaattcctgggcccaagagattgtctggcctctgcctcctgagtaactggactatgggtgtgtgccaccatgcctgactaattttaaattaaaatatgtttttgtagagatgaggtctcactgtgttgttcaggctggtctcaaactcctggcctcaagcagtcttcttgctttggcctcccaaagtgctaggattacaagtgtgagctaccatgcccagcctgagattgttttttctaattctgtgaaaaattactttggtattttgatagggattatactgaatctatagattgccttgggcagtgtggtcattttaacaatgtgaattcttctgatctatga

SEQ ID NO: 35559 - DNA, 1041 bp, Homo sapiens
aaactcctgggctcaagtgattctcccaccttggcctcccaaagtgctgggattataggtgtgagccacttcactcagcctttttggaattttctacatgtacaatcatgtctgcgaacagatagagttttcttttatttttatttcccagttttatgacttttatttatttcccagttttgagacttttacttactttactgacttattgccctggctagtacacaaataattttagtgggaatgggggtacaccacagctttgccttgttcatggtcttggggggaagcatttagtctttcaccattagctgtgatgttagctataggcttttgtagatgttctttatcacgttaattaagtttccttctgttcctagtttgatgagaggtttttttggaaaaattgttatgaatggatttggattttgtcaaatgcttttctgaaagattgagatgatgatgtgcattttctttttagtttattattatagtgaattacagtgattggtgtttggatgttgaagctgccctgaattccttggataaatcccacttagctgtgatgtatcatcctttttatatattggtagattctatttgccaatacctatatttaagtgaggatttttgtgtctatgttcatgtgggatgctggtctttagttttcttttcgtgcaatgcctttggtgtggcatcagagtaatgctgaattcgtaaataagtcgacaattttaaattttttctttgatattttttgccaagagagaattggtattatttctttacattggtagatataccagtgaaaccatttagacctgggttttttgatgttgttggaatagatatagagctatccagattatctgttttttcttgagttttgatagattgtgcctttctaggaattcctctatttcatctaaatcgttgaatttttgggatagtatttgtcttactctgcttgggctgccataacaaactaccatagactggatagcttaaacaacagaaatttatttcacactgttctggagg

SEQ ID NO: 35560 - DNA, 1020 bp, Homo sapiens
gcgcggggggagctgtgtgtgtgtgggtgtgtgtgtgtgaggctgtggggggctgtgtgtggggtgtgtgtgtgtgaggctgtgtgtgcgcggggggagctgtgtgtgtgtgggtgtgtgtgtgtgaggctgtggggggctgtgtgtggggtgtgtgtgtgtgaggctgtgtgtgcgcggggggagctgtgtgtgtgtgggtgtgtgtgtgtgaggctgtggggggctgtgtgtggggtgtgtgtgtgaggctgtgtgtgtgcggggggagctgtgtgtgtgtgggtgtgtgtgtgactgtgcgggtgtgcgaggctgtgtgagactgtgtgtgcgggtgtgtgtgggggactgtagggagctgtgtgtgtggggtgtgtgagactgtgcaggtgtgcaggtgtgcgaagctgtgtgagactgcgtgtgcaggtgtgtgtggagggctgtggggagctgtgtgtggggggggtgtgtgtgtgaggttgggggctgtgtggggtgtgtgtgaggctgtgtgtggggagtgtgaggctgtgtgtgtgcgagggggactatgtgtgtcggatgatgtccctggctgtgtgtggggatgtgtgtgtgtgtgtgtgtgtgtgtgtcagatgatgtccctggctgtgtgtggggatgtgtgtgtgtgtgtgtgtgtgtgtgtcggatgatgtccctggctgtgtgtggggatgtgtgtgtgtgtgtgtgtgtgtgtgtgtgtgtgtcggatgatgtccctggctgtgtgtggggatgtgtgtgtggggagaggggtgggtgggtgtgtgtgtcggatgatgtccctggctgtgtgtggggatgtgtgtgtgtgtgtgtgtggggatgtgtgtgtgtgtgtgtcggatgatgtccctggctgtgtgtggggatgtgtgtgtgtgtcggatgatgtccctggctgtgtgtgtgtgtgggtgtgcgtgtgtgggtgtgtgtgtgtgtgtgtcggatgatgtccctggctgtgtgtggggatgtgtgtat

SEQ ID NO: 35561 - DNA, 1028 bp, Homo sapiens
tggtaaacagtaaagagatcccatgtcccgcagggagaccttaccttgtccctcaaggctgcagtttgcggccaaggcctcgcactctctgtgcatcgaacaccagcatgcagtaggctcagtgcccaggctgacgctggcccagcggtgagcacatgcgcaaaaccatgcctggggccaggcacacagccgaggccgggaccaagggctgcagaagaaacagcacagccctgcgctgcttgcgaacaagctctagcgggggacggcagtagatacggatgctgcaattcatatataaagggaggaaacataaatacggtgcatgcacattttctagtttattcgtaaaatgtctcccgacggaatcacagaaaacttaaaatcagctgcctccaggcagggagccagcctgaagacactttcctctgagttttgaaataggtgagcacactagctattcaaaacaccaatacataaaacgcaaaggcccagaaactcctttctcaggtctttgcagtggaataaaaacacaataaaagcaggaaatttcgttctgattcttccccagacggccccaccacagggactgcatttgcagctgtgtgacaaagctatttcctctccttatttaatgtgacaaatacgtctgctacccaaatctctcaagtgcacaggctcaggagcacattccgtcgcccacccccgggggacccagctatggaagtgtctcaacccttcctggccccctacgtgcacccggcttcatccttggcccccagggacggcggcccttcacctgcagacctcagcctcaccctgtataaagctctgtcttcctctgctgctacaagaacccactgcagatgcagcatcagccaggatgcttccacatccccccgcgggacctggggacctgggtgaatgatgaacacgcggaagctcacgtagcttgctgtgccgtgagtagtaagccctttgtctccgcctccggggtctcatgtcttcttccagggtccacgaaacaggaa

SEQ ID NO: 35562 - DNA, 1052 bp, Homo sapiens
gtgttagttgtaaattcatggttacataacataataaatttacctacgaattcattatttataaacaaatggagactctgacagctgagctggcactcctcgttgatgtgaaagttgacaagcgaggcagcatccatacctgtgggtagagggcagaggactcagtgagggctcggtgccctcttccgcagtaggagaggccagtggggctgctcaggaagactccctgggcgtgcaccgcgcactgtatcctgcctgagggtgtgggccagggcgctccctggctgtggccgcgtggggttagtggcctgcagtgttgaccgctcactcatctgtacacctgtgcaccgcacgctgattcactgaatatttggttgttaaacagcaccagcacagtgttttgggttttgttttacaaaatgtttcttgaacccttggcttgtccctgctgtgcttttctttgatacgttgaaatgtaacaagaatgcccaaatagtttgcttataccagatgtttcacatcatgaagagaatatggatttgcaatgtgtgcaagtattctttttttccccaaagagctatttttggttgcatcttccacgataacgtggggttccaaggccagggtgtgtttcctctgcaggacgagcgtgtgactctggtgaccgcagagcccccctgaggcccccgggttctgtgatctcagaaagtggttagaggcgcattctcttgaccagagaaacgcgtgggcactgccagctgcagccaccccagtcttcgctggctcagaggaagtgcatttctttgcggttcattttgcactgtgaggaagtgtgaaatctctgaagctctctggtgctttttgaaaaatcgggaaattcttgccataggaaattcagcaacttgatgcagtatgtgtcttggggtgccccccgttttgtaaatatcgtgtctgtgaaatgagtgtgtttatttatactcctgatgctttttctagcttaggggaatttgggactttgaaggacatttttaaacccctctgccccacaagct

SEQ ID NO: 35563 - DNA, 1043 bp, Homo sapiens
ttgctgggttcttaaggaaagaggccaccgtgaaagacaggagtgagacccaacctgagaagacgagctggagggaacagagatgcacagaatgaagaaaagacagaggcaggaaaggaaagggtggggggaggggaagggagggagggggagggggaggggaagggagggagggggaggggagacaggacagaggctggaaaggacagtgatgcgcagaatgcagacaggacaggacaggaaaggaaaggaaagacagaggccagaaaggacaaagatgcgcgggacgaagaaaagacagaggccggaaaggacagaaacacacggaatgaagaaaagacagaggcccggcatctgtggcacaacgcggggactgcagtcaacggtaacttaatcgtacatttaaaaataacgaagagtgtgattggattgcttgtaacacaaagggtaagtgctgagggatggacaccccatcctccatgtgaccgttatgcatcacacgcctgcatcaaaacatctcagacacgccataaatatatacacctactgtgtacccacaagcattaaaataaaaaaatttcttaaaagaaagacaaaggcagctgtcatcaggatcctcggagaccagtgaaagcaccgcaccgaccaaatgaaaatcagtcgctgcagaaagaaaattcagacatgaaaacggctcaacaattaaaagcatgagagcaaaagccctaacgatcccggagaagcatttgacgttaacgctgaagaggtctttccatgagtaaaggaaaaagaggtggaaataataaagtcaggaaaatgagcagagcctgagagacgccgggggtcagagctccaggaagatcggagggcagggagtcttcaaggggaggttgagctggcttcccagagcccagggcatgagtttccgggttggaagttcctgctgggatctctgtgagattccacaccctcgtggacaaggagaagatcctaaatgctcccagagaggaggggcgggtttcatggaaatgatccagagacag

SEQ ID NO: 35564 - DNA, 1050 bp, Homo sapiens
gacatggctgccaaggggtgtccaggccactgccctgttgggaacgcagtgcagggtggagacacagctctgctgtcccagcagcgaccttgatggctctgagcctcatttcctgtgcccacacaatggccagcagcggtgtttgcctgccaggctgtggccagaccacggggccactgagcaggggagtgctgggaaaagccctggtgcccggcacggcgtctcctaccacagagtgacatcgctctaggcggctgctgttgacaccacgtgaccacaggctttgctgagtgtgccctggtatctgtggttggggcactgtcatctcctgatgcgccctgtgagaggggacctgaagtgacgcctggtgggtccctcgttcccacagatggcatcagcgtctgggtggccacccggcatcctcttcatctccatcttctgtgctcagatcccatggagctgccgtgggatgcttcctttacacgtgtggagagtagtggagtgggtccgttgggtccgtaggcgtttgctggggtttggtgcatccttcactgtggggtgccgtgaacgggggagcactcacagtacaggacatgggcggacatgacggtgtggctcgatgactttgtcaacttaaacagagcagcttcggcttggtctttttgtgcagggcccatgtctagagaaggtggcttggtccatatgtgcaggtcccgagtctagagaaggcggcttggtctttatgtgcagggcccgagtctagagaaggccgcttggtctgtatgtgcagggcccgagtctagagaaggcggcttggtctttatgtgcagggcccatgtctagagaaggtggcttggtctgtatgtgcagggcccgagtctagagaaggccgcttggtccgtatgtgcagggcccgagtttagagaaggcggggtctgtatgtgcagggcctgagtctggagaaggccgcttggtgtgtatgtgcagggcccatgtctagagaaggtggcttggtctgtatgtgcagggcccgagtctagagaaggcggc

SEQ ID NO: 35565 - DNA, 1094 bp, Homo sapiens
ttgcagattatataatcaaatttttacctgagtgcgcattgctgttgtaattagaaaagcagtgtgacgtagcaaagatgcacggaagtgcctccctcccacacgcactcagtgctcgtgggacgttgaggtgaggaagtgcctccctcccacgctgcacgcagctctcgtggggcgttgaggtgaggaagtgcctccctcccacactgcacgcagctctcgtggggcgttgaggtgaggaagtgcctccctcccacatgcactcggctctcgtgggacgttgaggtgatgatttctatgatctgtttctgcttttcagcaacatctgaatgaattgatgacgaagaagtggctattagggtcaaacgctgtagacattatctgtgtcaccgtggaagactatttcaacgattttgccaaaattaaaaagccgtataagaaggtaagaaggtgggacctagttccctcatcaccttgacgctagggctcacctctcaccctgctcagaattcagcatccagcgagtccctccgtgagtgaacgttcacttgttgtcctatcagcccaagggaggcaataggctctgcggacgccacctccctgggacggggctctggtgagaatggccggggccctgtggcatggccctcgaggtggagggagccatggttcccggagaggcccgcgtgccccgtcttagctccttgccttccactcactccctgaggccccagggatttctttccgcttcagaccctccttcctgcaggacccaggttcctctttcctccaaagtgcctgccgcgttttccagatgctgcggtcgttatcaaaggacagcagcagccactgacacgggcctgtctgtggaccgagtgctcatgcgcggcactgcctcgcccgcgtctgtcctgctgggggccggagctggcctggtgcgggggtccaggtcaccgtcactgttcccccactgagcccccgctcctcctctgcggtgagatgccagagccgtggcggagcgaggaggagtgggctcagagcctccggggagccaccgggagccccagcctgggtttcaatgagggtgctcctgg

SEQ ID NO: 35566 - DNA, 1960 bp, Homo sapiens
caggagaccccacccccccaggtcccagtgcccctggtccaatgaccgagctccctcctggggcggcaggagccacccctcccttagccacgacgcctgtgccccgtccccacctgcaggggagtcggacgctgtgtccttggtgacactagccaggaactcgatccccccactcatctcctcatcatagttggggggctcctcggtgtctgaaagttccaagtctggggaagacaggttggggtgaggactggggtcactggggggctgtcctcacagcccagtcagcagtgtccatcagctctgtgcacagaggtgcaggcagtcgggacccacagagaggagggctaaaccgcagggctggaggagggaccccacttagagggcagtgtccctggaaccccatcctgggtgggtctgcagctggggccctgaccatgcctcccctgcctgggtggctggagggtccccagaggggaaggtcctgagaggggaggttcccgagccgggagggctggggctgggaggtggtggctcccagtcccagcgttcctgcagggcccccagcgcacctttctccttgatggtgaaattctgcgcagggctctccatgggcagcttcccattggggatgctgctgtttctctgcggagcaaacgtgaagctgctcacaccccgacacagccacacccagccctgactgcccccgctccaggccccagccccgccaagcctcctggtgacccagccttacccgcttctgggcacgctcccgcttgtacagcttggccgccttcttgttctggttgagccccagcttggtcgacttgaaggactccaggcgcttccgcatggtcctgtggaagatttcccggtcctgtttctcgtcctccgtgggcgtgagctcgtgtcggctgtacagatgcttgtactgcgggatcaggcacggaggtcacagctgtgcccaccgccggacattctcgccctcctgccgcaggagctgagcacggatcccccgtggtcccaggaggggacgaggaagccgccccacggggtccctgcggggtcctccagcccccagcccgcagtgcccacctcctgccgcggcttgtacaggtactgctgtagcgtgtggtgcgtgaccatgtcctccgcgtcccggatgctccgccgtcgctgctccagagactgcatgtccaggcagacagcgctgacattttctctcctgcgtggggaccagcgctgagccatacaggctccctcagggtggggtctcttgcgcgcccctcgccttcccacggcgggcatctggccctggctgcctcctgcgtgcccctcgccttcccatggtgggcacccggctggggcacggggacatctgccatctggccagccccttctcccctcggggcttaggctgactccccacgaggccttcctggcctcctgtctgaagtgggtccctttccttactggtccctctccaaagccctggctgtaagactcggggaccccagcatctgcacatctggcagagtggacctcctatgagaactggctgtgagctgtggagcccagggccggaggagcagtaagggtggcatggggaccaggacaggctgctgcgggccaggggcaaacacgtcaggcctggcccccagtccgctgctgcccctccctttcaccttccatccagcactaagggagtctggccacggcctaatataggagggcttgtggaaggagacacccaccccctctttctgcacctctcccctcttccatgccacccccaggccaggagccaccacagccctgtctgtgactctcagctcccgaggctgggctcttccccagggaagctgcatgaccatggccacatacaggaggtaggagacagaggcctccacggtggacgatcgtggcgtgaagtccacgttgaccacgttgtcggtgctgg

SEQ ID NO: 35567 - DNA, 2682 bp, Homo sapiens
atactgcagaatcattgaagtggtctctgtccctgcaggagaccctaaaactccattggcctcatgtccagaactgaatcaggtagagaacggagcagagcccgatggggcacagaagccacacagctgagtgccagaggatggaagtggggccgcctatgtgtcctcagaccccacccgcctgatggcagggcctggagagcatgaggttgtgcaggagcacagggcagagtgggcttatggctggagtcagggtccccagggccggcaggggcacgggtgtggagggaacgtcagctcactgcactcagacctcgccaggtgggcacccgtgccgccttcagtgtgcaggatgctcccagggaagcccccggggtcaggtgggtgccgctgttcccactgaagatgcggcccccagttcactgcccactcgggggggatttgagggtcattggttctgagggccctccgcctgctcttttgcttctaaatccagcatcttctgtatgacctttgtcccgctcctgccaccccacgaagacagacgtgagggtcaggggagccacggtgctaactgccactctgggcgggcacaggcgagggctgtgcagcacccgggcacgtggggtcttcggaggggctgctccccacaccacttcccctgcccctgccgagccctgccgtggggtgggggggcgcagggagagaaagcagccgccctgggtgagagccaggagggacactgggcaggcagatgccaccccaggtgtggggacccccgctactgagtggccgggaggagcccacaggctccccacatgcagctgagcccagggttgtggtcgtgggtcgtgggtcaaggatggtggctggtgtggttgggggagaggctcaaggcccgcctgccaaccttgtcacctatgtgggggtgaggggagcccgccagaggccagagcccccactgtcccttcccaccctccagccaggctccaggcctcctagggccagagtatctgagctttctctcgcttgccgggcctgtggtttgggggtttgtgtggagcctggtccaggagccctccttcctgatctgcactggctggccctcctgacagccccaggcccccgtgccctctgccaggaggtgccttgccacttggcatggccccagtcacgggtggcacatctggggtgaatgcacgtcagtggaggcagaatcattctgtctgaatgaatggagtttccaggcccccactggccctctgtgtgagggtctgcagggtttggcaggacaggtctttctctccggcgagagcacccaccctgaccggctgctggatgagggcaccaaagctcgctagggagggctctgtccttagggaggagctgcggaatccctgcagctgtgcccccaggccctgccttgcacacttcctgcagccagggcgcccctggggaggtcagggcaggccggggaggctgaggcccacctgccatagtgggcaggtgcgggagccagggcggcagtggcctcggggctgggtggggcgcctggcctctggtctctggagcagtcaggggctctgcagacgctgagaggcctgctcatagtggactgggagatgctggagcagcctcagagccatggccggcccacagcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatccctggggaaagcaagggagctcggggtcctaggacctgacctcagcgctcacccccaccagcaccacagtcaccaggactctgtgactcagtttaccccacgagagcccctgggattcccagggcatcagaaggcccatcagcctcccgtgaactgctggggtgggcctggccttgggacgcgggtgcaggggcctctcctcactgccccatggcacccacagccagtgccagagcctgctgcagccccgacccggcagagcaagcggctctgctacctcagccacgtagctgatggcatccttcaggttcagctcgtggaagacattcaggatccggtctcgagacttctgggccgaccgtctcatgaggaccctgctgaggaacttcctgtcgaagtgggaccacctgtagggacagaccttgggtgtgagcctcaggtgacaggcgccctagagcccgccggacgcgtggcccggccccttctctcctgaattttgtttgctatagtgaccctgtaggcgcgtttaaaatgagggaagcagcccctgccacacgcccaggccgtccgccgttctcccgcctgtcctgttggatggaggccgttagacgcatatgaaactgcatgccgcctcctccagagggtggctcaggacacggtgggtgtcaggcctggtcaggcaagggggctttggccacatggggggcaccttcaggtgcacaggaggaagggcaggggcggacagacaccctgagcccttagacttgtgggagccaagctgaccagagtgaggttttttttagcctaacggaattagagtattcgctggttatccagatcagaagggacggtggcctggccggacttagaggaaactctggggcacaagga

SEQ ID NO: 35568 - DNA, 1078 bp, Homo sapiens
tttgtatttttagtagagacggggtttcaccatgttggctaggctggtctcaaactcctgacctcaagtgagctgaccacctcagtctcccaaagtgctgggattacaggcttgagccctgccagacaaaatcattttaaatgttgactgatactaaccctgtttatgacgtggaggaaataatctatttgccttattttcaattcctacataacaatttggaattaattgggccacatgagagggcatctctattccctggaaggagcacagagaattcagctcctgtcccctcactcggtggccccaactgctgccgccaactcctttccgcagcacctgcgtgtctcggggcacacctggcacctggcctcatggggcaccggagccctgaccaagcctggactcaaacagttgttatgcatgtggcttctggttcttccgagtggaggatgtttccagaagccgggctgtgcgacaccgccggggccgtcccagccacttacttgtctctgagataattgtgcccgatctgtccggatatgtcctcgatggccgagaggatgtggtcgaaagcctttcaagggaagaaagacatgagcgtctcggggcggccaaccggggaacatgaggtgcccctccactcctggcccagccccgaggaacccaccagcccccctcaccacgcccctggcctggacgcagcctcctctcccctcctggcccagccccaaggaacacacggtgccctccgccaccccccaagccccagaccaacgcagcctcctctcccctctcagcccagccccgaggaacacgcagtgcccccccccgccccccagccccgcacgtatggcggcctcctctcccctcctggcccagccccaaggaacacacggtgccctccgccaccccccaagccccagaccaacgcagcctcctctcccctctcagcccagccccgaggaacacgcagtgccccccccccgccccccagccccgcacttacgcgcccgtgcagcttctcgttgagccgaggttcccggtgctcgctcctcttcaccttcagccactgcac

SEQ ID NO: 35569 - DNA, 1082 bp, Homo sapiens
taaacttaatcagaacatattctggttgggtgtggtggctcatgcctgtagtcttgggaggccgaggtggatggatcacctgaggtcaggagttcgagaccagcctggccaacatggtcaggaaaccacaagactgtcacggaaacccttttctttcagtaacatgagccaaaggtcactgcaccttgtcccctcctgaccctgtcccggtggcagggtgtgggggacaatgaactgcttgtctgtgtgcctccaagtggggcaaaaccaggcagcatcctgctgtttagctgcacctgagacgatgcctgagggctacctgaggaaacagggaaacgtggggttttagccggatgtggtggcgtgtccctgtaatcccagctactcaggagactgaggcgggagaatcacttgaacctaggaggtggaggttgcagtgagccgagatcgcaccacggtactccagcatgggcaacagagtaagactccatctgaaaacaaaaacaaaaaaaccaaaacatattctaaaacataaatgttcccaggaaagtattgatgtattcggatctaaactgcctttttgattacggaaactttcatcttgtaattaatgttgatgtagtgactgcttatggggtgcgtggagcttgcacagcccgaccacagttgtaacaggaggacagcagacaggttacccgacgagtgggtttcagatggtgatggctgcaaggggtgacagaattgagcagccagaagtggaggcgggagatgaagtagaggggtgttcctggggagagacggttttggagggagaggcagtaaaggtgggaagaagcgtgtgggcttggaggtattgtagagataaacataagccgaaacttcaggtacgttccttgctcgtcagtgctgatattccaactccaaaggagttgcactgagttctaggtgcctctttcagattacgaggatacatatctctctgagaaaagctgaaaatacagaaatgtgtaagagggaaaataaagggatttattccacaataggacacatgtgttaaagtttgtctttcaatctttttacat

SEQ ID NO: 35570 - DNA, 1050 bp, Homo sapiens
cacacccaggcagaagccgccctccgggagtcctggtgtgagggcagagccacgtgaggatgtgcacatccagaggggccttgtcagcatctttaaattgcgagtgaagtcggcccgggacggcttcgaaaactgcctctgaacttgtctgacaagtacatactgtccgtttcatgggaaccaacatctcagagatcccacacaacgcttcctctttagagaagaaaaacacagcaaaacaacacaggcagcctctgtttaaacgcacgtggcccccccaccccgcctggaagcctctgcacgtggccttcatctggaagcctctgtatttaaacacatgtgggcctcctccatctggaagcctctgtatttaaacacacgtgggtccccatcccccgtccagaagtctctgcatttaaacacacatggccccccatcccccatccagaagcctgtgcatttaagcacacgtggtcccccgtctagaagcctgtgcatttaagcacacgtggtccccggtccagaagcctctgcatttaagcacacgtggtcccccgtccagaagcctgtgcatttaaacacacgtggtcccccgtccagaagcctgtgcatttaaacacacgtggtcccccgtccagaagcctctgcatttgaacacacgtggtcccccgtctagaagcctgtgcatttaagcacacgtggtcccccgtctagaagcctgtgcatttaaacacacgtggtcccccgtctagaagcctctgcatttaagcacacgtggtcccccgtccagaagcctgtgcatttaaacacacgtggtcccccgtccagaagcctctgcatttgaacacacgtggtcccccgtctagaagcctctgcatttaaacacacgtggtcccccatctagaagcctctgcatttaagcacacgtggtcccccgtccagaagcctctgcttttaaaccaacgtggcccctcctctggaagcctctgtatttaaacacacatggcccctcatctggtggaagcctctggatttaagcacacatggccc

SEQ ID NO: 35571 - DNA, 1191 bp, Homo sapiens
tgtattaatttgtatccggcagtctagtaattttaatcatttgcctgtagctgtttcctcatttttaggcacacagtcatgttttctatgagtaatgggttttctttcccattcctgttgttctggatttttactttatgtttttatttttgttttgttttttgcttttctacactggtcggaacccctagtgcagtgctgattagaggtggtaacagagtgggcatcgttgtcttcttcctgatattcaaaggggtgataaattctcaccatttatccactcacttgtaatggattttttttgcttgttttaaagcttcttctatcaataattcgcctcaagaatggatgacttttatcactttttctgcagtgatggagatgaccatgatttttatcatttaatatattgatgtgtttaacgaccataatttgcttttgttaaaaataaaccttgaatttctgagataagtccaacttaataattatggattttcttttacatacatattgttatatttggtttgttaatattttgtttagcattttgtggcccagctatactacctagcacctgtgtttgggccctgatttcctcgtctgtacaatggggaaatagtggcttcctcacaggattgttgtgaaggtgaaatgagttagtatgaataagactctcgggcagcatctggtgcgtcctgagcactgggtagctgcgtgctctagtacagtggttagtatctctcttcacgggtgacagccacttacgattttcctttgtaatgctgttcttgaaaggattcgcatctttacaccaccgtaaaatgagctaggttgtgtattctttctccattctctaggagaatttacttaagattataattatttcttccatggatgtttgatggaacttgctggtgaagtcacttgtgcctggaactttctttgtcaggaggtttgactactgatccagtataactcagtgttccaggatgtggcagaaccgttcacacagaccatccttatgtcccccctgcctttacgctgcatatccctgagttgggctggggccgtgtgactactgagcaacagcctgtgtgtgggactgaggtgagtcatttcagggccagagcagcgggagctggtgcgtcactgtgatagcttccctgccagtgacctgggcagctgcatcac

SEQ ID NO: 35572 - DNA, 1077 bp, Homo sapiens
ctggcatcgccatcctgcacgtcgctccgagttctcactgctccaggagggtccagtggtcccgttccagcaggacccagccttggggttccccatgcctgttggccgcccctgcctcccgcaagccccagcaagatacagaggacctagagcaacgtttcccggggccgacagaggtcggtggcaagccctccaggccctgcctattctcccctcataagtgactccaccagcagctgagcacctgggggcaggtgaggtgatgtctggccacctgagagggcttctcccctcatctcaggaaaccggagcccttcctgcaccctacttggctcagaggatggatggcaacgtccactgggccacggcagctcaggccccagggcgggctgagggccagggccctcccattgctgcaccagctctaaccccaggcacacccaccatgaagcccccacacagccggtcggggggctgcctgagctccggaggtctggctaccgaaggctcccccctgcctgaggggccgcctgggatcagcgcactgtctccctctgggcgcacaccctgcgcttgctgctaattaattttgcgttgctgccggccttttcgttttcctggggaggggcgggggtggggcgtgtgtagtcaccgccctgtggacatcactaggaagaggtggcccttggtgggacgtggacttggggcccagagggaccccgggcagatctgaggggcccgaccttctctagggggccccaggggctcggctgcctccatccaccccagtctcggcctgggcagggctttggtctgtgcacctgaagtcagtttctggctgtttgtttggagatcaccttctcaaatgacctgtgttgcctggtcaggctcatggggcaaagtggacagccaaggccacgcccaccactggccaagcgcaggagacgggtgcctgtcgccgcacagtgctctggggattgctggtgctgcccggcctgcagggtacaggagccacaggccttgactgtgaggccacaagctcctgaaccctcagccacagacgtccatggccaaggg

SEQ ID NO: 35573 - DNA, 1033 bp, Homo sapiens
caggatgctcttcccaggagccctgggcctggccccggccaggggaggggactgccagtgtgcagggctgaggcagtggtgggggcaccggtgtcagggcgcagggacgccctctggactttgcaaggcgcccgcccccagagtaggcggctgggccatggggttgagaagactgaggggtgccacccaggcagggcttggggacgcagggctacgccacagggcagggctgccgaggccacctccctaccatgcatgggcttcggtaagacccagtcaggccctgaaggactcaaggctgaggtgctggactcagggcatgaaagctgcttcccaaaggggcctggacaccaggtgggccgtcagcactgcactgagagctgaacatggcctctgcccacagacacaagagccggtgggagggtccgtgccgaggacacaggtaggtgtcccaaccctgggactcacgaagccctctcagatctggagttctcagcgccagtcatggccaaagtgtggctctgtaatcgtggggtcctgagtgtggccgctgctgaccctgagatcccacaaattcccccaaaacagccagaaaaaaatccaggggcactccctccactgaggaccttaagggcctcaggccccacccactcacccctttccctggaaggcaccaaaaatgcagatgccaacccagcggaggatgcaggggcaggatcctggtgggggctgggccgcgtgggggcaggatcctgggggtggaagggccgcctgggggcaggatcctgggggtggaagggccaggtcaggtgtcgagctgggaacagtttccagttttatcgctgacaccatttctttgtctgaaacaggagcttctcacaggcctggtctgtgtttcccctgggcctctgcagcaggggtcgctggacaggaggagcagctgagaaattaccagaagcaatggtgggttttgtgagcacccagaacagtggtgggtgtgcgggtcagagagaaagaaccttctgggatgctt

SEQ ID NO: 35574 - DNA, 1053 bp, Homo sapiens
catggacatatggagtggaataagatgacactggaaactccaaaagatgggagggtggaagggggtgagagttgaaaaattacttcttcagtacaatgttcactattcaggcgatgggtacactaaaagcccagatgtcaccactatgcaatatatgcgtggaagaaatctgcacttctaccccttacatctataaacattttaaaactctgttcttaaataactgcatctcagaataagattttatcttatctgcctccctgaataaggtttacccaggtgtggatttcttctttttatttatgcagctcgtcataaatcaactcttcatatacctgtggattcatgtcttttgtcagttctgtgaaatcctcaggaatatttataggactacagaaatatccaacaccagagaagacaacaatttttgacaaccaatcagaaatattaggcacacaaacaagtgggaaaataggagccataaggaggcaaatgagtctattaaaactgatccagaacggacacaagggcattaaacaatatcaaaactacattccacgtattgtaaaagctaatttgaggcacagaagatataacaacactctggatcactgttctagaggtgaaagctagaacgtataaaatgagaactgcactgcatgggattaatggcagattagatgttaaagaagaaaagattattcattgtgaaaccatggcaatataaactatccaaaatgaaaccaaaagcaaagaggatttaaaaaaatttaagccaaattatctgtgatctgtgggacaacttcaagtggcttaatatatgtttaattgaagtccccaaaggacagaagaaaacatgaggaatgagggtagtgcattaaaaaagatgtttggaaaaataatgacaacatttttttccaaattcgatgtaaactagtaacctacagatgcaagaagttcaatgtacctcaagcacaagtaccattgaagaaaattacatcatgtctcattataatcaaatcgctcaatcccagtgataaatagaaattttaa

SEQ ID NO: 35575 - DNA, 1047 bp, Homo sapiens
gcacggtggcgggcgcctgtagtcccggctacttgggaggctgaggcaggagaatggtgtgaaccggcgaggcggagcttgcagtgagccgagatagcaccactgcactccagcctgggcgaaagagcgagactctgtctcaaaaaaaaaaaaaaaggaaagtgagatccttgccaaggttgaaggcagtgagggaatgagcgaagtggggctgtagaattcccagaaggccaaggagcagcgagagcaaaggctggggggtctgcgtggcctgtgttggcacaaggccactttccttcctgttggcagcctgctggccatcgtcctgccaacctccttgccagatagggcaggatagaattgggtcaccgacagccgtgatgactgtggtgcttgcttctcggccacaacaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaaggtacctttattttttttttcctcttgatacaaatggatttcttatatgttcttaattaattaagatagcttaaaataagctcgttccagtacggaggatttcaacatatgcattaactcccttcttaaattgaaaactagttttgtatgtgacaggttgagctgatagttgaaactagggccactgactcaatatttttgttcttttggcacaatacagtcatcattgttcattatttgaggtaccagtcagtgtaggggacgtcagtgaccggctgtgtttacctggctggctgcacaaaccttagttctcagcttaccccgggcttttccaatgccctgcctctcgggggcctgtatccttacctgaaagaggaaacatcacgggcgtagtatgggcctggttttggtcacggggtccacatgacgtcacgttcttgagtcgcctgttgtgatgataggcaggaacactgttgccgtg

SEQ ID NO: 35576 - DNA, 1065 bp, Homo sapiens
accaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaactttaagcctgatttatggtgtggggaccttatggtgtaactgcatcatccagaagaaattgggaaggtgccagtggcccaggtgcagattcaggaggtagatcaccaaggccaaggcatatgcaggttctggtcaccgtgtcgtc

SEQ ID NO: 35577 - DNA, 1742 bp, Homo sapiens
gcgtctgggcctcagcgtcctggggtcctcagagggaccccatgtccctctgcccaccatcaccgcctgctctcttggctgcccaggtgcacccagctcaactgtcccgagggcgtgccaggccagtggccaggtccgtgtgccctgcacccttcagggcagccactcatgtctgagaccagccagccccagacagagctggagcaggggccatttcagtggccctgattttgctcctgagggctgtggtgtaacacgaaagaacgttgctgtaggcttccagccgtgggattccagggctgtctttgccttgtgctgctggacagagcaggacctgcacctctgtttgtcacaggcttgtcctgggcaccgcctcaaaaggaggaaacaaaaacagaagggctgagtcccggagccaggaccccaaaccagaagtccctcccagagcccacagccccccaccacggggccgccctgcagccccagggcctgagctgctttctggatgctgggagaaccggacagtggctgctggaaggcaggcctggagggctctgggtgctggggtgcgggtgaggccgggcatgggtgcaggcctgtggtgctggggtgtgagagatgctgggctggagtgtgggagaggccaggcaggggtacagggcccgtggtgctggggtgtgagagaggccgagctggggtgcagggcctgtggtgctggggtgtgggacaggccaggcaggggcgggggctgccacttgatgtgggtgtcaggacagtgtgtggtgaggaggcatggaggaagcgtggccccccagaggcttccaggctgggcagccactgcaaaggccctgaggcaggagtaggcctggaggacgggacggtagcaggcaggggctgcgagagacacagcggaggaagaagaatggcggcccccacccatctccctctgccagaaggagccacgggcacagcctacagatgtgcactggtctctgtgctgtgggaggccagacctggtgtctgtgaggagcaccacagctgcagacctgccggatgaccctcgggtgacactttggggtggaagaccccacccaccctgcaagccatgttcctcgggctccgagccccatcctcacatctgtggagcaggtgggaccactagcaggggcttctggcccttcctctcctcccattgatttgttgaaagcgatttaggttttctgtaaaacaaagcggacatgggcctggggaaggtgcttgcgggtatttcatgagcttttctaggcctgagacatgttttaggtggcagcgggctcacgtgtgttggggggagagactggtcacagtcagggcgactcaggggcttgtgctcagatggtgacgcccagcccccttgtccccagggtgacagggagaggtggcaagaactggcagctgcccacaggctgagccgagcccagcagaaaggcccaaggccggagcacagaggtggcctggatgcttctggccggtggtcaggaccctgccaggccttgcttggaggcatcttgtgtatgaggggagccctgcccatgccaaccacctagctgtgcccaggggaagccgccccagaggcccattctcggggtctgtttgcctgtcgtggggagagagtgtcacaagctgggcccacagggaggaacatccttggcctccgaaagggcagagagcaccatccctgctttggggcatctaggggagca

SEQ ID NO: 35578 - DNA, 1043 bp, Homo sapiens
gtccctgctcttcccaccctctgtgggcgtcccagcccattgtccctgctcttcccacccgctgtgggcgtctcagcccattgtccctgctcttcccaccctctgtgggtgccccagcccattgtccctgctcttcccacccgctgtgggcgtcccagccctttgtccctgctcttcccaccctctgtgggcgtctcagcccattgtccctgctcttcccacctgctagtgggcgtctcagcccattgtccctgctcttcccacccgctgtgggcgtcccagccctttgtccctgctcttcccacccgctgtgggcgtctcggtccattgtccctgctcttcccaccctctgtgggcgtctcggcccattgtccctgctcttcccacccgctgtgggcgtcccagccctttttccctgctcttcccaccctctgtgggcgtctcagcccattgtccctgctcttcccatctgctgtgggcgtctcagcccattgtccctgctcttcccacccgctgtgggtgtcccagcccattgtccctgctcttcccaccctctgtgggtgtcccagcccattgtccctgctcttcccacccactgtgggtgtcccagccctttgggttccttgggatccagacatcaccctcagccttttcctgagaggcccagctccagcccgtgtgccatatcccaaagctcccctccctgagccacctgccaggcactcacttcattctaccacgtccagcatcctcccagcccccgaggcaggaggtcactgctggcctggacgtggccttggtcctgcccagccgcatcccaggtgcctcccgagtgccctgaggtggcggtggctgcagcctaagcttggcaggcgcctaccttgctcctcaccacttggcatcctgcctgagccccacaaactggccctcgatgccacgacagccccgtaattctggcagccttgggcctggcagcccagtttgtaggattagccctgcagaacagggtggccacaggggtggtgacaatgaccacaggacat

SEQ ID NO: 35579 - DNA, 1064 bp, Homo sapiens
tgagtgtgtgaatgaatgggttagtgtgtgaatgagtaggtgagttagtgtgtgaatgagagggtgtgtgaacgagtgggtgagttggtgtgtaaatgagtgggtgtgtgaacgagtgggttagtgtgtgaatgagtgggtgagttagtgtgaatgaatgggtgtgtgtgtgaatgagtgggttagtgtgtgaatgagtcgggttagtgtgtgaatgagtgtgaatgagttagtgtgtgaatgagtgggtgagttagtgtgtgaacgtgtgggcaagttagtgtgtgagtgggcgagttagtgtgttaatgaataggtgagtttgtgaatgagtgggtgtgtgaacgagtgggtgagttagtgtgtgaatgaatgggttagtgtgtgagtgggtgggttagtgtgtgaatgggtgggttagtgtgtgaatggatgagttagtgtgtgaatgagtgggttagtgtgtgaatgagtcgggttagtgtgtgaatgactgggtgggttagtgtatgaatgagtgtgtgaatgggtgagttagtgtgtgaacgagtgggcgagttagtgtgtgaatgggtgagttagtgtgtgaatgagtggctgaacgactgtgaatgggtgtgtgaacgagtgggttagtgtgtgaatgaatgggtgagttcgtgtgtgaatgagtgggtaagtgtgtgaatgagtcgggttagtgtgtgaatgtatgaatgagtgggtgggtcaatgtgtgaatgagttagtgtgaatgagtgggtgagttagtgtgtgaacgagtgggtgagtttgtgtgaatgagtgggcgagttagtgtgtgaatgggtcagtgttttggtgtgtgaacgagtgggtgagttagtgtgtgaatgagtgggttagtgtgtgaatgagggagttagtgtgtgagtgggtttgtgaacgagtgggttagtatgtgaatgagtgggtgagttagtgcatgactgagtgggtgagttggtgtgtgaatgagtgggttagtgcatgaatgggtgggttattgtgtggatgagtgtgaatgggtgtgtgaacgagtgggt

SEQ ID NO: 35580 - DNA, 1032 bp, Homo sapiens
gccggtgggttagtgtgtgaatgagttagtgtgtgaatgagtgggtgggttagtgtgtgaatgagttaatgtgtgaatgagtgggtgagttactttgtgaacgagtgggcgagttagtgtgtgaatgggttagtgtgtgaatgagtgggtgtgtgaaggagtgggtgagttactatgtgaatgaatgggtgagttagcgtgtgaatgggtgggttagtttgtgaatgaatgggtgagttagtgtgtgagttggttagtgtgtgaatgagtcggtgggttagtgtgtgaatgagttcgtgtgtgaatgggtgagttagtgtgaatgaatgggcgagttagtgtgtgaatgagtgggttagtgtgtgaatgagcgggtatgtgaacgagtgggttagtgtgtaaatgagtgggtgtgtgaatgagtgggtgtttgtgtgaatgaatgggagagttagtgtgtgaatgggtgagttagtgtgtgaatgagcgggtgtgtgaacaagtgggttagtgtgtaaatgagtgggtgtgtgaatgagtgggttagtgtgtgaatgagtgggttagtgtgtgaatgagtgggttagtgtgtgaatgagtgggttagtgtgcaaatgaatgggtgagtttgtgaatgggttagtgtatgaatgagtcggtttagtgtgtgaatgagtgtgtgaatgagtaggtaagttagtgcgtgaacgagtgggtgagttagtgtgtgaatgagtcggtgagttagtgtgtgaatgaatgggttagtgtgtgaatgagtgggtgggttagtgtgtgaatggatgagttagtgtgtgaatgagtgggttagtgtgtgaatgagtcggtgggttagtgtgtgaatgagtgggtgggttagtgtatgaatgtgtgaatgggtgagtgtgtgaatgggcaagttagtgtgtgaatgggttagtgtgtgaatggtcgaacgagtgtgtgtgtgaatggttgtgtgaacgagtgggttagtgtgtgaatgggtgagttcgtgtgtgaatgtgggtg

SEQ ID NO: 35581 - DNA, 1077 bp, Homo sapiens
ggcaaattccaactccagctgtcaaacataaggggactggtaggctctccagggtggattgtctcacggcatccagaggcagggaccgaggcagggacctagccaggcctcgggaaggagctgcaaacccaggagctctggggtgtggcttcatctccctccctccctaccaccctacccccatctctccgtgttcttcagatgcctcattttcctgtcaggcacctggccagctctaggagctggaatcaggttggtgcctccttggtcagtgtccacccctagtgtcatccacagtgaccaacggaaggggtggccggtggtacaggacattggccatcttgggaaagatcacagagacaggaagggcctctccagctgagcagatgagaggttcttcagtggtctggacacatttgcccactcatggccgtccccctgccctgttgagagaaccgatgaggaaagggagccctgcatctgtcgccttccgactccgaccgcctgaggctgggctgccggcaagccgcggcagcatatgacagcacttgaaagaaagtccctggaaagaatgtggatcattgcagaactccctcaagaaagcgccagaggaggaccccattcagcaccccgcagaactcctcaaactcctgcgtccacactcccccagcgtggtggctgcttctatctccccaggcttagctggcctgggtcttgaaggcctctcctcctgctgtccccacgcagcatcctctctgccactgcacagctggatgcagtgaaggccaggcggctgtggctgcttgggcaacaggagctgcttgaccctgttctgctggccttgttggcctcactcccgtagagagccaaggttacccacgtctctgaagctaaggctttctttctaggcctgggggagtcacatcttgcattcgtactcactgagctccacgtctatggttagagaatttatcaacattttataatgcttttatcaattccatcatttgagggccctctggcaaggaacctgttagtacatggagtgcctggaatgttccagaaagctaacatgaa

SEQ ID NO: 35582 - DNA, 1051 bp, Homo sapiens
tcaatgagctcctgaattcgtaattagatcaggcatgcctccatgattcctgaatttgcttcctgaaggatgctgtgaagtgtccttcacagccaccttattcattctttttcccactttggttagcctggtgttcttcttgttaacaccgtagctatccctaaatcatgtattttcccttctccttcaatcttggttacgttatccattcccagtgtgtagtttttgtacgtctattccagagctacagggcattccagaaaagctcacatgatcatgaattgactataaattcacattctcaaaattcagctggttcactgttgtgtggtttgatgggtgggtgtcagaaaagtttgttttatagtggttgattatttggcaatgccacttgagtgttgggttgagaaagatcctgaggcctgatgcacattcagtggaagagtgtgccatgattgattagtgatgtctaccaggatcatggtggtggagaggggcttgtgtctggtgggtttgcctctcggagtagaagctgtgtggacttgcagtctaaaaattgtgaggttgaatcacagcatgggttcagttttctcatttgtgaaatggaaccatgtgaatatttttaattgaatcataagtctccagtgatatcacactgtcagttgtcgagtaagtggtgtatagggtaagtgctctttctctccatcctcagaaacccttttctgtttgttgtttgaattgttagtgtattcccagtagaagcatctgttccatgtgccacattctccaatgctgtatcccagtgattcacacaaaggagctcatggcattgcgaatgggacatttcttccgtgtgcaggctgtcctgggcattcttgttaggtatatgaacttgacatttggaaggtggaaaccgatggatgttgaaaggatttgcaggccctttggtttcttttggcagtgatcgtggagaaggggaggtttctcttagtgtggatgcggtatggtttcttttagtggtgaccgtggagaaggggagaaaccgatggat

SEQ ID NO: 35583 - DNA, 1049 bp, Homo sapiens
tttggggaatgatgggaaggaactctccagaaatccgagtcctcaggtgacagccaatggcccaccttgcaagcaggtcttgctaaggatcgtgttctcaggcctgctgggttaattgtttgctgcacacacaccttggagcttggggagtgctacagccagctggtagaggccagggattctgccgaacatcccgtcttccttctagcccaagatgtcagtagtgctgaagttaagaaactgtcttctcttacatatttactgatttgtttgagcagactacatatcccattatcatctgtatttatttgtttgctatattatctatatacttactaccttagcataaccattttcctggctacactggccatgtcttctgtcatgtcctctcagctggtatgcctgctagcttgctccttgccctgtgtgctcagccaggtgtgattctacttccccaagaaaggaaggaagcatgggcatcagcattcacagtgacaattcaggagggtattgtatggataaagttaaaattgtctggtagaggggagaagtaaatgggaaacaaaaagtcttgagtaagagagtgggctgctctgggaattgtgttagtgaattagtatagcttaagaaatcacccagaaggcaaagaaaagatggtagttatgagagaaaagaggagagaattgaaaataagcctgaactttccaatagactatataatagaagctctagaagaggagagcagggctgctaagagaaagcgataatcgaggaaacaacccttagtatctcctggagaggaagaacaccttgaacctcacttcttccatagcagctggacctgtgcaggaatgaatgtgggtcagaggagcctgatcgcccttcacccaggcacaccctgctcactttcacaattgcgaggttcattatttagaggccttggtttcagccaacataaatgacatctgaatctgattggaggaaaaaaaaatgttttatcagagtattacaatatctgaccacagataatacagtatctgaccaga

SEQ ID NO: 35584 - DNA, 1047 bp, Homo sapiens
cactttttggctagtttgaaatagtgctgctataaatatcagtgtgtaagtttgccgtggactctattttcagttcatacctaggaatgggactgttggatcgttgggtaactatttaacattttgaggaactgcaaaactagtttgctcagcagctgccccattttatattcccaccagcaatgtatgaggaatgtattcagtttctccacatcatcatcaacacttgctattgtctgtcttttaattttagttattctagagtgttcatttttaatttttaagttttttcaattttaagagctctgaatattcctttcaaaaataacttgtttcgcaaatataatattatttatctcatcctattaataaacattttttaagttttcttttcagtttttgtttacttcaggttgcttttgcttgttttagcctctttcacactgcaggtctgtctcatgtttggaagtccttgcaaagagcgagtagcagatacactgaggatgtggggcttctggaccctgagtgtcaaggcaggacagtctggttgggccatttattgattgaagaatgtctagtgtcattacctttagatattatctgtaagaaggtatttcccttcttcttcctggaagacagaaggactacactgtttggaagcctaatgaagagagacaggcagccagtcttagaccactgtgcttaggtttatttaatctttatgcttttgacatagtacacctgccccaagggtccctggtgttacagagaccttcaaaaagcaaacctctttctgctggatgggggaggagtgatttctctgaggcatggtggatggttggggattgggattaaatgcttatgagaaagtttgcaactagtgcttgttttagttccattccccttcaccttctcaaaagaatccatgttactgattctcaagcttgttgaagttttgcagtataaatggagctggttctcacttttccccactgctggctttcttgggtgctaaatcagtactcttgagtctgctttccagtttcc

SEQ ID NO: 35585 - DNA, 1035 bp, Homo sapiens
tttcagctttgtaatagtctcatgaatgtatgagccaagatactactcagatctaaaggtttctaaataaaaggcttgtatatcaacgtgatgcttttgagaaatttaaggtgatatagtcattaatttagcatgcatttgtttcaggaaatctaggaagtctagagggtgccttgcatggattgaaacataattttaacatagtatattttctaaattaaaaagtaacctaatttttcttttcttttttgcagtaatttgttaacagaatatcagaagaaatgtgatgatatccttttactggctttttctgttgagttttggaactaacttatgtttaattcctgaaagagatgtgagaattgttcctcataggccttctggaagatagtacttaacaggcttcagtagggagcatgtctcacaagcacagtaaacagacagtccttttattcttaatccatgtttaatgatgagttttaaaaatgagattacttttcttgttgattgtgattttcttaacgtctcataagctttttagtgggtgggtttctcttaatttgtactgaggatgtggcatgttttttaggtttacgaataatgtgaaactgaatgtgatacttgctgaatgttatttttgaatctgcaagaagtacagtatgggaaattcaaaatgttgggcaattgactttcattaattatttttgtgatttacagggaaatgtgtgtgtatatatatatctccaaaatcatagaaatagcgttgctgtatattcatgaacgctgtgggcagtcagaagacaattcttggccttacagtcaccacttgttcggtagccatttaatgagctcggttgtggagttagtgtctggtcagctatttttttagcagtgggaaaaagatgtgtataattgatccttccatgtcttgctgtggtaataccttgatttaaatctctcctgtaaaaacttaaagtttctctcataaaagtaaacatacgtatactcctttagggagtccctgaaatttagctt

SEQ ID NO: 35586 - DNA, 1032 bp, Homo sapiens
agcgttaaggaagacctgagtacataaacatgttcctggatgagaagattcaaagcataaagatgtaaaatttccccaaatgtatttataaatatacagaaatattcaaagtcccatagatgttttctatggaagagcacaagcagatggtttatagggaaaagtgtatgttcagaataatacaatttttcaacaggagaaaactgaataatgattacgctctaacagatattcagtaacctaccctgattaaagaagtgtggtatggatacagaaaatgacaaagcaatgaagtagaaaataaattaaataaataaatatgtaagtccttaaatattcatacatgccttagagtttgataaaggcagaattttaaaggatcagggaaagttgtgcaattcacttgaaggaggtgttgtcttcacaactaagtgtgaagttaacgctgaagatgtttttctgctttgttgggaatagagtgcttttatttatttattttttgggtcagattagcagtaatgaatgctcagttacaaaggcatagctctggatgatagcctccataagaatggaaaagtaactttttttctttttttttaaggttccttgtttgctgctttgggtatacgtaataagcagggatcctggtcaggtcatttaagcaaaggggattacagtatttggaagcaggcttttgggtaggttatatcacaatgtagataagctactcgatcacagaattttggaactgaaaaatggatatggctcacacacagtggcaatcagaaggttgttttggctcaggagagttggcagtgtccagcctttcacacttacccgtgaactgtcctccacagttgtcctgcccctttctgtggacttcattttttgaagtgatgcagtctgccagcttaagtagagctaatctcttacaaaatctgtgattccctgagacatttgggtttttaaagtttggtcttttaagcttctcttgaactggagtaaagatttcactaatatcagtaaatgctt

SEQ ID NO: 35587 - DNA, 1024 bp, Homo sapiens
ttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactgtagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggca

SEQ ID NO: 35588 - DNA, 1076 bp, Homo sapiens
gtattttaaatttaaacagtatatagagtaaattagagtttagaaaacaagaatgagagtagaattacatactgtatttcatatactcacacagattacataaggcaaaacccaagaaattatgattatttgactagtggtagtgacagtatgcagctaggtcttttgagacttgcattctggcatctgcagcatttaccagccataggaaacagacaggcgtggggatttcttcagtacccccgacctcgattctcatgatttaccatgctaggtaagttcttaccagttactatgctctaccttctgatgtagcgcaagttttattttttcaatagatacttaagttttgtaacttttagataatctttggtaggctgaagataagtatgagtgtacattgcctttttaatttttttttcaatccagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaaggtatgcttagattgtgacaattttgtattgaaaatatacgattgcctttttcccttatactggagtctatattttcagctctgattactgtgtgtcttttaaaataatgttatgttttgtccattgaatagctttagctatacccagctgcacctggtctttagtagggcttacttatatcagcactatatttccacttgtaaataaatgagtatctctcattactgtgtatttgttctatgctctgtgcagctgctttagaattagatatagttgccttaaagtatgggatactttaaagtaagtgacaagccaaactgctgtaccactaggtggaaagggcagcaactttaagatggaattgtaagctgatgaaaagaagtagatgagagaaagctgaaaggagacggtgacatgagggttgtcctttgattctcttttctctttactatttcttccatccctactagtggatcag

SEQ ID NO: 35589 - DNA, 1029 bp, Homo sapiens
tagctgggcgtggtggtgggcgcctgtagtcccagttactcgggaggctgaggcaggagaatggtgtgagcccgggaggcagagcttgcagtgagcggagattgtgccactgcactccagcctgggtgacagagtaagacttcatctcaaaaaaaaaaaaaagaaaaaaaatgctaccttcatccctatcacattttcttgctttatttttctttagtacctgtcactagtttttgttcaattctgctattgtcatctctctccccagtagaaatgactctggaggggcggagggtggccttggttggcttgtggcgtatccctagcatgcggaacagtgcccacacaaggggagcacctggcgaatgtatgttgaatgaaattaattatcattatcgtaacatacagatactcacaaaacctaaagggaagagaaatattcaaaattataaattagcagcttctgtcacctgggagaaaattaagctctctgacattcattgtatgtagtaaattaacttttctctgtgcatctataattctggcactagctttgtaccatctctgagagaatggagaaaattgtcactcaaataatttttctgtaggtcttaattttcttgtggaaccctggctgagaaaggctggtttaagggagttggtgacattaaaaaggatgcatcaaaggtttgataatccatatccttgagatacttgaagctgtggaaattaccttgtccatggatccatgtgtgtccaaggatgtctgttactcttgttcatcatcttgacactaagggaagattagacatctgaatgtcaaacagtaaggaatcaaatcatggcactcctgtatgagatgatagctatattaaaacacatagctatgaatggattactatgtattgacatggaaaagtatttcccagtctgttactaaataagaaaatgacagaacagtctgtccagtgccagtctgtataatgatgtgtcagggcctgctgtgggcctcagctttctgaatcctca

SEQ ID NO: 35590 - DNA, 1073 bp, Homo sapiens
taaaatgtgccttatgtgagatccactataaaaagaacttgatcactaatatactgcatacaaagtcaatttgagatgaattatggacccaaatgtaaaagctaaaacaatcataaaacttctagaagaaaacacagaagattacgtctgtgatcttggggcaagcaaagattttttaggagacaaaaaacatgctgataaaattaaaaaacgattaattatacttcatcaagataaaacaatccggccaggcacagcggctcatgcctgtaatcttagcactttgggaggccggggtgggtggattgcttgagctcaacaaatacgaaaattagccaggcatgtggatcgctcctgtactctcagctgcttgggggattgagctgggaggatctcttgagcccagaaagcagaggttgcagtaagccaagatcataccactgcactccagcatgggtgacagaatgagaccctgtctcaaaaaaaataaaatcttcatcacaaaacattatcaacaaaataaacagttaagtcacagactgtgagaatgtattcataagaaagaggatttgtatccaaattacatgaagaacttctaaaactcaatgataataagacaaagaacacaatttaaaggagaaaaaaagcaaagaggctgttcacaaaagaagacataaaaatggcaaataagcacatgaaaacctgctcaacttcatcaaccatcaagaaaatacaaactagacaccccaggagctcctaccgcatgctgccctagaagacctgcaatgcccaaggctgactgcagcaggtgctgggaggaatgcggagccctgggatgcttatctgctgctggcaggggtggaaaatggtacagccactttggcaaactgtctgtcttctcctaaaataatatacttccatcctatgacccagtgatgtcattcccaggtatttgtcaaaaataaatgcaatatattcataaaagttcctttacaaaaaagacttttataatagtcaaacctggattgtttaatcaacacgtgggtaaattatgctttgctcatgcacttgga

SEQ ID NO: 35591 - DNA, 1014 bp, Homo sapiens
tggctccagctgcagccagccaccctcagtgtgtcagaccatggggttgaatgaagagaaccacatccagaatgggacaagctacaggttctggaacagaagggacatcagagtgggagttgagggggaagagggcaggaggagcagctctctcattcttctgagggacgttcaattgtcctgctgtggactgtgatgaacccaccttcatctgtcctccatcactttgcccctgctttttccactccccttgtctcttcttccctccttttcaaagtcacagagaggtgaggagtctgggtggcgccaggaaggctcatccatttcctaacacccctcactgtcagcgctgacaccacgaaagcctgcagcctcatactagccgtgaatccatgtcctctgctgatctgatccggagtgcgtttatgtcactgtctctacaaagcacatgaccacctggattttacccgttgctctgggttgcctgttcgtcagggcccttggggaagacaccccccactctcccactctgcctgtgaataccccccactgggtccagcgcctctgggcgcacccttgctgttccacccctaggactttgcagaattccagagccagggatttccttctctttctcttggataagcactgagctttccccacacagcctaggacccgcccctcttttcagctttcctctcgccctttcttagggaggctcgctgtctaccttccccctccaccctggcaggtgctgcgcccctcagttctgcgtgaagaccctacacacttccttcattgacttctgctccttccggtcggctatcacctggaccctcctggactgggcttttgcctaagaactttccaaaaaccacacaaaatagtgaatggcagtttctccaataacaattccaaattatctgaaaatagcaaaccatggctaatttctaatgaacaataatactcttctctatgactgaaagggaagtgccaagcacagatgtgtgagag

SEQ ID NO: 35592 - DNA, 1048 bp, Homo sapiens
aaaattatgtttacatttaaaacgccaatattctatcacgattgtaaacacagatggagagcaagggaagccactgtttattcaccacttgcctgtgctctctctgttcttgtgacctgatggattgtgcagggtcgtagtaaggaaagggaggttgtcctggggccaggtcgctgagtatgcagtgggccaggtcccactctgcagcccctaagggcctcacccataatttgaccttgaagagaaacctcttcaagtctctctgcctcactcttctcttctgtgaaacaaggaggacaacagaaccgccctcacaggtaaacgaagaattggagatattgaacgtaaaagtgcacagcacgatatcaaggatacaggaaatgggcaataaatgctggcttctctatgcttgattctcacaagcccatgagatagagctgagtgcttgaaacccatcctgcactccccagaaggcaaagcctgggcaaggctgcccagctccaagtgggggccctggaattaaaccctactttgctgttctgtcctctgcttgaactgcccccttcgctacacaggtcccatccttaagggcaaacatctgcggagctgcagagtgggacccactacttagatcccttgtggggtcagcccaggacgcttgcaccaggcaaacaccttctgtggttccagccaaatggtattaaaagccaccatggtgttttcagttgttttcaaaggccctcagcagaaaccagggctttccaaatggggagtgtttgtctctgtggaaggaaagcatgttggaaaacaccagcaatcttttcaaagggcacctggacatgagaggtcactttctgttcctttgtagtctcgatgtaaacaagagaattcttcagaaaatggtgtggaaagttgtccccagatcccctgagatcttacaaaatgttatatttttcacgtgactgagttagatttactacgagaactgaaggtggaagaattcacacaggggcacatgatagttacaaggaagcgatggccccgggtc

SEQ ID NO: 35593 - DNA, 1067 bp, Homo sapiens
acttgttttcattaatctttcttaaacgtatgcgtagctcacatttatgccagtgcttaacgttagacatgttttgggtctttagttagcagtttggtagtttttttgtgatcagaagtatgccatctcaactcttgtttacatcaattacttattgtaaaattgattttgttatatgtcattttgcttaaagtcccaatttccaataacctatggacgaggttaagtgagaacttactgtagatttacgttttttttttctcttttccatttctaataccttactatgcaataatggatgggacatcatctttggggtcagacagacccatgcacaaattctgagttttctctggcctctatatgtctctgttttacttgacttttatatatctgtgtcctggtctctaacatgatggtcaagcacatagcttttagagttgtgaggatgcaggaaggggccccaggaagggcctcctggagtgtctggctctgggggccttggacacgctcatgttgcgcctggggatctccttcatgcctttctctcctcaccctgcccctattggtcctgcttcatgtcagcccacaccgtgtaagaagccatccctgcgatgatatctaccctgcgtgttgcacccgcatcacagctttctgagtccaaacatcttcaggggttcaaagccaccctggctggtccccatgatcatgtcctgtctcatctgctatctcccgaacatcccaggccctgctccttcctatctgccttaatcccagtgctctctgggccgcctcctcacagcccaacttcacattccttggaagccacaacaactcctccctctgccagtggagcctcggctgccctccagggcctgctgtggccctgctctccccggtctctgtggctcctggggaccctggcactctctgcacccccagcctggagggcagatggccagcatgcaggaggagtgtgcaaaccaacatcatcccaagaggtggacagtgagccaggctctgctttctgtgtggacccatgactgtggaaaaatcacactgtcctt

SEQ ID NO: 35594 - DNA, 1034 bp, Homo sapiens
gtttgctctcactttaaaccaggaacctcagccctgacagtccagtttactggttcaacagactccttgattttctctcacaggcagatgagagcatttcaatttacccctctcttttggctgggccggagcttcttaggcagagatctggagagctgagccttttccattcagttcccaccaatgcacttaggtggatgtagttaaacatttatggaacaccatgtatgtgcaatgtcacactcttggacttgcttacagttgttctctgcccttacaccatggcaggcaaccgtcttaccaccgtcattactgttaattgagagaggaacactaatgccgtatattccctagattttacagtttacgaattgctttcctgactgctttctttgatataaaactcttccttagactctgatctggaatcactctttatgaggattggcaattttggtctaaaaataaacaatctgcaagtaaaaactagacacagttttagagttgggggtagaacttgaaaatgtaaatgtttttgattgcttgtgattgataaataggatttatagtactgaattttggaaaatggtatttaccaaattattatcttcaccttagagaattgggctttttttttttctttcacaccaaaacgtactgaaagaacagaccttgagaatagaatgaatcagcagaggaagcacctaaagcagaaagaagcttttacagcgaagactattttgggaatttggttggttccctttgtgaggataattcatcatttttcttctttttttttttttctaatgtgcgcagcattttgttaaatagcattttggtaaattgctggcctccaatgtgattacaaaatgaattttctgaattataacccaccaaacatttttattattcaagaggcaggtgcattatgaagagctagaagttttttttgaccactaacttgctaacatttgttggtagtcctaattagttggcattagttggctcttggctaacgtccatccaggaggtgg

SEQ ID NO: 35595 - DNA, 1050 bp, Homo sapiens
gttttttaataaaggaaacttgtctaagtgtaaggaaacagtaaagggctctgcagctcagctttgtgaaatgatatgcagtgatgtcactaaaatccaccttaggtctgagagggggccacaccatggtgtcactgggaagcacaagtgcacacacatgtgcacacacacacacacacacacacagagacatacataaagcccatcttccaaaatactaggcctagaaatagcactttacttatgactgtaaaaccagcagtctcatcagaaagagtgacaaagatgaacagcctgttgggctcctaaaatctgtgggcttctaaccggctataacacagagattttttttgagacagggtcccctctatcacccaggctggagtgcagtggcatgatcattgttcactgtaatctttaattcctgggctcaagcaatcctcccatctcagcctcccaagtagttgggactacaggtgcacaccactttgcccagctaattttgtttattttttgtagagataggggtctcactatgttgcccagctggtctcaaattcctgggctcaagcagtcctcccacctcggcctcccagagtattgggattacaggtgtgagccacctcacccagccatacaacacacaaaatgtttaaaggccctgtattaggttgctggggctgccataacagaggacctggaagtccaagatcaaggtgtcagcagggctcatttctcctgagtcctgcctgcttggcttgtagatgctgtgtcctccctgtgtcctcacatgaccttccttctgtgtgtgtctgtgtcctaatctcctcttcgtgtaagaacacagtcagattggattagggcccatcctcctgacctgactttaacttaattacctcttaaaaaccctgtctccaaataaggtcaccctctgaggtgctgtgggttaggggttcaccatgtaccttggtgaagggaggagaaacaattcagcccataacacaaccaaacaggcatttcttaaccagttgctcatcttgtttctgcaac

SEQ ID NO: 35596 - DNA, 1070 bp, Homo sapiens
ctagaatcagaggttgttgctgccctagatgtgttgatgtagtcgggaggggagaggacggctggccacaagtgttagtcctttcttctctgccagtggttcccaaccctggcagcacattagatgccctgaggagtgtgcagattatttcagtaccagggctgtcccctcaaagactcagactttgtggtctaggatcaggccctgacagaggctggtccaaagagctcctcatgattctaatgggcagcccgggttggaaaagctgcctgacgctggccatggtccacctcctccctccccacccatctggcagacacagcctcacccaccagtaaccacagcccagagcttcagaagtggtgataattaatccccccaacctccccaccccacctggctcacactccctgtcctaggtcaaccctgactcagcgccttcaaagcccgacttctgtagagatgccatcctaaagccagccttcctccctggactgcttatgtagactacgagggagtgtaaaccctgaaaaagaaaatgtagggatgattccctccaccctcgatgagacgcagctgcggagggtggtgtgagcagaccctccagagccgtggctgacaaattaatacagcacgggaatcgagtgcctcccgtcatgcaggaacttcctaggcatcattgggggatcagatacacatcaagtgcctgccacagggaacgtaccctctaatggggagaagacaaaacccttcacatttgcttttgacctgccaagtggcttcacaagtatctttttgttaatatttaggaaatatccatggatctgacaatagacagtggcctgggtatatagtggggacatgggcacagtggggtcctgggatcagcagggtcttcagaaattccaagtgatgttcttagaggaaacactctacttaagggtgattgagactcgacattaacatggggcattagtcactcagtgttttttggaatacggtttcattgctgataaatggaaaggccaggcatgcccccacactgaccaagaagttgtagtaatggcaga

SEQ ID NO: 35597 - DNA, 1802 bp, Homo sapiens
actaccagttatggctaatatgttacactaacaatggtaatctgaagggttgcaataatactgttcagtcaggctggggctcgtagtgaaattttacggtttattagccataatcatcttgcaatttttttcctttaggttttggcttgtggttaacgggcatgttgataaacatccattcagatcatatcctaaggaatctcagaaaaccaggagatactggatacaaaataccaaggggtacgtacagaaagtgaagaatttctgtgaaagttgcttgccatggttcctggctattttagtgttgccagctctaagaagtagtagcgtagtagttattagctacaagttttcagtgtaagtcatcattattaataacaagtgctattgttattgtcttattagaataacaaaagacccaaatctagctaactgaacagttattaaacaaagcagaaactccagttatatctgtgcttgggaagagaggatgaggaagaatttatgattgacgaggagtgtctgacacttttgtttctagcagtataatggaatagatactttgaccctcctctgaaaacagtttaaaacattggaatattttgaaaatcttcttaaacgcatcagtatactatcaagaaaggaactaatcatcagaggacaagatctaggtgaatgttggaatctggagcgtgtcttttgagaatttgtgatgaggcgccgaccaccatgctggtttataacccagattcgcactacttgtatagtatgaaaaatctcaagccataaattaatttccgtggcctggggtagtggtggactctcctggccagcaaaagcccagatccccaaggggatgtgcattcaacctgagtctcaaagaacccaatgtgccacgttccacagagtaagaggcacggtcacaaggtacagaacccacaaggaagtacagcaccatgagggagagcgtaattcaacatgaaagatttcagatgttagaattaatggaaacattataaagtgagtacttgaaatgctttttaaaaggagtagattacaattaggagtaagaagcaatgtaccataaaaggactagaaaccaatagagcttcagaaaaaattttttaaagtacataaatctaaaactttaatggagaaagggcgtgacatcacttagtttgaaattcttccacttatgttcctagaaaccatatgagaatagcaacaaaaacaaacaatgctacaaacctcaaattacttaaactgtgaccctgagaacctggaatcagcaaagccagctccagacgtgatggtagtgtgatagaagtggcagagaagagaaaacatgacagagtcctagacaggctgctgatcacctattcagcccctgggtggattggggaagaatcctctctttggtgttgggcttatgagcaaactgcaccctcatggggtcatcccaaggagccgcttcctctggcaggtacagtggctgggagagcacagtgtaagctggatggtggccccctcgcttcctgcccagcacccttgcatggggaacagcatgattccaaattaatcggcaagtgttcatcccctgaaggagagggccctgtcctgaggaggagctgccatgagccagactaagaagggacagggcacagtcctggggaaggcagaatgaaaaggtgcagaagataccagaagccacagactggcagatttgagaaacaccacttccaaaagaaagggcatccccagagacggcaggatcccatgggagggccctcctgggccaggct

SEQ ID NO: 35598 - DNA, 1098 bp, Homo sapiens
aggatgtcaaggctgaagtgaatttagagaacatctttctaatccaatggatgaggaaactgaggttcagggagcagagtctgaggccagccaggagccccatctcattgacgggaagagatctcaggagcaacgtgggatctttacctgccctgacattggcgcgtgtccctgacaataaatgatggagactgggcttagcaagcggccagcctggtatgcacatttactatgtcccctgagccacccacttcatccactcaaaacatctaatcgaaatctccaatgctgctgatgctacgaggtgcaaaaatgtataactctgtcctacttcatggagtttatcatcttttttgggactaaggacagagagaaaaagctaaaagaagaatagattgatatggtatagtgggaagagtacctaggtgtacttcccagcctcaccacgagtttgcagatgcaaaggatgattattggagataagaagaagaaaggtcatatctgaagtatctctttgtctaattttttttttaagacagcatctcactctgtcacccaggctggagtgcagtggcacaatctcagctcactgccacctctgcctcccaggctcaggtgatcttcccacctcagccttccaagtagctgggattacaggcatgcaccaccaggcctggctaattttttatattttttgtagagttgtggtctcactatattgcccaagctggtcttaaactcctggactcaagtaatcctcacacctcagcctcctgaagtgctaggattcgaggcgtgagccaacgtggctggcctctttgtctaatacttgaagaagtgatagcataaatgtgagctctaagagcagcgccccgcattcttcgagacactccatcgtgccagtggcctggtattttcacgcatagacagtgaggagagagcgagatcagagagccacgacctacctaaatcccagagctgctgagaaaaacagaggggtctgcggaaagttgagtgagtgccgaaggcagagagggtttgagaaggaggctcaatgccaggcatggcagaaaacactgtgggccaggaatgggcctt

SEQ ID NO: 35599 - DNA, 1104 bp, Homo sapiens
tttttttttaacaaagagctatcaagccatgaaaagataaggaagaactttaatgcatattggtaagtgaaaaaagccagtttgcaaaggctagatactatatgatcccaactgtataacattctgaaaaaggcacaactatggagacaataaaaagaacagagttttggatgaagggagggatgaacaggcagaatacaaacaaattttagggcagtgaaactattattatgatactttatggatatagaatattatgcatttttcaaaacacatagaatatacaacatgaagaatgaatgctaatgtaaactctggatttttattaataatattatttaattaaaatgatttattttacttattttcattattatctaaaatgttatttaattattaaatttagatgctacttaatttttgctttattattattatgttaatatcatcaactgtaactagtgtacaacactaatgcaagatgttaataggggaaatcgtgttggagagagagatatgtgagaactctgtactttcttttcaatgtttctgtaaacataaagctgctctaaaaaattaaatctattaaaaaaaaaactgagtggaaaaagagcgttttgctcattggatggactttttgtcctccatgtgatggagtcagctggctgggcgtaaacttgcagaaggtgggagaaggctctgccagcctcgcccctgaggtttccatcctcccgtgctctgattcctggggttatgctctgttgcctctggtgagaggtggtcagtaactccatgagctgcttctggtgcctttgtgctagacagattttgcaaaggcaggtgtgtcaaccacaaccagaggccaatttccctggagtcagatttcagaccacatgctcctctcctcctcacaatgtagtctcctccccaggctgagccctgccagaggggagagttaggactggtgggaagggcttgcccccttggctgcaggaagctcaggtggcaccttggggacaatcctaaaaagatgctcttcttccagatgcctcacatctacctgtcagaaaattgtcacactgttctgatgtttcagaaaactca

SEQ ID NO: 35600 - DNA, 1034 bp, Homo sapiens
ctttaaagcgtgtgatacactgtaatagctgcatgttctgtaacttatttcacctggcttgggctacaagcgataccttctaaatttcccgaagtgtaaacatgcagtgcagacgccggcaggagcgcagactcctcttctctccctccagttcttacctgtagaactttctgagagcaggtggttgggagcagtttcttcttgatgaatagcaatatatacctaagggctcgcttggggaggacctttaggtttccagcctgttatgtaactggaatggactccgtttctcttagcactagaaaaaacaggaagacacgtggtctctgccagtcttgggttgtacctctgctcttagaaagtggtagcgcatcaggtcccatgcacctcacttgggctccccgagctgtttcctccaggtaactctagtcaggctcagtaggtggtgttgcttttgttagtgaatgagcccactaggatcaggtgctgtgctaggatctggggatctggggcagggacggcatgggagacacagtctcatgatcttgacccaccctgaaacctgcctgcaagtgccccctgcctagagcacaagagtaccctgctcagttgtgcaggtcccctctcacgctcttcgtcacccacgtccagtctctcatcacatgctgttcgtttggcccttttaatctctccacacctcatcctccctcatgcaggctcttgttacttctgtggagattgctcaagcagccggaggtgcctttgatgcactctggtcctgcttgagtcctttcccatcacaggtaatggggcaatcttctctgccagcaggtctggtcagattccccttcaccctgtgatgtcacctcccccatctccaatcccccacattaaagactaaagcctaaaactcagcaacacctccagggctctgctgctcagatgcccctaggtcctggctcctggccccaccccttgccaacccgttagaacctagctgtaaggcagtatggtgtagggcatgagagggctct

SEQ ID NO: 35601 - DNA, 1116 bp, Homo sapiens
cttttctggggaggagttttctgcccttggacactttgcctggtggcttggccttgtgagactgccagtctgccttctgcttcaagtaggatgaagaaaaagcaggtgaaagaggacagggattggtgcaagaaccttcagaggagaggaggtgaaatgcttcttttggctctggttcttgaatcattgtttgattgaaatctcaagcctttgttttgggagtggtgtgcttagcgtgagctgtgctatctacctgggcttctgacctagagatgttgggcaggtgtttggacaggccctgggccctttgcatcccagcctctggctgctgtcacttgcaagtgctctcatcccctgacccagcagggctttgggctgttgttactttgtcatggtcgttctagcagctttggaaacctcttcaggttaagagtcttgcataagtgagagtgggagcatggccctcagatatttggccacatccttactggtgtgttacagagacccaggaagaatgtagttgaacgaggacacatgcaggtgtcccgggccctgaacagcttctattcagagtttggcctttcgaaggctgtgccatctcaggtgtgcctgcagtgtgcagcaggtgtatgcagcttcctctttgcaggtttcttggtatttaatctcatcctttaatatcttctattaactcaaaggaaattctgttcttagtttgaagtctgagagagaccgacgactgtcggcataggacatggtcagccatgccccgcaaggcgtctggtgagagtcgtttccaacttggtgcatgtttttctcaattctttcttgcgaaggagtcacagcttggaggcgcaaccaggatcccccctctccctctagcctgacctcactgacataaagtagagcaggtgtgacctgtccggaacatccttgtgatgctcagcagggcctgctgcagagcacgggaggcatcactctaggggcctttccctcccatactttcctgtgagtgtccaggatgcatgagagaggttgttgtgagacctgccttaaagggtggcggtggcacgtgtggaccttgctttctgagtttcactctccgagtcccagagg

SEQ ID NO: 35602 - DNA, 1958 bp, Homo sapiens
ctggagagttggaggttgcagtgagccgagatcgcaccacagcactctagcctggtgacagagcgagactctgtctcaaaataaataaataaataaataaataaataaataaataaataaataaaagtttgcaggaaagccgtgtgaatatatgaaaatacagtgattgaaaagtcctgttcacgaggtgtcctgcattggctagtttaggaaaggggtctttcctatgcaggtgggggttgatgacttacccaagagtcacctctggaacccagttctcttaagttgatagcagtctatctttgctttgcagaagatgtggggaacacttgtcctgcaagcccaggttcgtagcaatgttggcttccccagaaccttggcttcagagcactgtgcctcctttaggaggcacaagaaaactcccacacggttcttccctctgtcccttcctgagccccctgagtgtttggctcttgtggagttgctgctattactaagttgatcccactgccctcctgagtctcctcagggaaggaggggctgtattgtagcccgcattcttagtgccaagcacacggtagccactaagtaagtatctcccaagaaagaagagcaggaggaggatctgccaactcaggagagcaggtgggggatggcaagtcttcggagtattcataaaccaaatgctaagggaaacttttgttgtttgtcttagaattttaaaaaataaagtctgttgcagtttatctgctttccttcctggagagtggctaaactagtgttctgttttacaatgtagaatgcaaaagcagaaaacattcaagaaaattctatactgtatttgaaaaacatcaccatttagttttaactgctctttgtttcttattataaaaattaatacctaactatgaaaagttagaaagcctggagaagtatggaggtgagttgtccaccattgggccactagagagtgccctatgagcctgtccctggtgtcctggactctggtggtgtgcactgcatttgctggcagtgagccagggggtgggccacatctgggcccgggcggggtggatctctgcagaagtttatccatctcttggctgacagggtgggcgagatgggagcagctctgagggtccctgttggcagagaatgtctttgattatcaacaacatgcctttttgttgtgggcttgtgatccttttctttcctaaatcagctgccgtgcataaccagttaggctctcctgtggcttcagattggagttagtttcccaagtgctaggatgtgggtgttaggtgatttctgtctttccgtttgaaagagatttcagatcattgtaacatttctggaatcctgtcgatctgaaggaatggctaggatgtagtagtttaagggaaatgaaaagtcgaatgtattttgatgtttctgcatcagacctgctcggtggagtccatttctcagcttcgggagccacgtgcttggctcttgagagcctagctccatcagcccatgtcacacactcacaggtctggctttagctggtttcgccatggtttctaacttgagcctcagtttccccccctgtgaagcagagcctgtggcacccacctcagagagtacatgaaagacttggaagcactctgtgagttgtcatgcgagagattaaaaaggccaccgctgcccttttctcctctctttaaggaaattgaaaccaaaaattaagtccttcttgccagctggacaggaaaagcctttttcttggtttttgaaaatacaacttccactttcagaccaaagtgaaaactgctaaagactgaatattctgagtcttgggagtggggggctagaggggtgttgtgaattgaaagatacctttctatttttaaaacattttaacaatgccttaatgatgaataatgtctgttctagttttgcatttgttagtttttttt

SEQ ID NO: 35603 - DNA, 1050 bp, Homo sapiens
ggagtattcttagaagttgcattctatgaagagtggagcatctgatgagctgtttactcgctgtttcatctgacggcagttgaaagacaaggcaggactggcagcgcagctgcctcagtcagcactgctgcactgggggcttgacctgcagtctcgcaatcctggactataactcattttgaagagagaaaaattaagcattaagtgattcaagcgtcttgcccaaggcgctactagaaaataaaggcactggtgcccagatgcaggtctgcatggtatgcaagcctgggcttcttcccacctcccccacagagagggcactggtatgttggagtgaagagccacgcaagacctctgtgaatgggcagagatgggccagtgacgcaacacagtaaagtgtattttggttataggcatcgtctctaaacttatgtaaaacattattaaaaaatggaaggacaacgatgaaatgatggccaaaaatatagaaaaggataccttgcatgtcctgtgaaatgcaaaggaattctaaagtgtcattatgagttacctcatggaagaaagcaaaaggtgaatctatctagagtttgtggttctgactcacaagagactgatgttcatgctgaaggacgagtgtgacaggtggaaggatagagcaccgagaccacactctaaagggtaggaatctatgggaactattcagggagatgaaagcatggaatgaactgaagcttgcagactcgttgagtaaaaagcgcgttttaggattggttttagaataaaataacaaggcctgtggttggggaagatgacttgctgttcacagagcctcccttaataggtggggacctcagcttttcctctgctgccatcaggtgagtggtgtacagtcctagccacagtagtaatcaccactggcctgactgagccctcaccctttatacagtgtctcctgccaccctcctgggagaggctgttctcggcacagctggcctggggtcacacagctggtaggtgtaaagcaggcattggagtccaggtagtctcact

SEQ ID NO: 35604 - DNA, 1076 bp, Homo sapiens
tgcttcaaagctagaggttgtttctaagagtgcttcgtgctaactaactaaaacataatgacattgtttttgtaaaactgatccgtggtttgttttttaaagcagaaagctctaaagtcactcagtcccaccacccagaagcacaagcaggtggctgccactgtaggacctctctctctaggctcgtgtagatggacacatggattggtcagtagaaatacttttattaaaagtcttatctttacataaatttgccaaattattaattttgcttgaaagggaaaggtgtccaacttcagttggaaatactagtttctaagagatactgctgagactaagagcataaaacatgatgaaaaccttaagtggctaagtgcagcaacgtcagagtaaaagctttgatgaagtcttggtttgcttgggctgtgtaggttggaggctcagcctttgtttctccctcctctggtgcccagtggtggtgtttgtgtccgtgaattttcaacctctgtagtttgtttgtagttatgaccactgttgcaccgaacccttaccgagggccaggccctgtgctaagcacttgccagtgtggatttattaagtcttcatgacagcaccatgtagggggagctgcgtccctgtgttgtacttgggacgcgatctgacctcaggcacttcaggctcctgaagggtctgcagtctcgtctctgcctgggaaaccacgatttgcagcatattccacagacctcatgctcatcatcaggaggcttcccgggactgctgcctgagatttctaagttcctaatgtggttcatgcttctggtgagtttctttgaggcgacgccccctgcgttgcctctggtcagctcagtcctgtggtcctgcagggcatcctacagtgtcctctgtctgtgacttgtgccgtgccaccttgacctggcatccactgtcctctaccgcgtttgcagataggagccactgttggtgcctttttgtcgtgtgtgttgaatggtcagggtcccaaatagctgattgggagcactctccttgaatctgccatgtgcctgggtctcaggtga

SEQ ID NO: 35605 - DNA, 1031 bp, Homo sapiens
cctaccttgatccccagctcaccaccctagtgcagttgcttcttcgctcttgttccactccttgtcgccatccaccctgtgctttctcgatgtgtccttactcggtgtttctgtggagcagggcatcctgggcttcctttctgatccctggctcctgtgatcttccgtgctgggctccctcttcccttcccttttccactgtgttgccctcacacagctggcatgccatggatgtcgctcacccaagcccttcctaatgttgctcaccaaaacccctcccaccttgcccctgggaccttctccccttccaggctgcatgcaggccgagggcctggcgtctcagcaggaggcagtggggcctttgctggcacctgggctctgcatcctgaccttctgagggcttggtcctttaggtccatcttgaatctcctccaggcttcggactctctgctctgtagctggcccatggagacgggtacactcaggcctggtcttagactccgctgcttgggctgtgctggtgcctttggtgccctcttagtccatcccacctgggggccctgtcctgctgtccattgtgccagagtgctgtccccttgtctttccgtaactggctgctcgttacctttcccatctcagcctcagtaccagccacttggtatcagggaggctctccctgaccaacctaaagttcacagccgtggttgccagtttaaatttctgcatagcaactttttggtttattttggctacttatcttccccatcatgccccctgtccctcccatataaactcagtgagagtaggggccacatctcatcatcctgcccacagctctgctgtctgtatcagccagggtatgctgtgcagaggctcacggtaaatagctgcagaccacgaatcccatctgcttgctgtgctttaatattggcttacatctttggatccagtgagttcttttctctgtctccctctctctcactcgctcatacttactttgtgtaattggtgatttccagccttttgtatag

SEQ ID NO: 35606 - DNA, 1128 bp, Homo sapiens
ctgtatcagtaaatggatactttaaagaggatcattgatccctcaaaatagaagcaatgcagtcattccctcattatgctttacttgtgatttgcttacaacccactcttcctagttaaagttaaatattaatccagaccctatcagtgcgatgtagtagtgtctgaatcagttgttgttttggtgtaatcgtatcaaagcatgttataaaatctacaaaattgcagggttaactccaaatattttcactaaggtattgtttttttgggcaaaaatgcatagtgaacattgtggagctgaagtgagggaacttcgatttctgagaaaccactagttttaagggttttgaaggaagagttggaggaggagaggaagagaataaattcacagttaatgagtttccagtattttctgtcgcattttacgttgtaatggaaaagactgggaactgaactcacatgcagtttgtcaaatcactttttccctagaattcaggattgatgagattaacggggtgttaaaggtaaactgaggcacataattaacatggacagaactgtagacctgagtgttgagagttgggaaatttcagtgagttgggaagactggaagcacctgttcttcagagtgcaggtcctcatattcagtgggtttaaggtgctgaaactttttttttttttttgagatggggtcttgcactgttgcccagactagagtgcagtggtgtaatcaccactcactgtagcttcgaatcctgggctgtcagcctatcctcccacatcagcctcctgactagctggactgcaggcctgggccaaaactcctggcttgaaacttcttgtaaccagattggaggaggagggcatgttcattttcgtgacgtttcctttcccttaaacatccagtgaaatctgacctttgaccatcactttgcttaaaagaagctactggatttaaagtctaggagaatgtcctagacaagcccatagtatgttcctgtatgttccccacccagagacctgcgttatgaagtgtttggtgtgcttcttccagccccactgttctttctaaagtgttttattttacatacgctgtcctggcttctgggctatgacctttgcctttttt

SEQ ID NO: 35607 - DNA, 1260 bp, Homo sapiens
gaaaaaatattttaatgttgggctctgttaacagctggactggtggctgtctgaattgggaccatgcttggggtgaggttttttcttacttttttttttttttttggtgagacagagtcttgctctgtcgcccaggctggagtacagtggtgcaatctcggcccactgcagcctctgcctcctgggttcaagcgattctcctgcctcagttttctgagtagctgggactacaagcatgtgccaccacgcctggctaatttttttctatttttagcagagatggggtttcaccattttagtcaggatggtcttgatctcctgaacttgtgatccatccacctcagcctcccaaagtgctgggattacaggcgtgagccaccgcatctggccacatatttttttaaattaaatgtgatacataaaattaggctgcaggcatggcctgatttgcaggtgcttcatgagcaagcgtgcacagcatttatttgctgctcctggagtctctcgtgtgtgcttgtagcctagccttaagccctctgtggacggcttggaatgcgtactccaaatgactcttttggcggggtgggaagtggcaatactttaggtgactgacagttgaaattaaccttacacaagagccaaactgtaggctgatgcagggccactcacctttgtactcacccctggcaggtcctgtaagaggtgctacttgcttccactttgccagctgttcgttggccctgttttgtcttctgctgtttgccttatttatgaaacagaatggaaacaggcgagtttgatttgttataattcctaggagtcatagaatggaagcaggtgagtttgatttgttataattcctaggattggataatttgccttcccctctctccatctttaattaatcccttaaaggaaaagaggacgacagcacttttcctgcagtcatctgtgtaggcctcagccttaactcatgacataggctggtgccactggccacagggctgacctcagctcttggagcccatggggtgacaggagatcagcacctttgaggtggcggcgtgaggcgtcttccaggccttgctcatggtgcttgaaaacactgctttagagctttgttaagagagagaggccctacttactcctgtcccacaggcatttgggtgttgacctccttgttggcctcttaaggagagaatacttgagtattgaattcgatcagcttttctgcctccagggaccctgtttctctctgct

SEQ ID NO: 35608 - DNA, 1035 bp, Homo sapiens
ttgctgtagttcatgaactgcacttcacctccttaggggccataggctagtgggattgtgtcttggcctttgtgggagacacaggcacatgtgccttggtgcttatcctccccacacgagtgtgtaggctgtggcgaggggagcagtggctgacgtgcgttttcttctgtcagcgacatagacctggtggtcttcgggaaatgggagcgtcctcctttacagctgctggagcaagccctgcggaagcacaacgtggctgagccgtgttccatcaaagtccttgacaaggctacggtgagtgcctggctttggcccctctgaccgggcaggagccttgtcacatcccaggtggtcacaggatacgcctgcgtcacgagcttgtggtattttacacagttattggctacagttttgaagattaatctgcttctggtatagacatgtgttttatgtttttgtttcatagtcgtgatcaccaactgagaacatgtttagtgacagtctgaacttttgggacttgtgagcccattaaactgttcttggaatgaaaatatatgattgtgtctacttgtgttaggatgaataggaaaggagagtcatctgaaaccggacactgacattcaggtgctgcccattatggagagtgtggctcaatgattaaaccatggtttttatgattaccatttgctatgttatgttaaagaggaacaacttagctgttcctttcgtggttccaaaaaatatacatatatgaaaagccttttatctttgggggaagtttgaagatgagactgtttctggtgtgtacttgctaaggtttatgtcagttcaagattataagccccccagggactatgaggtacttgcctgttgtatgacagttcttagctcacctgtgcgaccggctagcatttcatttttaaatttgtgtgtcaacttgtgtgtgattcacatccttatagtgtttagcagaatgtaagttaaggcaggagcttcctcctgcctgtgtggtgataggggagggggcattcacat

SEQ ID NO: 35609 - DNA, 1060 bp, Homo sapiens
gtattagaatcaaagaaggaggtgcctatatcgccaaagaggagatcatgaaagccatgaccagcgggtacagaccgtcgatgctgtgcattgaggaccccctgctgccaggtaagggcgccctgatctccactgctgagagctgggccagcctcggggacgtgctggtgacagggcctgtgttggggctctgagagccccgggcagttcatttgctcttgatgcaggtttctcttatactaaccagttaataatcacactttgagaaatccttatttaatgcttctaattaacttttgtctttctaactgtttacattctataataaagaagaattaaggaaaatcttttctttttctgattattgaagtataacatatccaccctaaaccatttgtttctctgaagtatgtaatatagaaaaaccatggatgccataatccccttttatttggacatgtatttctccactttttccctatatggatattaatgtttattattgttatcttgttgaacacatcccacaacgcaaacacgtttgtcacttggcttttgacttaacgcttacccttgaccctttcctatgtgtgtaggttgtgttttgtcgtgaggattgccgcattgaagagtctaaggctgggctagaggtttcccggttttattcccattggcgtattcaggggtatttatgtcctcattcctttggtgacagtcttttaaaatctttgccaatctgataaaaccatgtgttaacgcttttaaatttatatttctttaatgattagtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgctgtgtgcaaggcctgtgtgtgtcggggaagcctttcttgtcacacatgtcatactttttc

SEQ ID NO: 35610 - DNA, 1050 bp, Homo sapiens
ccacacatagaatttcaaagtttctaggctgtgtcaaatgtgaaaagaaacaggtgaaataattttgatagattttattccactcaagtcaaaatattaacatttcaacatgtaatcaacataaaaataattaagatattttatagctgtttcttgtactgtctgaaatccggtgtgtatttattcgtacttatagtacatcctaattaggatgctaaattttcgtaaaaaatacttgatctatatttagattttagaaagttcacagttgaagatgatttgcatacccaagttattacaaacatgtttaatgttttccaacaactaattgaatgtaatttttaaaattaaattaggcaaaacctaatgttgggtttgttagtcacattagcagcgttcccggctcagcagagcccgtgactgatgctgccggggcggctccacgccgcagttctcaggagttattaaccaaggctttttccctccacagacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgtaagtgccctcccctcctccgtgtgtctgttggacagtttgtgtctctggtaaatgtccatagccgcgagcttaaaatctcccccttggttttgctcaggttttgtttccttgtatgtgtgtggaggtgggtggggggcagccccgtgatgtgggcaccaggcttcctttcccctgccgtgaaccttcagaacctgtctgtgcgactcatgcggctgtcgagggcagtaatcctctaaatggttgaactacagtggacttccttgagtagtttttaaaaatttatttgaagattaaaaaaaaaattaaatccaagtatctcttctgtatttcctttaacattctttttcagttgtgatgaaattacttgaaggaagcctgggtagg

SEQ ID NO: 35611 - DNA, 1569 bp, Homo sapiens
gaggaaaccaaaagctatttaagactgttgtgaatgatactgtggctcaagttttgttcaggttcttggcttgtgccacatcgtttttcaggtaggtggtaatactctcatttttaggataaaggagctgtggtacggatcatttggggagcttgtctacagggttgcacttaggaaacacagattcaagcccaagtagtttcgagccgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggttagagccgttacagtggattttaccgttttgtgctttgaagaattttggttgggaagtgatatttatgaaacaaaaggacactaataccaccacatagtctttgttttttaacagaaatgtgtttgttcaatggtatagtaagatatcaccagcatttttttaatatagaagtgtgtagttgaattagactaaatggtctcaaaaattgaaacaagtaacaactccttaactgtaaatgacagaagtagcatatgctgtgtctgtttcacagggtggctgtgagaacaagtgagatgtgtgtttgcctgctcaggtgtgctttccacctcttgaatctcagtgtcccacttttttccccaaaagaaaggccttgccgtgcgtgttagagttcctcctgatgaaggaccgcctagattcttttgtgaaatagaatttaaagtagtagtgtaaggatctggaaaaaactcggctgcttcttcagggactagttgtttatgttcagtctctgcagaagttcctaccttagggtatatgcaactttaccatcttgtgttcttttatttagtttgctgcctccagattatactatttcagacaattcaggcgataacagttggcaggggctttataccacaagatgatttgccagccgctaagcagttaaaattcacttcaacatttcagagactgtcctgccagtgctctctcacccaagtgcacaaccctctctggcctttcctaaaactccagttcagaacactagactgtgtgcagctcaagtgaattataaacccagctcacggaaggagactcacctagttcctttatgcagccctgccacggtaactctggacaccagagaaaagggagcttcctggaggagactgccagtcagcagactctgtcattctacagtaacttaagttcagattgcagtgccacatgatgaagtatctgaatctgttactttg

SEQ ID NO: 35612 - DNA, 1027 bp, Homo sapiens
atataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacctactgaaacagtccttgaagaagcaacccctcatgccattcctccatttagaaaagcagaacaaaacaaaacactcccaatgattttgataacttctctaagaacgattctcccagaatgaatgattttcatttcccagctacacatcaggattagctaggggagtttttactaaattatatgacttaggcccacctccagtgattctgatgtaattattccaaggtagggccctggcatcgttatttttaaaagctcccaggtgattctaacatatgtatcccaggttaagaaaaactgacttaggactctgtgaaccatagtttaaaaatgttaaaggatcaaaagaaccagatcagcacaatatgataccagaggggaattgagggtctgcattcctgacttgtgacctatgttgttttatctttgaggattattttttggagagggtatctagcaaggatgggttgagtataataaataactgattagaaatttgagattgtaaccctggcaatgatctgtcatatataacatgttcaagagagtatttcacagtatttataattttttttttaccttaagtttttatactttctgtattttcaaagagagaacacatacttgtttgaaaatccagaaaagacagaaacagaagcctgtcccactgttcgagtcaatgttaggcctaagcgtggaaccactcatttctcacccttttgtagagaaagaacatggagatgcctgcacaactgagggatttaagcttttttttttttttttttttttacaccatgagacatagaagcaattcttgatt

SEQ ID NO: 35613 - DNA, 1034 bp, Homo sapiens
acaaatttagaatatgccctttgcagtcttaaaaaatgtgatcttgatagcatgtttttaatattagttcccaagggtgtgtgctatcatcgtaactatcatctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactacataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctcccggaagtggccattaatggatacaatttttcaaatgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaataaatatatgtatatttatatatatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatatata

SEQ ID NO: 35614 - DNA, 1048 bp, Homo sapiens
gctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttcggacagttattttatttcgttttaattttttccttaagcaaaagcataatcacagatgtctctgtctcatcagtgtgttcaccatttcgtagacactttacacattctgcctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatg

SEQ ID NO: 35615 - DNA, 1026 bp, Homo sapiens
ggtgagaggtagcattctagggagaggaaacggtagaagtaaaggcttgggcaagaatgcgcatggcacgttgtagaatggaagagccatccggttttaatggagcactgacttctttaacttacaatagttcccgaaggtggaagctattgaatgcccaacatggaaaatacgacgttatctttggggaagaaggggagccattgagggggttttgagcagaatttcagtagagctgcacttcaggcagcaaagcttgagatagaccgaagggaataaggaagaccagaggggttaaagaaaccagggcaggggtgcaggtaagaaacatctgagcaccagacgttgacagaaaatgcagaggaagggacactccgagagggccttcagggtttgttataaagtgaattcataatagaccattccactaggtctctcaggtgtccctgttcacttagtgtcttggaggtttacttacgcaaagttagaaacaatacagttcccctatggactctttgtttgacttagtgctagttacacaacctcgcggaacctccttttccagggggaggtgataggcctccgtcaagctgaagacttgacagtgatattaaatggagtgacttagaggggctgcacagtggttgatccacggtaggcactcagtatttgtttcctttctagaaagaaaaagtttcaagctaattgtattatgtattccattttattttccacttaacagggacctgcagagaaaataacatccaatacacacacctggtgtaacaacataactaaaactaggttgttttgcatcagccattttgttcaaactgcatgcatttgtgcccagaagtcgcacactctgagacagggttattttacaaaactggggacttgggcccagagcagttgagaaattgttctgaagagcagttgctactaaagagcattaccatggtcagggccaccgctgtcagagtcaaagccagtggtctagagcagcattctcaagtttggcatatt

SEQ ID NO: 35616 - DNA, 1584 bp, Homo sapiens
tcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccatctgactaacacggtgaaacgccatttctactaaaaacacaaaaaattagccaggcatggtggcaggcacctatagtcctagctactcaggaggctgagacaggagaatcgcttgaacccaggaggcagaggttgcagtgagctgagcttgcaccactacactccagcctgggcgacagagcaagactctgtctcaaaaaaaatggtagtgtgttcagggtcctgaaagaagtgaccctgttacctaaagccgtgctttcaattgtacatattatatttgccgtcctggacaaatttaacttagcttaccttgcctttaagatttctgactataccttttaggcaagagttaatgagtaactggagttaaaccagaatgcactcatagtaatcccagttctttgctcagttaagtctagtttgggttcatgaataccttagcgtaggtgtgctttctctctgacatagcaactcctctttgggggctgcgtccttgggagttgaaaacaccagtactcaagaagacaggaacgtgggttggttagggtattatttatcatagcaaaccaactagagactattttcatgtctgttcttgggaaagttgttgaatgtactcattgatgatacggttcttggtgcctacgacataccaggctctgttgtaggcactaaaggtacagcagggaatgaagccaagctcgtgctcttgagacacagataagagaaaggtgggtacagctccattacagacactggtcagagaggtgacctgtaaggagaggccaacatagggtgagagcagtgcccctgggggaggagcattccaggctgaggacagatggggatgctcctgagccaggaacattgttggcttgtacaaggaagagccagcctcagggattgaagcatgctggcgggagcttataaataaaaggccatcatctgggccggtgggacagttttcatgagaatggtgcctcagctgtgctggggggccacagataaattgagaggccagggatgttactggatcgtgctggtgaggcgcaggttgctgagaatgagaag

SEQ ID NO: 35617 - DNA, 1537 bp, Homo sapiens
agtgagctgagatcgcactgttgtattccagcctgggtgacacctgtctccaaaaaaaaaattagcatttctagatctttcttggaaatatcttacatttcagctgtggtcagatggacttactttagatttcctaagttagggtatggatactttgtgggataagatgttcctgaaaaatgtcaccctgtagctagtcattgaagacagtgccctcccaacagctctctttaccaggtgcgagttccagagtgtccttggaagtaatgaaattacattcatctgaaaatgaaatataactgaaattagtggcttcctgcttggcttccaggagtttgtatttcttaagtcttactgtgattccctaaatcagaaagagttggttattgatagtttattgtatgctattttaggataatcagtgtccttgtatttttcagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccag

SEQ ID NO: 35618 - DNA, 1031 bp, Homo sapiens
attataggttatttctttaaaaaatgcgacttaggttttttaaatctgcttagaaattttttggtaggagatattcaaagtatggccaaacataaaactaaattaaaaaaaaatcagtatcacctacttttgaaaacacttatactgttgtggttctgttttttatttattttattttattttattttattttattttattttattttattttattttattttattttattttccgagatggagtcttgccctgttgcccaggctgaagtgcagtggcatgatctctgctcactgcaacctccacctcccaggttcaagcgattctcctgtctcagcctcctgagtagctgggattacaggagcgcgccacctccctctgctaatttttgtgtttttagtagagatggggtttcgccatgttggccagactggtctcaaactcctgacctcaggtgatctgtccgcctcaacctcccaaaatgctgggattacgagcgtgagctaccgttcctggccggttctctgtcctttaaaaatatattttaatattctgagcaaagagattaagaatgttacaaacacatcaaccgtgcgtatagtaagtcttcccttccttttaaaaatagcacattgcttgcctctgatggtaccatatatgatagtctgatgctcagaatgttatgcatttgtagtaatacttagttccgacatggctgtttcatactaattgtttgctagattttaaagatctctaaagtttcttcagtattaaattaatttttgtaaaatcaacaggtttataatccattctcataatacagggatggataaatcattcttactgtgtatatgttatttgtatgagtgcagatgtgttatgtcaactgctatccatcctgacatttttaaacttcagagctataggagaccttagacatttgccctcctcattttatgggttaggagtccgatcctgtaatgcactgagatttctcagtttcagagaaaagtctatcctttggtcaaggat

SEQ ID NO: 35619 - DNA, 1148 bp, Homo sapiens
gcattgtagaaaaattggaaccttcatttgttacgctaggaatgtaagatagtgtgactgattttggtaattcctcaaaaagataagctgagtaaccatatgacccagaaatttcatatacccaagagaattcaaaaaatatattcacacaaaaacctgtatatgagttagcagtattatttataatagccaaatagaaacaacccagtgtccatcaactgatgagtagataaatgtgatctatttgtaaaatagaatattacccagcagttcaaaggaattaagtactgatgcatggtacaacttggataaatctcataaacattaggataagtgaaataagccagtcacaaaagaacatattttctatgatcctatttgtgtgaaatgtccagaataggcaaatctatatatagagaaattagtggttgtctggaactggggagagcagatggagtaggaagtatccactaatagttacagggtttccttttgggatgatgataatgttctaaaagattatggtgatggttgcgtaactgtaaatatacttaaaacaattgaagtctttaaattggtgaactttatgacatatatctgaataaaattgttaattaaaactactgtgagatatcattacatacctattagtgtggctaaaatggtaatagaatgactgaccgtaccaagtgtttgtaaggaggtagagcagttggaattttcatatactgctggtgggagtgtaaagtggtacaccacttcttctggggagcagaaagcaaccttccgggtacaggtgagccaaggttgatgggcagttatgcagagggagttgggatatcactgtgtgtacctgtgcaagtcctggagtgtgttgggtcctcatcagcagggctgtatgaaggtgttcattaaaacaaaactactgatagtgtggcaggagctagaaaacacccctttcttcttagatatccctccagcaccctctactggcaaagtttaactgcccctagccaaaagaaaagaaaagaaaagcttagcatccctatcactgaacagggactgaaagggagaatttggagttgagaaggggatacatggataactagctcattactgctgaaattgttggaatcattcattgcctg

SEQ ID NO: 35620 - DNA, 1001 bp, Homo sapiens
tgattaaaacaatatagaactctttcaaggccctgtagttggaaagagtccagtttaaatcctttaaagaggatctattgcagggcaagcctggtgctggcagccacggtaatcccactttcaatgtggtgtgctgaattcctggcagttaaaatgcttgtttttggatcttaacgtgctgccggggtccattgcaagaaagtccatgcctcttgtctttttggtaccttacgggctcttcttccctgagtttccctggagctgaagtgtgcacttgaagaaaattagtgttcaaagtagcgtgggctgcctggatactgctggtgggaatcatggaatgggagcgtggttctattttgtttgtgttggaactttgaggaagcttattaagcagggcagttggggcattagtattgcaccgctaggactcaaattctgggccagtaataagactgatcagagtgaaagtttttgccaaggatgttttcattaaccaagaatgaaggtgaaagtgggaagtttaaagatgttcaggtcctgtgtagttacgaacataaatgtgatgttgaccactgcattaatgcccatgacccactagcagcttccaggaaaccagagccctttgggtcgtggtagggggaaggtctgtgttcatagctgaaactgaaaggcaacagcaatagagacagcttaatttgactgaacatgagcaaccttacctgcttccagcacagacaggattgtcccattgatagttattctgtgggtgggggtgcatggcttttctacttgatgaagagattttgagaggtgacagcatgctggcagtcctcacagccctcgcttgctctcggcgcctcctctgcctgggctcccactttggcggcacttgaggagcccttcagcccaccactgcactgtgggagcccctttctggcctggccaaggccagaactggctccctcagcttgcagggaggtgtggagggagaggcgcgagcg

SEQ ID NO: 35621 - DNA, 1202 bp, Homo sapiens
ccacaaggtaaaagagataatggagatgaggaaacaattggtgtcttttagattgaacgagaaagctgaccatggtaaaggaaaagtctcatgaacctagacatattctcaagttttctggagctgggtagggtggcgatggtgatagaggtatagagattgtatgcttccagattatcctacaaagtaaagaaaatcagagtggcatcagacttaaaattagcaatgttgaatgctagaagacaatggaaactcaaaatttgatgtttttgaacctaaaattccctttctgcaaattactctcagattgaaggacaaactacagatgtttcaatggatgtgagggattggaaagtttactaccttaaacctttttgaaaaaacaggatatactttactaaatgagcaaggaatcagagagaaagatgtgagatacaaagaagtgtttcatatagctaagtctcaattgttaatctgcaataattaatagtttttgggtaacagcctggaactaaaattccagatgatcttaacgtgggagaaattgtgacgggaagatagaaattaaagcttttaaaattgcttatctcatttgtggggagattatagatgttctagatgtaggtagaaaaatacagcataactgtgcattaaaaatgtggactagacttataactacccagaactggactcaaaactacattgttacattattaatgacaaaagtgccaccacagatcggtggcaaaaagatggtcttttcagtaaatggtatggcagcaatcagatggccgtacagaaaaaaagaatcatatcattacctcaacctaacacagaaattaatttgagatgaatttaaaagcctgaatgtgaaagttaaaaagaaacttctaaaataaaatacaggagaataagcataaaacaaaatattagtaaattgaacataattaaagttaaaaacttctcttcatccttagacacttttaagaataaaaggcaattgaattctggcactcaaaaaaaaaaagaaaattgaaagccatggagtgagagaagatatttgcagtacccatagccaacaaaggacttgtatctagagtatataaatcaataacaaaaaggcaaacacatcccaattaagcagtggacagaattttgaacaggtatttctggaaaaatagctaaatatactaagctctccg

SEQ ID NO: 35622 - DNA, 1176 bp, Homo sapiens
tactttgtctttctctaaatggccagaatttagaataattatattctgtattttagaggacctgtgaatctgtgcttttaaaatattggttgtcaggttgccatttatggcattgcagtacatactctactgaaaaattctcttaatttcaaagacttatacctccaaaactgaaaccttttattgtcatgagcagacttaatgaattttggaattctagaatttaaaaaattctttatattataattttggagatctttactttagatttttcttttcaaacatctaagctcattcaataaaaaaaagcaactaaacctagagagaatctaagtgctaaacatgattgtgtaacatttactcttcattgtcactatatttgtgcttgactgtgtttttaaaaatttaatattttgagacttaggcttgtaaagactaaatgtttatttcagtggcatttgtggcgttccactttacctctgctttcttgagcagctatgtgaattcatgatgcgagttgtgactgtgtgccatcatgctctttttcggtaggccgcatctacaagtgcttgtttactggctccgtgagctcactactgacgctgccattagatatgctgtcaacgtgagtattgaacctctgtgacgaatgttgcatgatgtagatgatgcttgcttttttccttgcatatttattttattataatttgtaaattcttttgttttgagaacaataatttatgtctattacactaacagttatagctgcagtagaagtagctgataaatgtaaatgacacttcttttaaaacatacctgttttatgggactgttttgtaatgatgggatgacttttctttctttcttttttttttttttgagatggagtcttgttctgttgtccaggctggagtataatggtgcgatctcggctcactgcaacctccgcctcctgagttcaagcgattctcttgcctcagcctccagagtagctgggattacaggcactcgccagcatgcctggctaatttttgtatttttagtagagacagggtttcaccatgttggtcactctggtctcgaactcctgacctcaggtgatccacccgcttcgggctcccaaagtgctgggattacaggcgtgagccaccgcgcccgtccgggatgactttttaa

SEQ ID NO: 35623 - DNA, 1021 bp, Homo sapiens
actagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaa

SEQ ID NO: 35624 - DNA, 1048 bp, Homo sapiens
taattttggttttcagaataaggaattggtgtattaactattcacatgggtgtgctaactgcttccaaaacatcaaagtgttttctttgatgttgctttttctcttttcgtgattattattttggacttttccttttttgagcatcataaactcatggatttgtgtatgttcagtgtttttccatcagttttggtcattattctttttgatgctcatattatcctctctttggcctgttttcacaatggtttctgtgttgatttggcatggccctattagaccttaatagctttgttgttctctagttacagagaatgtcctaggcagtgtatttttagcctagttctggaatctttcatttctccaagaagccctagttccttttagtggggaattgtagtaggagtgttcattgttttgatgtcggagttttcatggaattttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgg

SEQ ID NO: 35625 - DNA, 1067 bp, Homo sapiens
gttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgccatctagaggcccagaaaggcccaaagctctcttcagtgggtaatctttgtccttcatggtgtagggaagtggggtgggctaccttttgtctttatacatttatattctgcttctaggcaatagagggaggacggaaagttttcctgcatctattctttctcagttgcattcaactcaaaacaatccttatgcctaagaggcatatttttagggtggcatattgtggttttctatactcccatgaattttcatcaaccacgtttaagccatcctttatctgaaggttaaccagtagcttacggtatctagaaccctgttcatagtggagacaaaaatgaaaatac

SEQ ID NO: 35626 - DNA, 1127 bp, Homo sapiens
ttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcaga

SEQ ID NO: 35627 - DNA, 4151 bp, Homo sapiens
ctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgt

SEQ ID NO: 35628 - DNA, 1019 bp, Homo sapiens
cgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaa

SEQ ID NO: 35629 - DNA, 1073 bp, Homo sapiens
agtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaa

SEQ ID NO: 35630 - DNA, 1046 bp, Homo sapiens
atacaaaaaaaaaaaaaaaaatgggcgtggtggtgcatgactgtagtctcagctactcaggaggctggggcaggagaatcgcctgaacccatgaggcggacattgcagtgagccaagattgtgccactgcactccagcctaggcaacagagcgagactccatctaaaaaaaaaaaaaaaaaagagccgtggtagttctgaaggggaagagcaaggaaggtttcttccctgcaaaacacaaggctgcagtagcgaatcaggattgccttggggctgaggtagattgttagaccaatgggagcaactctcaggttcattcctgtgtttatggggaggtgggatgagcttgagcatgctgttactaccaatgggaaaagaatggatgtgttcatatattgtgctaggaaaacagaaaaaggtaaaattaaacttctataataaaaaccatggtggattcaagacctcactatgaaaaaaaaaaaaacttgaaactgttgaaattaaatacagaggaatatctttagggtttttgaatgggaggcattgcttaaacgcatgacaaaaagcattcctataaaggaaaagattaataatatgactgcatcgaaacgtaaaacgggatggtaaatgaaaaacaagtggtgtcgagaaaacaatcgcaacacccttgacagagcttcaggtccaggggcagcatttacagaggcacctactctctgtggtgcctgagagggagcgcctctttaaatttggtgccccagggcctcctttgccacatcttagtgccagccttgggcgccagtgccatcctgatgccagctttagtgtctagggctgtattgcccagtagtgtagctggtacctccaagtggctgtggaacacagtgcaactgaggtgtgccgtaagtgtaaaatatgtactagattcatccaaaaaaggtaaaatagctcattaaaatttttctattgattacattttgaaatggtaatattttggatatgttgagttaaatacaatatatttattaggatttcatttggctttta

SEQ ID NO: 35631 - DNA, 1044 bp, Homo sapiens
aatacacaaagccttagctctagggcttttcattgcaggttttactcatgagaaagaaagtgagaaacagatcatctgagtatccaagaatagggatttgttaaataatgacaattctaccccacatagaataggatagtctgtatctaccaggaattttgacacagagttacttttattgatgtgaagatattgctgatatagtcctaactaagacatatagcaaatggtcctgttttagtttgaagaaaaatgtgtgcatatgtgtgtgtctggtctataactttttttcttctctttaatttttggatctttttctgcaataaatatgaattacttgtgtaattatatgcaaaggaagatgttacattatgttcaatatgttttatttataagtcaggaaattgtagaatactagagcaatatctccatccaaagaagttaaaaatgatttttgggtgctccctggtgggatgacaagttttccggcacatttatgcgaaagcaggtgggtaggttagctgggagaatggaggtggtggtggcagcgaactcttagttcccaaagaggctgaaaacctcagtggcttttaagtagagcctgcctgcagcccactcttttctatttaaaattagattattgtgaaacatttcaccatatagatggaatgacctatttcaaagggtgcttaagctagattatattaaagaggctttaccatagtcaacagttattgagttgattatgctgtggtatggatgtcagtgttagaaaatcaatggtattctgtagaactttaaacatgtgaatatttgtgatttaatattcttctgtggggcaactaggagccttattgagataagtgggcagggctactcgagtcctcttgttgttccatgaaaaattatattcttactaaaaattggccgggtgtgttggctcacgcctgtaatcctagcactttgggagactgaggtgggtagatcacgaggtcaggagttcgagaccaccctgaccaacatgatgaaactctgtctgtactg

SEQ ID NO: 35632 - DNA, 1060 bp, Homo sapiens
gaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggct

SEQ ID NO: 35633 - DNA, 1049 bp, Homo sapiens
aggtccgggcctggagaggcgggcgggggtgctggtggcggcctcggggaggacggccgggctggggacaccgacaggccgggggagcggccctgcgctgggggacgcgcgggaggtcggcggttcacgcttttccgtggcctctttgaaaatcacctccccagattcggtgagatcagttccccaatccgggtcacgaggagcaattgcagcgggagggcgatggtgagaggcagaagttagcagtgctggtagatacctggtttagtactgtcttctcttggttgtcttgatctttgctaggcggggttatttttgattcattttagcagattggttgtggctgggagtgacacagccgactgtccagtgttagcttggggttaatctactccccagtgctcactctccttgagaagtgcctgcagaaagcaaaggtttaggaaaacatgagctccttctaaagaaagctacccccccccacctttttttttttggtgcgactggccagatagagcagccccgtcttacctcttaatagcagaactgggacgtattcccttcatgccctgaagctaagtctagctttctctctacctacctgtcacagaataatagattctgtgcagaattcagctcctctctgttagaaaggctcttctgcgttggagatggattttttggtgtttgtgagaccaggcttttttacatctctattatgcatagtacaaaaatcacttctgctgctgctaagagccctccctaaaagacaccgaagatttgctgcctgttggcgtggctctctccaggagttgtcgtctgctcttggctttgcttaggcctgtgctgcccccgccgccagggctcctgttcatgttccgtttgggtcagaaccaggtaatgtctcactggcttgttcctttcttctgccctccaaaatgacaaacttaactttttagttgtttcacttagaatcaggagccagggcagaacttaagtaggtatcagatgcagcatcccattccagcgatagcctggaacgtcttttt

SEQ ID NO: 35634 - DNA, 1026 bp, Homo sapiens
ttattctgaagcatcacgtcctgtcgtgcttggtttctttcattattaaatcttactcgactcctcctgcagcccctgtctttccagggaacaggtgaagaaaatcaagtctattagggagaagcacacatacttttatatattttgatatgacggtttccttgtggagtattgagagaagcttttcttcatatttataccttgaatgccacttaggtagttggcctggggcgggctgtgctacttctgttggtattgagaagcctggcagctttggtccttgtgagcaccaataatgattgtattacaaagtgggtccttgttaccctcaatatttcaaaaatagaaactgaaggaaatgtaatttgatagtgaatgttggtttctcctttttaggtggcacagtcagttttagaggaaagcaaggagatttctaaaattcctgtaagtgactttcgaggaatcaaagaagtgcagtaaagtcatcactgaaagaagcttttcattgagaccttgtaaaccgacatattgatgtgggatattgtattttttccctttgcaatttaactatttaagattcaaatgaaaatttaaagaagccatttccaccatttaaatgattaaccagatttaaatgaagccggtggtggtgttcaaaatgaagcatgtggtttacatatgtttcctaaatgtaccctaaaaatatgtaatttcagtggccttttttgaccttttaaatgttacgataaagttgagatttgttctgaactgcaggtgaaagatgtgtttgaagctgtcataatctaagtcagctgtattcaatatttactttgtttatttacttgactatcgagaaaataaaattttatctcataaccttggcagaattccagagaaaagtctaattcttaatcaatagccacactttactgcctagtaaactcactgatattgatagggatgagctgtgttttactacaaaaagcagtgataacaccctgcccccattcctcctcaattctataa

SEQ ID NO: 35635 - DNA, 1057 bp, Homo sapiens
gtagcgactccctggacagtgaagacttggatttgcgggagaatcccagtgtattctggtggaaagtgcgtgctctgacctcatcctcccatttcttccaagtactcagctgcgtagacttggccaaactgacaagggtgatggtgtggttggcctggtggatggagatgctgtcttttgaatcttctcagcctcattttaattaatgggctgcagggaccaggctgggtccccagctggagcaaggggtaagcgggttcgatgtgcatccacagggttctcttcgtcctattccagttctgctgacgcgctgttcagtgggccactgggagagggaatgaacagggagacttcccagtgacccttgcacttgggaattctggctgctgttactcagcgggagctgttctgggaattcctattgctgtgcctctgaactgaggggaagggagcatagaggagtggtcagaggcttgcggggccctgcatgtgctgctggcttcctgctggacccctggtctcctccccctgtgcccgcagaacaggacttcgctctcactgccaaggtgcccagctccctgctagttcgtaaatctcaaagagagatacctggctagattgtccagtgaggactcccagctttttgatgttactgagccttctgtgcagacagtcttgcttttggggaatcttgctctcatgtttaatggttaacaagtgcataaacactcattttcgcttctcattcactcatggaaacacttaatttgcttactgaatagttgtgttgttaccttaatttcctcttttctgtcccctctccacataaggaagccccttgaaacccaaattactaatcacctgccccccgggaaaggttgtatgtggggaaagagagagcaaaccagagtgaggctacgagcggggggcagagggcattgacctctgagatttctccctgtgccatttgatggcagaggggctgtggaaatgtaaaacctcgttttggtgatgaacatacttgagttttagattactggctcttttcattagccac

SEQ ID NO: 35636 - DNA, 1334 bp, Homo sapiens
aatgagctatgatcttttgctgtcacttagtttgatgctgtaattatctaagatttggctagtgggagccccttcatcctggctcttttatcttttgtgacctgtctccatcatttttttggagcactttcttactttctggcacaataaactgttccaggtgcaccttgtgctttccttgccccagggctgggatcagccatttctccaaggagcccttggagaaatggttcattttagtagtgaatggtatttagaaacacgatctaggcactaagcgtgctcattgctacagagttgtccttgcttttagggcctctcagtagacagagctaagaagtgtatgcgtgtatgtgtgtgtatgtatgcatacacatagacattaattacacatatgcaaacgtgattgagatctctttctgcacctcttggtgataaaaaccatatgtttagactcagtgtgtccaattccaatacagtaccacagggtgcattttagtctttcctcttccgtatttgtaattcccttctctgacagtgaaaaacctggctccttttatcctccgtatctttacttattcactcaatcctagaatatgcagaaagtaatttgagaatgctaacccacaccacggtgataaatgaacctccacccccaagtttaaactgttcaaatcagcagttagtggtcagcttctgttcagctcagtgccttgtcagttagtcatccaaacaaaacagatgaagtaatgctctgcagttccccaggggcatgtttaagaaaagagctgccagactccatcaacagcttactttctggtgatgtcggagcacaaaattgaaaaatcaggagtcgccagagaagaaagggagattaatttcatacagtttataaaaaggacacctgttgtgggaaaaacagtttgtcatcttcatctcaatgtacaaattgccaaagagaagaaataaaaaggaaagtgttgagccagtgagaatgggtgtgtagaggaggatgggtcgagcggacctttctcagggatccagtacattctacaaggaggagaagaagctgagttcatgtgttggagtaagctgtgagtcatgacttgaaagactgttgcttactgcccttcattgactaaatatttcttcccagaaaccacctgcagtaaattcaaagcagctatgtttctgcctcagtgcgggatttctgggaactgagtttatgtgcagtcagtcccagaaatcatggaacggtgggtgagatcttaggatttcatttgctgttctgtatttttcttttctctctctctttctctctctctccccctccc

SEQ ID NO: 35637 - DNA, 2086 bp, Homo sapiens
gtttcgccatgttgcccaggctggtcttgaactcctgggctcaagcgatccacctgcctcagtctcccaaaggcttgagattatacacaggagccactgcacccagcctgttctgtgtttttctacattaaatgatgacacggatattacgtcgctgacttggggagacagtctcagtttcatatattatgttctgtactgcccataaacatcctcatgcttgttagattgtgttctggaaaatttggcctctgtatttctagcaaccctttctatgatgacacattttagcaagaaaaaaaatcataatttgcttattaatattttaatggagaagggcttttgatattagaaaactgggaataggccgggcgctgtggctcacacctgtaatcccagcactttaggagcccgaagcatgcggatcacgaggtcaagagatcgagaccatcctggccaacgtggtgaaaccctgtctctactaaaaatatgaaaattagctgagcgtggtggtgcacgcctgtagtcccagctactggagaggctgaggcagaagaagcgcttgaacccgggaggcagagggtgcagtgaactgagatcacgccactgcactacagcctggcggcagagtgagactccgcctcaaaaaaaaaaaaaatctgggagtaaaaagtcatgactaggggtagtgagaatgactgctaataggtcaaacattctgaggaaagtttttgagctaatggagatgttttggaattagatagtgatgaggctggaaacggtgatttctgcctgtaatcccagcattttgggaggccaaggtgggagaatctcttgagcccagcagtttgagaccagcctgggcaacatagtgagattcagtatctaccaaaaatttaaaattcgctgggcttggtggcgtgcacctgtagtcccagctgttcaagaggctgaggtgggaggattgcttgagcctaggagtttgaggctgtagtgagccatgattgtgctactgcactctagcctgggcaacagagcgatgacacgctgtctcttaaataaataaataaaaataaagaacaaaaagtcatggctaaatgtgtgatacatttcagattttgaaatagcttcagttattgagtgtttactatgtataagccacttaattttcctaccccttacaaagtaggcagtgataacattatacctgaggaaatggaactcagagaggttttttaacttgccccagctcaggtggctatagggacaaggttaccacgcgcacagtgggttctgccgggggtggaatccgcctgtgctggtgtctcctactctgacgtgcgtctcttatggaggaatttgactcagttttttctactcccactccccctctccctttttttggtgttagaaaaagtgaaatcacctctatttgaaggaggggattgtggataagatttgaccaggtttcagttgtgatttgatggcatatttggaaattttgtggaaaaacctgggttaacttttcaggaaatcgcagtcaaaaaaaaaaaaaaagagagagagactttgcttccctgtagattgtttcagtcctggtggtgtcttttgagatagtgaagagcatagctgaaaaagtggaaactgatgatgctttagcttttattgttttttaaacattctgggaaagttgaagggagaggcaactttctgctatgcttctcctgaaagtgatattaacattaaaaatcggtgtcattgtttttctgctagtgtgagctttatattttttttctttttttttttttgagatggagtcttgctctgttgccaggctggagtgcagtggcacgacctcggctcactgcaacctccatctcctgagcgatactcctgcctcagcctcccgaatagctgggattacaggcatgcgccaccacacccagctcatttatttttgcatttttagtagagacagggttttaccatgtttgccaggatggtctccatctcttgacttcctgatctgcccgcctcggcctcccaaagtgctgggattacaggcgtgagccaccgcgtccggccg

SEQ ID NO: 35638 - DNA, 1596 bp, Homo sapiens
aggctggagtgcagcggtgtgattttgactcactctatcttctgcctcctgggttcaagcgattctcctgccttagtctccttgtaactgggattacaggcatgcgccaccacacccggctaatttttgtatttttgtagagatggggtttcaccatgttggccaggctggtcttgaactcctgacctccagtgatacaccttggcctcccaaagtgctgggattacaggtgtgagctaccatgcctggctcaaacacacatttcttagttgcagatcagtctgtcctttgtagctgggcagacctcctgggaaacttggacttcttgcccctgttggcctgtgtgtcttgtgctcttgtacctgtacctctttgtgtttgctgttccctcttcttcctggtttcccttcctaactcagctcaaacatcctttcctttggaaaactgcacttgaccatcctgtcccagcctcttgaggcccattggtgttggcatgacactttgtgagaactggattctggactggttcctttgggttataattgttccttcactcgtgagtttgagttgctgggacctctgaccccagcgccggcccagagcagtccccaggtagaagtgcagtagatggttgttgtgatttatgcctgtggttccttaactcagattttagcataattacctggaaagttttctttaaaaatacagaatccctagagattctgatttagtggttctagattaggcccctagaaatgtattttgaaaaaactctacttgtagtttgttttgagacagcgtctcaccctgtcacccaggctagagttcagtggtgtgattatggcttactgcagccttcaccttgtgggctcaggcgatccacccaccttagcctcctgagtagctgggattgcaggtgcataccactatgcctggctagttttttgtagaaatggggtcttgccatggaggccaggcaggtctcaacctcctggactccagccatctgcctgtcttggcctcctgaagtgctgggattccaggtgtgaaccgccatgcctggtctctactgggaatttagacgcacagctagggttaggaaccaccgagttatgccaaggcacagtattagttgtgggttatggaatcacggccaatttggagtaaggtgtaagtgcagtttgcagaatcattccattcacatatctggagagagtggagaaaatgaatgcagtccctttatgatgaggatgtgctccatgaaggagaagatcctggctcgtggaggagcttcctgctctgtgaacatactgaaggcacaattggcccttcaaactctcatttgaagtcactgtgttgccatagagatattgtgtagtgttgaaggagattagagaaatcatgtcgtaaattatcagaacagatggcttgtaatttaacactcttctagcccatattctttgtactgaccttgagaacattgaaggtatcagtttttactttgttcttttacctataaaaatggcagagttcatattgagtgagatctaaaatgggtattagatatgccacatacacagtgtggtatgtgaaagc

SEQ ID NO: 35639 - DNA, 1067 bp, Homo sapiens
ttatgccctccctccctttgccccccatccctggacaggccctggtccggtgtgtgatgttcccctccctgtgcccatatcttctcattgttcaactcttacttataagtgagaacatgtggtgtttggttttctgttcctgtgttagtttgccaagaatgatggcttcccacttcatccatgtccctgaaaaggaaatgaactcattcttttttatggctgcatagtattctatggtgtaaattttgtatttttagtagagacggggtttcaccatgttggccaggctggtctcgaaccacctgcctcagcttcttaaagtgctgggattataggtgtgagccaccaggcctggccaactaaagggtattttctaaaaggagacttctttgaaattttttctgtctctctattctagcctgggtctgatgtgtaagtcttaaaagattgtatccttcattaaggacaactattgcctcttgcagggagctgcatcctgattgggattctggcacattcacacatgcacattgttgtagatgaccagagtagatatgtacctaaaacatttcaaattaacaaaatcataatcctgtgagtgtaatttaaaaatctaataaagcttaccttatttttaaagtacttgtagttagacatatattaacacaactatttcatatggttttattctcacatgcttgaagtattcaggaatcttaaataggctcttcatacattttcatgagcctcatttcttatgtgtcatacagtaggaaattaagtaagttttccgatctccagataattcctgagttgctcttgtgtgaatgtgtgttttaactgaatccagacattcatagtagtgagcactttctttgactccttttttactagcctacactgcttatactaatgggggtttctgatgccactcagcagtgggacagagaggtcagttgtgagcctgaccctgttggatatagcaatttttacctcaggatgacacattcacgtgacttaaattctttgacacttctgtgtcaatgctagaaaattttttataaaag

SEQ ID NO: 35640 - DNA, 2295 bp, Homo sapiens
aaccctattgcctagggcttgggataatactagtactagaaaatgctgatttctggggcctgccttggaagaactgagacttgccccagacatcatgaagagaaagcttgcaggccacatgtactaagatccggggataggtgtgagtcagaggctgggcaagggcctctaaggagctcttggtgcccttgaagaggagcatggttctgggtggatgcaccatgaagggctgttactggcagcattcactagtccccctgacccaccaccagtggaacaagtacccttgctttacctaaatactgaacattcatttcttacttagtagagattgacttaaatctcttttttttaaattgtgctttttaatctatatatcagaatcatctgataattgtgtgatactgaggaggtatttaagccatagcaaatcaggaagggaagaagctaagatggggtttacaagatagttcttcacatgtgtctgaaattagtactcttaagaatgttactaatttctggcaggatccctggaaaagtttctagaacaattggaagagaagccagaatagctgtgaaaaatggcggtgttcacaggtgtaaatactcacagcctcacactcaagtgtgtcatcctgaaatcagtgaaatgctctcactgatttcatggaccttatcatccgtgagaactggatatgccacgtgtttaattcatgactgagttttatgtgctgttcacacagcctaatgcaagacattcacttgaagaagtttaccctgaaatcccccaaatagggaggtcccacgtaggtgaactaaataggctctctacaagtacattactcatatttttaaaataggagattcccaagtggatctggctattggccaacagaatgagacttacacagcctgatataaatcggttcatttctccttgtactgtagttgattttcaggaggattgatgtgcaatttattgtttgtctgcagcagaatgacttgtatggctctgggtgctgttttctagtgctgtgtttgtggtgcatgtcttcttcctgtttcttctgattctgagttccgccctttttagctagcattcagttggtctggctttatttgacttctttgacttggtgagtgccatggtttgtgagttatactatcatttgtggtttaaacatttcagtttttgttactatatgtccatctatgtggccatcttctcattttaattaccaatacatgtttcagcttgctttttggaaaaagtgttgagatgcaaatgtgtctttggaagtgtcactgagaaacccaaggtctatctggcattccgctcctggcggcagaccgtagtctttgtccacgggttgggaagagagctgtgaaacagggaggccttgccgactgtcctacctgcaatctggactttgcacatggagcctctacttaggggattagttttttgactactgctgtttgatttttgctttttaattgggttatttgaggtgaatgcatggtttaggtttctcgttctttgtgttggacagaattaaagggaaatttgagacatcctggtctacttatgttcaactccgttatattcttttttaatgggcaataaaactgccttttttttttttttttacttttctcttttttagatggaaggttccccatttttatttttacatcacgttcttcctcatacagttttcttcaacagtaccaagagtcgtatttttaagaaagtgtctctaaattttctttgcttttgtaggactatgtcatttctgatgatcattaattggtatgcctaactctcccctttgacccaggtattactaatattgactgaaagatggaaaatttcaaagatggaaaatttggattactgctgtgtctttaccattgagtcccaggaaataacttgcccagtttcataaattcttagacgttggtttctcttgtgattgtcaagtctttggtgttctttactttattcacctggaccacttgagttgttattcatcgaacacacacgtgtgtgtgacatgaagtataacttgttcacccttactttgtgcagtggtggtaataaaattgttttaaacctcttaattatggtttttcatgttggattcactgtgagttcttaaaaaaaaggatcacccactgatggattcaaatctacctttggaaaattaaagtgataagcacttaatggcattttgggattagcttgagaatatctgtaagttgattgtacttgaaacatgcagttgtgttgtg

SEQ ID NO: 35641 - DNA, 1789 bp, Homo sapiens
tcctctcgccttcgcttcccaaagtgctgggattacaggagtgaacctctgtgcctggctcgagatgtaatatattctcttgaaagataatattacatctagggaactatctttatcactttatttaactatttacattgaaaatactagaataaaatataagtacatatttgtttttaacttaatatacaatttcagtgttagatgaaatgaagatggaatattaacaatgtataagtaatgaaaaattactgaaacttgactctgttttagcattccaaatcttaaattatattccttgccctaaaataaaatatcatgaagatattttgggtgaacagttggaaattgttacaattctagagtattaaagataccaagaacattcagaggatccagccgaacctgacttgcccaagaaaataagtaaatcatttagtttgtcacttcagtttgcatgaccacaaagaactgtacacgcaatgagttattacattgttatagaagaaacaaaatattttataatagtttgccaaaaatatcatgccattatgagaaaaacctgttgactaagtcggcctttggtcacagtaaataatcactgcttttgaccaaaactgcaggaatgtaaatctacgtttttcagtgtttgaaagactttaaaattgcaccatataaggtaatgctggctaactaaactttataacatttgaatgtagaccataagctgatgagccggaggtcaaaattagatagctgtaaattatttgggctaatgaaggataaaggtagagtttagccaaacactgttcttatgtagtcttatcaccggtggaggtacagatggatatcacccacagaggtgtgggtaggttgcttcagaattaattttttaagaaactgttaagtaatagagtatctgaaactggactgtgtttaaggactacttagttgctgttgctgggtattattcagtcttaagcttcttcctggttataaaattaaaaagcaagaaagagacggcaggaaggagcggggtggggggatggtcggtggttagtagatatgtggacctagagtagccttttcagccagtttgggttgtgaaatactgctgagtgcttatgtggccaagttctgtagttatagaagattatgtatacacactcttttccattttgcaaaagtgagcaaagatatccttgtatgcaaggtgtcataatcccattcctcttatgttttgaaaagaattacatacacctgcagataagttgagtagtgcattgagcatctgaatacccttcccttcaattcactgttaactttttgccaatctgttctctctctttctatcttttatattcattaggacactaataagcactgcagcattactaagctgtgagttacttttgcttgaagtcagtgtcagttaggttttagaaagattgtgcatatttttgttttaatttgtcttgagggcagattttgggcttaaaaatacctctgtaactgaatagccaagcagtacttgcccctgagaagcaggaagtgcagcagatttagtagaaatgcttgaacaaatctagcgtcttggttgaaattgactaaagttccaaaataactaaacagtgtcacagagagtagtgacaggcagactcatctcagaagcagtggctcctgtcttctgagtgacagtcactttcaagtggcagtcagagtgttgaccaggcacacagaataaagccccttctgttgaagaactggcttaatggagtgggacaggtta

SEQ ID NO: 35642 - DNA, 1054 bp, Homo sapiens
ctttatgcccgcctgcctctctatctacccagtcaacttcctctcaccttcctagttcaagacaggattgatgagcaaccctgaaaagtttcacatttctgatggtcacgtgatgggtcaggccatctggtcagcagtcgtcagggtcgtatacaacacacacaaggctgcgggcctgaacccttgccccaagaagattctgccacagagtttatggccccagttaagaagatgttctttgatcactttttgtgacattccctccataggtagaggtcagatcgccaaataaataatagtatctagagtcagggattttagtctacagtcgagacctatgaattttggtaggaaataaatgaattatatctttattttcgtggatctcaataaaattcagtatttctttcaattgtgaatgtagttctagcagtatctgtgacttttcacctgtggatactgcagatatttttaatcgacattaattattacagatctctcaaaatgttgttcatgctcatcacttcaaaactgtagaagttactagaatgactgctattttcatttaatgtgtggtaaagatgcacatattactttaaaatcttttgatgatcattactattttttttagatataattggttttctggttaagtttctctatgcacttaaaaacagtgttctgagaagagcttcataagtttcaccagattgccactagttagaaatatactactcccccaaaattgctggttggaattgagattacagttttctctttatggctgtcaggatttaaatttttctttttttcttaaagttttgggatacatgtgcagaatgtgcaggtttgttacatagcacatatacatgtgcaggattcaaatgctttctaaaaggcgttttctaattcctttccagttttttccactccttacttagaacttctttgtccctttcaacaattcctacttcctttaatgttttaatatctagtaatagattccattttttgtttgctttttgctgcgtaaattatacattctttggagcta

SEQ ID NO: 35643 - DNA, 1985 bp, Homo sapiens
tactaaaaaaatacaaaatcattagctgggcgtggtggcacgcgcctataatcccagccactcgggaggctgaggctggagaatcgcttgaacccaggaggcggaggttgcagtgagctgagatcgcaccactgcactccagcttgggtgacagagcaggactcctgctcaaaaaaaaaaaaaaaaaaaaaaaaaaaagattaactgtaatatagatgtggtaaagcctatgcgttatattccctagttttctggcacaacctcttaaagttacctggatcaaaagctggttacatgctgatattttcagtctgtggcctgaatttccaaaccgatcattagatgttgcctggagcttcctattctcattggattaaaaaagattattttgaaggtaatgggacaaaagaagataactgactttacaactttttataaaactatgctgagacttagtattgtttgaaatgaaagctgttagtattcttaaataaataaggattgtttgccttctaaagaatataacctaaattgttcctttgtaagaatcacatttttaacttaaataaaaaaggcagaccatgttgttagaagtgtctgatctttgcatatgaaaatataggccagacacaatggctcatgcctgtcatcccagcaagttgagaggccgaggtgggaagatcgcttgaggccaggaatttgagactagtctgggcaacatagcaagatcctatctctacaaaaaaataaaaagctgggtgtggtggcacgcagttgcagtcctagctactcaggaggctgaggcaggaggatctcttgagcccaggagtttgaagctgcaatgagctctgatttcatcactgtacttcagcctgggtgacagagtgagtggtcccatgtccccccagtgcccccacaaaaaaaaaaaagaaatataggtaggtaggcagttttaattttcttttgaaatttatgatttgagttggcttattttctgtatatactaaaatatttaattttgtctagggaaatccttcagaaaaaagttaaggtataaagaacatgcaagaaaattgtgttcataaacattcacatttagaattttccttgtttccattatatggattataaaaaaataacaatggaatactacaatgtatttttttttgtttcattcttctattagctgtatttcttaggctcttacctttttgtaggacatacagctaacactgcagacttaaaaaaaaaagacatcttatttaagggatatagaatttctacaaataccgtattattcttggatgccttaaagtgtattagagaaccatgaaaaggaaatgtcctttcagatactggcctgcttgaaattttgttagtacttctctgaagtttttggtgtttgttgaaactaaaattgttgtgggctgcttcacccgagcccagacaaatctgtagaactagttatctgtcaccgtcatctgttgtttcctgcctggggggtccctggcactgtctgttagaacttcacagccattctgtggcctgcccaatctcagaatctgtgatggcctttgtgccagattgcagatggtcgtgggcaggcctgtgagtggatgtggagcgtttctggggggcgtagtctgtgagatggcacgtgggaccactcacacaggacctgtgtctacggttgcccccaggcagctgcactgcagaaatcctttgagggccatttcagtgtcctgaaaacgctggctgccccctgcttgacttagagaccaatgtcaggggtctgtaaaggtggattagaggattgaggccaagttcagagtcttgaatggatggcaggagaaagaagagaaagtctgaagaccacatggtggccacgcccctcccggcctgggctcttttgcatccccacttgccctcactattccttttctggtagtttctacactccgggctgatgtgggtctgaaattcta

SEQ ID NO: 35644 - DNA, 1026 bp, Homo sapiens
tgccacataaaagtccaattaagtaaaaggtgatatgaatgtttattttatgtgaagtacttttaagtgattattgttatttaggtgttgcgttctgtggagtttcctcattattaaagtaatgtatttgtttacaaaacaatgacaaaatgagacttatgggaggggaggaaggaattattaacataataggagaaagggctttcttatggggataaatgtgttttgtcactgaagtttttatttgttctgtcaccgagccaatctttattgcgtgagaagcagaccctgctgtattaaatgtgctgatgggaaacccggatgtctttgcttttctccttgccagccgaggagttagactagaacaccttcaagatgagctgtaacttttgaatagtgaacacagattttataatatctgctggtgttttatttgtcacatctgccagtttacctaaaattaaaattttgaaaaccattttttgtggaaaggacaaatcatgtacttgttggagttctgggctgaatattttgtgatgtggttttcaagtgatcttagaataattatgatgccagctaactgtccttgagtgccaatgctgccatgtattgttctcattgcctgtattatttaataagtgtaatattttctccattttacagatgaggaaactgaggtacagagagattggttaagtagcccaaagtacagagttagttaagggatggggtggtttgaacctagttcttggcccattctcttaaccacttcgctataactgttgttaactaaatcatatagtagacatgagtataatttaacacaatttgtcttttatatgactgatgaaattagccccgtgggtttattttcaatgccttatacatactaaagttatgcaaagtgtttctatttttgaatgatttttctttccttattttcattgttttcccctgcactgttgctgataaccttacaaataaagattgtaaaagaccaggagaaagataagcatgccaatcata

SEQ ID NO: 35645 - DNA, 1035 bp, Homo sapiens
tgtgcactcaaacctggtagctttttcctttttttctcttatcgttacgttgcacctcagaagatgcctggtacttttaagtaaagcaacaaatgtaggaagaattgaactgctcttttcaggatcctgatggatgtctcaaatgtttctagaccttgataaaagtacttgagcctgtcaatagcctagacgttttaaaagctgcttatgctttttatttcttgggaaatgcttgttttgagttgtgtgtcttgttttaagccaaacaagtgtcatctgtggttgtgctgctagtacatttctgcttgacctcacaataaaatactgattttgaaagcaccagcctgtctttttaccgcagaggtaatttgagagaggagtggagggtgcccggggaaggagttctgcactgccagcctcatggatgccagagagaaaggggagttcttttccttggtcgatggtcacagaggaggaagagtgtgaacttactccttttttgttctgcaggttgtcttggtctgtctttatgatcgtgggcagcttagggacaagcaaggtcctggcacccatggttgagtgagtggaccacatactaacattgtatggtcagtgttggtctctaggtcttacgggaatgtgtacttaagtatggtggaacaatagctaattaagtagagatttcaagaaacaaaggatttgaggaagatattgcccaaaataagactattgtatattatcctatgaagtcctgaaccctgtctctcattaaaatgctattcagattttggggaacagacatgaagtaaaagatacagtgtaacatggagagttaacctaaggatataggagcttagagcagtgaccctgacctgggcaagtgccttcccctctttgactctgtttcctcactgtaaaatgcagataacagtagtactcattcactgggctgttcggatgattcagtgatttaatatttgtaaagagcctagaacagggcctgccaccatgtatacactttagtaataatattag

SEQ ID NO: 35646 - DNA, 1045 bp, Homo sapiens
aggaactctgtgttgtttgaggttgtgcagcacactttttttctttcattaaatgctttaaaatgtactctaagaaagaaaaaacattcaacaaaattgacagtattggccctcaaggcagtatttttaaattgtcaggagattttttatcagactcagatcttctggtgagaggaatttaggagggcttctgcacagagggacagaggcagtggcagagcattgcagccccccagaatggggtccccagggtgttggctgctccccctctccctgtgtgctgagctccctgtgtgcgggcctagcatccagcttgcagcgtggaccaagtggggtcctggtgccgtgggagccctgattgctggaggagcccagctggggccacaactagggcagcgagtgcagggtatggcgccccaggtggggtcagggggagtcagatggaggagcggtcggcccctttggttgagttttgaaggaatacaagtagatggtagatgaacggggaagttctgtgtagaaggttggaagtgtgaaatggcatgaaattaaaccactggttacttttgaggacagcttccttgttgacagatgtagaaacagagtctagggaagctttggcttgtctgaggccaccaaggtaattgtccagcgaccccagccaagagtaggggtgtccagctttccccaggctccgcaccctctgctgtgatccccatggggacctatttgcagccagccattttgtggcctgcgtttagcttcttgctgtccaggtgccctttaacttatgggagcatctgtcagagcccatttagaggtctctcttttccagatctgtggagcagttgagaggaggttattttgcagcatttgtttcttctaaatctcctttcaaaccacttttgaaagtgtttttttgttgttgttgttgttgtcgtggttttatgattgttttggggaaaaaccatgaaagaaaaaggaaataaatttttatttcaacatgaatcatagatatcacccttatttttccatcagttattgt

SEQ ID NO: 35647 - DNA, 1052 bp, Homo sapiens
gaaatgctatccctacacctgcagcttctttctgggcccctttcttgccctcagtcctggcactagtccccaggagagtgagagttgttgcattgaaatgaccataaagcttttcttctccctcgtgctgtcccccacgaacccaggtatgaagtatacagaaggtggggaattaggattctggggctttcccatgccagccacgacagctgcagcctgctcagtcacaggcacactcagttattaaaattagatttctgatttataggaagattgtcttgatcaatgatgacaagggcatacctgactaaattaatgagaaaatggctagggtaagtcctgggcagctatgtgaatgtgagtatcattctagaagtgtgtgtggcacttgctgcagccctgtgtggctgtcctggcactttgttcccggtgtcagggcctctggtgtgtgattgtcgcagcacgtgtggggcagtgtgtgtgggcattcccagcctgacacatggcttgcataaagattgcataaggttataggaaagtgtctctgtcttttacaccgtattgccagtactaatcagtccaaagtttgagaaaatagtaaaagaataacatacatggttgaaatcaagcatttaaaaacattcagtaactttttgaaagaagactctgcttttctgattaaataaataaaagtcttattaatgatttttagtataactatagttcatgtgtgtgttggggggagagtctcgtttaccttcccaaaacaggttggattttaaaatgcaacttttgcaaagtaagtaagtttcagcacaagggcatgttttcatctctgcactttgtcatctgtgtcagtaagcagttaagtggcacagacctgcctggaccccctttggcaggttgttaggatgaattagtgaagtcgtcggtttaaagagcttagggtggtgcctggacagagtgagtgtctaatgattgctaaagtaattttcttagttttactatggaatcataataacccacatagaagactgatattaagagcacag

SEQ ID NO: 35648 - DNA, 1027 bp, Homo sapiens
tgatagaggtgaggaagctgcagaagaaaagttggaagctagcagaggttaaatcctgagattgaaggaaggaagccatctccataacaaaagtgcaggatgaagcagcaactgctgatgtggaagctgcagcaagttctccagaagaccttcctaagatcagattttcagtgtaggcaaaacagccttctattggaagaagatgccatctaggactttcacagctagagaggagaaatcaacatctggttttaaaacttcagaggacaggcgactttcttgttgggggctaatgcagctggggactttgttgaagccaatgctcattgaccattctgaaattgctagataccttaagaattatgctgaatctactctgcctatgttctgtacatggaacaacaaagcctggatgatagcccatctgttgacagcatggtttactgttttaagccctctcttgagacctattgctcaggaaaaaagatttttttttcccaaaatactgatgctcattgacaatacacctagtcacccaagagctcttgtgtagatgtataagaagattaatgttggtttcatgccggctaacacaacatccgtactgcagcccatggatcaaaaactaattttgacttccaagtcttatcatttacaaaatacattttgtaaggctgtagctgccatagatagtgattcctctggtagatctggacacagtacactggaaaccttctggaaaggtcaccattctagatgtcatgaggaacatttgtgattcatgggaggaggtcaaaatagcataaacaggagttctgaagaaggtgattccagtctcgtggatgacttcgaagggttcagcacttcagtggaagaagtaactacaaatatggtggaaacggcaagagaactagagctacaagtggagcctgaagatgggactgaattactgcagtctcgtgattaaactcctcagggatgaagcgttgcttctcatgaatgagcaaagaaagtggttttttgagat

SEQ ID NO: 35649 - DNA, 1101 bp, Homo sapiens
gtggaaccagactgcagttgatcaaagcatggttgagggtgggaagtgctgggctcatgcgagggtgtgtgagtgattgtgcatcaacatgaaggatcactgggggagtggtggggtgtaaggttcattggaagtctgggactcagctatgattgaggtcagatacctagttcaggggataagaccatatcatcttgaaatgatgggctgctgaagggtcttaaagaatcatgggtacagtggctcacggttttaatcccagcacttcgggaagccaaggcaagtggatcacttgagcccaggagttcgagaccagcctaggcaacatggcgagacctcgtctcttaaaaaaaaaaaaaaaaaaaaaaaattagcccggtgtggtggtgtgtgtctgtagtcccagctacttgggaggctgaagtgggaggactgcttgagcctgggaggcagaggttgcagtgagctaatatggcaccactgcattccagcctgggtgacagaatgagactctctgtcaaaagaaaaaaaaaggaatcatgtaactgtcctcccttctcctttagtaaatatttttccttcctttcttccttctcttattattatcttattaatacataccaaaacatgtatctcttattatttcacagtggcacactgaatctaaagtgatcctcctgcctcagcctcctacaggcatgggattccgggcatgcaccaccacgcctggctaattaaaaatatttttttgtagatatgagatctccctatgttgcccaggctattttttgttttgttttggttttgtgttttttgtttgtgtgttttgttttttgtttgttttgagtctcactttgtcacccagattagagtggagtagcacaattagagctcactgcagacttgaaatcctgggttcaagtgattctttcacctcagcctcctgagtagctgggattgcaggtgcataccaccacaaccagctaattaaaatttttgtatgtgtgtgtggagacagggtgtcactgtttcccaggctagtctcaaactcctggcctcaagtgatcctctcactcaggcctcccaaggtgctgagatagg

SEQ ID NO: 35650 - DNA, 1043 bp, Homo sapiens
catctccccaccctcacaaacccctagaggtgtcgtgcacgtaatgacttgtattcactgggcactccactgggtactgattccctgtttgatcctcgctgacctcatcagatgctgctgccccactttacaggtagggattctgaggcatggagtgttaacagcctgcccaaggtcacctagttgcagaactgaattctgatcagcttgagccaactctaaaaacccacattctttccactattgtctgcgttctcgttgcatggagggataatataggaacatgaatgactatgagatttagaacagaggcgcaaaattcacttcagcaatgaagaatgggtagggaactgtgtaggatctgaaaggagaacatttgtttttgatcactaggaaaggcttcatgaagtttgagatgcctttaacgaaggatgcttttcacgggagggaactgccatgggaggaggaggagtattttcttgatttaaaagtattcgtatataatttagaagttgtttcagggtaccctggttttctcatgtagatcatcccccaggtttccctgtctcttcagcggttctttcctaaattagcttttgcctgactttccttcctttgcaacctcagtttctgattttatgtctagtctgtgactaataagttttcaaatagtaataaaaagagttaaagggactcatacaggtttgtggaatgaggcttgagaaactaagtgaagcctgaagtttatttccttttatgaacacagtgtgcttacattggtttattttaacataaactatttctaaaaatggagtcagttattatctactaaatgcaatttggtagggagatttctttcaaatcatgagcttctcagtggggataaaggaagaaaagggggttctcagtggtgaaaagattgggaaggaccaatattcttatgtctgtgaaaatcactgtaaaatttgagctaagctgttaccctgaagctgttttcccgttcttttacatcacagcagattttcattcttctcctctttccc

SEQ ID NO: 35651 - DNA, 1031 bp, Homo sapiens
acgcacatcaatgtagatgagtcatgcaaactggaggcaagtcacgggagaacgcaagtacagttccagcgtccctcctctgaaatgctgggcaccagaagtgttttggatttcagatatttttggattttggaatatttgcatatacaaaatgagacatctcgaggatgagactcaagaccaaacacagaattcatttgtgttttgtatataccttatacacataacctgaaggtaattttatacaatattttaaataattttgtacataaagttttgatgtgctttgattgagacctgtcacattaggtcaggtgtggaattttccacttgtggtagagtcatgttggtgttcaaagactttaggaatttggagcatttctgattttctgattagaggtgttcagcctgtagcatgattgcatttatataaagctcaaaaataagcaacacagcaatatattgtatactaataggttaggtttgtaaatggcaaaactgtaaagaaaaataaggactgaatgacatactagtctgttcttttgttgctataaagaaatattggagactgtgtaatttataaggaaaagaggtttattttggctcattgttctgcaggctgtgtaggaagcactgtgccaggatctgcttttggtgagggcctcaggaagcttccacttgtggctgaaggtgaagggggaactagtgtctcacatggtgaaagagaagagagagaagtgggaggtgctactctctttgaaacaaccaggtttcacatgaaccaagtgagaactcacaaagacagcaccaagacattcatgagggatccacccccatgactcaaacacctcccaccacgccccacctccagcatgggaggtcacatttcaacacgagatttggagggaacaaaacatccaaactatatcaaatggttatgcagaaagtccgcatagtggttacgtctagagccagggaggtgtgtgcaatcagggaggggcatggggaaggcttctaggggagtgtcagtg

SEQ ID NO: 35652 - DNA, 1029 bp, Homo sapiens
aaaagccagtggttgccagcatcagtataatcctgagacagttggacaggtatggcctctgggttaacatacttgttgagcagtcaaatctttttacaacaaatagaaggatctggaagaaaacttccaaattaactgtagattgcatgctgaattcagcctaaaaacaagttacaaagtgccaggttttttgttttttttttgagttgtcataatagtaacaggattgctcttacgggggttcttagactgctacaaggctgtctggcctctgcaggtcaataaacatctaaagagcaggacttggctggcctctgatcggatgaatcctcagagcatcagatgtattgcaaattacattcagagaagaaggaacaaagctgtcaaagcaaagtagattaactgaagtaacttaggcaaggcagtttatatgtgagctataatatgggtttctaatattagaacatcacagtattaatctttgaacatgttacttacgttattattcactaatgggctttgtgtttctaatctccacagcaagcgtttccaaccctttcagaatggtctggaacaccttttttatgttaaggacttatttttagtgtcagcgatagatacagcatttcaatgaaaagtaacacttttaaatggatttgtctaattaataataacagtatctatatctctttacacataacagtgtgttttggaagacatatttgtcagctcttactgtttacacagttaaggctacggttagtgtaatgtgtgttttattttgttttagagtataagcttcttaaaatcaggaacatgccatttaggggaaaaatctctggggtttaagagagtaccatgcataaatatgtattttatgaatgccaagcgattaaacacaattctaagctttatcaagggactgactggcagaaagttttgccaaattctttgatgttattaaagatttatttttgtactgagtttcatgttagaatcaaatccatgcttactgaagtggaaataact

SEQ ID NO: 35653 - DNA, 1030 bp, Homo sapiens
atgtttaatagtacttttcattcataaatgttagccccctctaaggaccaggaacccgttatttagttatctctgtgacatttttactactaaaaaagaagtaaagccagtagttcgaaagatcatgcaattttcttttgtctgggcgaagacctagcgatgacagtgttgcatagttccttcatctttatttaagcttttggagcctcagtatctttataagactggaatgataaaacctctcaacagagtcattgtaaaatcacatcagaaagtgtatgtagagcacgtgataccctacctggatctgttgttacctatgattgttgctcccatataatacctaaattattggatttagaaataatttaaggcttttctagattacatgactgaacagtacatgtggattgctttaagtattcccaatcaaaatgaagtttcattattatttagaatgagtacataattcctatgaagttatgaaaaccatattggtaaaatatgtttttaaaataccatcatcttctgctgtatgctttttggctgttctaaaaggaaagaatcttctgggtttttttttatttgtttgctttctttctaattttagatgatgatttttggtgcacagaaaataatgaagagttttgtattgtgacttgaattttgaggtctcccgaagagagatcattagagttctaaaactaaatgaaggatccacttgagaaggctaaattttcttcctctattttcctgacaaccccgatggaagtaataaaataaatgtgacaattttaccataagcgtttagtgataccaagctgacttcattaggattgtatatgttaacaagaaatcgttctgcctgcctgtctgtcaaagtcacatactctgagatttgtactcttagtgtgtgatagaaattttctaaaatccttaagctaattagctttaaaattctcatgtggttctctcacatgcatgtgtgtggttctgtgtgagagactggcaaagctggaccagtgagggt

SEQ ID NO: 35654 - DNA, 1087 bp, Homo sapiens
ttagcctggtgtggtggtgggcacctgtagtcccagctactcgggaggctgaggcaggagatcacttgaacctgggaggcagaggttgcagtaagctgagactgcgccactgcactccagcctgggtgacagagcaagactccatctcaaaaaaaaataataataataaatataaagatttcttgcttagactgtaattgactaaaactttgtcactgttaaattgcaatgtagtacagattatatacaactctaggactgttcagaatcacagcagattattgcaatgaataaaacattgcctctatccttagctctgtcaaatgagcctctgccagctttcttgccaactcttgaatattttctaaatttttataaattcattcatatcccatcatctgttatttgatgggcagtggggttaggcttaggcaagatgaatgatagggtggtctggttggagcagcattcatcgtttaataggcagcccacacgtaattgaatttagagtgatgttacacttaaaagggttttgatgcccttgagcaagacgtttgtgtaatagcaagtagtagaaaacctccacagagtttctggcatggatgaaaaagaatggggagaagaatgcattgatgtaagtgaaatttctgaattgtttgctctgaacttgcaatttaacctgtttcctagtttaatgtgtctgttatagtgggttaatctccatcttcttggaaagaaatctcatttctttagctctcatgaaatacacgattctacagttttgggtattccagctgacatatatgtgttgctataatggatttgtctttcattgtactgataatgcttctttcatctacatttatttttatggggccagaaccaggtatgttatgttttctataaatagattactttaactttgaaaacctgtgactgagcattgcaaattgcattatgttaaaactatataaaattggttcatcttctcatacgtgattttttttcccttaagacaaatatggtctctttagaaggccttaccaaagtagttgatccttctcagctaactcctgagtttgatggc

SEQ ID NO: 35655 - DNA, 1042 bp, Homo sapiens
atgtgttgcaagccatgaacatgggtgaattaatcattgagttttattggagctcattgaattttatattacatggacaggagaatattttgtaaagtaaaaaaccacattagaattcttggatgtaaaaggacttttcaaaaggtgataatccagtgtttttattactaaagcttttaatgtatctgtcagtgttcttttgttttaagtagcaccttgtctaagagactggaataccttcttttcaattactggaagaccaggttactgtcactgggattctggttcaagtcatggtagcaatgctaattgatgatagtcatctatattttcttaaatgttttcattgcaaatgtcttaattgacatccttgtccaagtaacatctatattgaaccttaagggagatgtcatagttagtttttcccaccttttttatagtaaattttatgtttttgcaatctgcacaggtgtctgtgtacttcttgatcaaacagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataagattttctggtaggtcctgcaagttcagaactgctgacttgttcttcgaagtaaagactcttctgagagaatcagacagcgcttgaagttgtccagggaaggaagttgccctttcttggtactgccccatctgtgggcttgtgtcagtaatttctctttctggagtgattgcgggttgtctttttccttccggtagatgtttgactggatcacacacaacaaaggcctgtttctaaacagctacacagagattgggaccagccaccctcatgccatggagcttcag

SEQ ID NO: 35656 - DNA, 1136 bp, Homo sapiens
accatggctaggattatttctatcatgggctgttattaacccagaaaaagggcagaatcctttgtccacaaggttttcatgtagcacaccatccttccctggctatatgttttcagagaagtataatcagtgccctctcaggatactttaagaaattataagttagttctaattacaggaatatgtaaaacttcttgaatgttttttctttattggttgttgcttcaaaaattggagtccaatatactttaatgattttgatatagtgatatgttaatctgatgcttctgttcattacattatgaagtattatataactgaaatgtgtttccaccatgttctgtcagaagcgttttgatcttaagaatacgttgcaactcctcttggttttgggtgttctgcagtggccattgtccaggagcgcttaattgctgacttagacctgatgatttattaatgatgatggttaacctcaatcaatttgtgtttgaaaaacaataatttaataattggtattaaatgcaatacaggaagatgatagagtgaaacagagctcaaaaatactgacaatcatctgacctgaccaaattgacatttatagaacatgacacccaagaaatactcagttgacacttaatgccgtatgaactggcttcaagccgtaaggtctgcatagatatttttctgcactcaacaataaaaggatttccataaacagttattatttgggtgacttgtctattttaatgtcctaaaaataaactgggagtttgttcttactatattttaagggaattatagcacatttctttctggtcagttgagtattgcatttcaaatagtcatcctctgcattccctgctaagttaaaagatgtgtgaggaacaggagtaaagaggttaaaaccgagggaaatgtgttgatgtctgtttggcttaattgaattagcttttttaattgggccttccgcacttgcctttcactcttaactgtgatggatttcgataggatctccctaggaaatttggcagtgatttctcagctgttgatgatcctggagatggagggtgtcagtggaggagattgagccagggttgggatggctgccgcaggaccgttgatgatcctggagatgg

SEQ ID NO: 35657 - DNA, 1049 bp, Homo sapiens
gttttgccatgttggccaggctggtcttgaactcctgacttcaagtgatccgcccacctcggcctcccaaagtgctgagattacaggcgtgagccaccacgcccagctgtcacttccatcacagttgtataaagcctcattaaagatcgcagtgttgctgtagcgacatgcagtgctgtagtcagcatctgccatagtatcagagccaacagcccatatgacagctgtcttcttctcaccccaaactcagcttgaggccttgcaagcacttgaaatataagagcagcaaaagtagagcccaggtgcagcctatggaacacacatgtcaggcatatggaactgactcacgccaactgggctgctccagacgtttcctgttttggtcttattttggtttttcctttctgataatcccaggtttacaggtgtcagagagtcaaaccaaggtaaactgatctggttttgaataagaaactgaatagctgaaagaaatagaaatcatcatttggaggtccatccaataagaactttgcctggagaaggaaccagctttctctgtgttctccctgaagcatgggaaagtatctgtcgttgggaacacacatgacctttcaggaggtaattgacctgcactgttggtaggagcatcttatgtagccatctgaagacagattggaacctccttactcagaagggttcgattgtttggccaaggaatgtcaactgttgctgcagaataagctgggtggttacctgctgaccccttttcattcttttctgctttattagaaccttgatatgagaataagttcagcaagagttggagaggagagtgaaatcattcccaggcttcgtgtggaggtctgtgctttgcaggccatggcgagctaagcctgaaaaagaattaagacggtgttggctttgagtcggcagaaatagtgcaattcatttcataaaagttttgaaggaacactttttctttattacaggctaaatgtcttggtgtattttgcctgtttttgttgtatcttgggaatgccattttctag

SEQ ID NO: 35658 - DNA, 1047 bp, Homo sapiens
gatttaaataaaagacagtgactgagtaactaaaataaatggaaccaggttgttaattttggttttatagagaatgtgggctggcagggaggaaatctttattttgcaactggaaaaaaaatctgactttgtataaaaaagaacaaattcagagtattttagatttacctttgcttttcatttgtttcatgtattctttaaatggattatagaatcagaggagcttattttcatttttgtgtgcgtaagatgtgacttagaaggggttctcattgttttgacttaaaacacactaattcattatgtattgtatcttgagaacagtggctacagttgacagatgattatctattttctctgtgtgctctttggatgcagaattacctgtaaaaacaaactagcttagtatgttcttggttgctttatgtcagatgtattatgtagtttttcaagtagcaattctagagatgaaactctagttttagaaatattttaaagacagtatttacaaactgaagtggaatgtagtgagcttggagttgagaagacctccatttgaatctcttttcttgggcaggttacttatccgagcctcaatttcttgcttaatagaaataatgattaaagtctgctctctttttatttgtagcttttatttgtgattcagaattcagaatttctcaaagattagaaaagtaacacagtgtacaatactaacacttctagtggcatctggacagcccccccataatcaaatgcatggctatttctatagctgaatgttcaaggacttgcacttattaagtactcagtaaagactatgtaagtaccctcaggttaggttttattgacggatgaatttttagaaccaagttttgaaaaatatttggaatttcagagctttctgtggttgagatcatggaactgtattgccctcccaagcagagcatagaacagtcattcaataaatagagctgatggcaatgatgcgatgcatgaccatgatagaaaaccattctaggaagtatttgcaatcaacacctctgc

SEQ ID NO: 35659 - DNA, 1051 bp, Homo sapiens
gtttaggtggtggaagcgagtcatacagtgtaacttctgcagacacaagacctagctgcaggggccctgggtttcagaatttgttttagacacggctgcagtcacctcaggaagcacttggatccattttgcatgcagttttgcagagtcaagaacttcctcgtaactaatttgaaggtcctttccttaattttgtacagtgattgtgagtagctctatcctgttgaatgaatccatgctaattgatgtgtatgtgtggtgtgaatagccatcgtgcattttcatgggctagtgtaaaaaaagaaataaaaaatacttttcatgcgaagctttttgcaaataactgtcaggaagatactctttcatgttaatgttcctgttttagattttaaaagttatgattaaaacagccagtaaagcccagaaaactcaggttcaaggaagaatctggttttgagagcacagaaggtatctttactatcattagtaaatctttggcatagcatccttcctaagtacctgctctgtgaattcttaaaccaccctcgctcttttctgcctatccccctggattcaaattatctttcagagatgtaacctgtcacaaagttattatccaggaagccatttctgtcaacagcttttcgtatgtgccacgtaattatcttgtcttcctggataaaagagtttgtcatttaggaaagcaggagaccttgaattcattcttgatttttaaaagaaaagcagaccagtgactccctggtcatgacttaactcattcatcttttgcaaggaggataactgcctccataacacgtggacatacagaatgtccccacgtgtagcatgctctaaattctgatttgtgacagccgttagagcatgcatatgtacaaaataggctgttgctttgcagtaagtttggttcctaatataagatgtattgtttttaatcttttaaaataaattactagtggaaaattcaggtcaaattatttgctatcaagcattttctttagactggcacgtatttacagggtaccaaatcttc

SEQ ID NO: 35660 - DNA, 1029 bp, Homo sapiens
ctatgcatatttcagagaaacaaagtcatctggtaatagtgtgtttttgaagatatgtttgacagcaaaagaacacttaaaagcttagcttggatttgccatcattagtaattagggaattggaaattgaaaccatagtgagatataccactcatttagaatggcttaagttaaaaagactgaccacatcagttattggtgaggaagtggaggaattgaaactctcatacgctgctggtgggaaggtaaaaatgatacaccactttggaaaagcttggcagtttcttaagttaagcatacacctgccatatgatccagccattctacacctaggtatttatctaaaaggaaggaaatcataagttcatacagaggttgtgcccaaatgtttacagcagctttatttgtagtggctccaaactggaaataaccgagatgcccaccagcagatgaagggatcaattgtggtttcacacatgcagggactgctattcgacagtggaaaggaacgaacccttgatacacacagtagtatggataaatctcagggtaattatgctgaatgaaagaagctggacagaaaaaaaaagagtacatactgtcccattccagttctagaaattattttagaaaatgcaaggtaatctccagtggctgagagcaggtgagtgccagggagggagcatgacagagggcatcagccagctttgaggtgagggagaggctcacggtgaagtgggtatagacaaatgtcagaactcacattggacactttacatttgtgcagcttatagtatgtcagttagtcctcagtaaagccgttttgtaaaaagcttggcttggaaacagaagaccacatgcacacacagtttctttctgcaagtgcagttttgacttatgagtcttgaggcagcaggcgttgcacagggtatcaagcgggaggtcccgacttgccccatctcaccagctgagccggctgtccccactagacatacagaagatgcgtgagctgactcttagtccctgagg

SEQ ID NO: 35661 - DNA, 1030 bp, Homo sapiens
ggaggatcgcttgaggccaggagtttgagaccagcttgggcaagatgacaagatcctgtctctacaaaaagaattttttttaattagttgggcatggtggtgtgtgcgcctaaagtcccaagctatgtctgcttatttgaatattgtttgattataaaggtattaagaaaatgcctaacatcacataccacactcaaagctagatttaagatttgccatctttcacctctgctccactctgcaggccattgtgtatggccagacagcctgctcactgcccagctccaggggccatgcatgggggatgtgatgtacacatgactatttggaattgagtaacatggtggcctgctccactaataaagtgtatatgaaagaatttttccattcctgaatactccttttcctcaagtttgatgtgtggttattgaaagattgggcaatgacaggcttatttttattcttgtattttataagaaatgtctaaaattgtgagtgatatatgacctttctgatcctcagatatgtagaactgtttcttttgttgggtttattgaattggttataccaggaggaactggtagattttgaaaagaacacccctcacctttccttttcttagcaatctttttctttggtttctgactgcctttcccttaatcagaaaacacctgctttggtgtttggagatgtcctttgatttttcatcatgagctgaggctccctcacttgccttctgtcacccgatcttagaatcttctaagaaaccattttgcttttactgtatagagaattcttagctctgaaaggaaagtctttcagtgcacttgttacaatgttataacatttttagtgttgatggaaatgaagctggaaggctaaacaagagtctcccatccccggctcgctgagactcggctcggtccctttgcagctctcagtgcagtcatttctccacgggtcttgcaggcaccacctgcatccaggttgtgggtgtttatttaagagagatttctgtcctcactccaaa

SEQ ID NO: 35662 - DNA, 1038 bp, Homo sapiens
ccattcccattgaattaagcagatttcagtgattttgtttccatttgaatgaagcctatcagtctttctccaaaaagactgacattctagaaattcttttaatacagactcaactttatgtttgtacttatcttctacagaaataagatcaggaaaactatgaaaatatttttataggaagcttaatttctctgaagccgagccgtcaggtgccctgtgacttacttctgagggttgagagacagtggagcccccttgggactgcaggcctatgctgtttgctctcttatagtaagagaaaggaactgaagaagcaacagaagtgtattctgaccaaaataaaatgcattttcctttggccacaggaggtacatgattctcttttaatattgttaaagcagcggcagcagaagctcctttaggtggcctgtgatgagatgatgctggggtcagcaagagcgcagtcccctcacccctcagcagaaggcagaaaagaccaaatgggtcttcagccaaatatttacgtctccgaagtatatgctcagtgaacacactagcacttgcccagaaataaatttgttagaaagcatttgaaggcgaaactggctagctgtttgaaagtcacaataacttaccctagttaagagctacatgttttgttcattctttagggggcacagatttctcagtttctggcatatctcactagtaaaatgttttaaaacacctttgtaatatgataccatttttattctttgcagcatattcctaaaggagctggaaaaatatgaacagttgccagaggatgttggacattgttttgttacttgggtaatgaaacctcaaccatttgttctctcccagctattaggtgacgttgaaggaagttaggagggatggtcttcatttcctttaagtcaccatcttctgctcatatccatgcttgcggagaaatagactttacctcaaagaattgcatacttcaactaattgtttttgtggagtgagtttttttattggccctggtgatggtttgaa

SEQ ID NO: 35663 - DNA, 1039 bp, Homo sapiens
catttactatatatttatataattaccctgaattttttgaaacacctagtcaattaattttactttttaattcattagtatttattgacctgcctaatttctcattgcaggagttaaatgagagtgtgtgtcatgattatgcgtctgaactgcactgactgaccctaaacataaaatgagaaatcatcagttcttgatattttagtacccttagttcccagctgtggcttgctgactgcgggccaggcatggtgcactttggtacgctctgcatatgttaacctcccaacaatgctagtctgcaggcatggaaactagcctcagactgtaaggagtgtgcccagaatcaccactcaaacacgttaacaggctcagctcagaacacagatctggctgatgcccagggcttccactgaagccacggagaacccatgcccaggaggcttcctctgtcttgttgcttgtccctgatgtcacacccctcgcggcacaccttgtccatacagaccgcaagtattggagtcaggctgacctctgctttttattagttgtgagtgactatagttaaaatcacatttaagaaaacaatagtgattagtcttgacaatagaaaggtaaacaaaacttagaatttgtgctaagagttgtcacaaaatgtattttatttttatattatatatcatcaatacacattttcttgactacctaaaaattgacagattttgtctggtaatgttcagcataccattttctcagctggtgaatgttattaagcattaaaatgtagaaacatgcattcatcccagtgatggtattctatgaatcctgccatgttccagggactgccctaggctcgacaacgggaagttattatgtaatttgtctagatataaaagaaatttagaagatggagttacaaatgctggaactcttctttaccctttttgttagcaagaaaaatctacagacagtaataagtagctacatcgttttgtgaaagtgatactattatgggatttttcaattggaaaagctctcc

SEQ ID NO: 35664 - DNA, 1023 bp, Homo sapiens
agtggtgtgttaggaagaattatcctctgtaggatgggtcagtggcgtcgagtcaggatcagatgggaaactcttatctagggttggccgatgggcatttttaaaattgttgaaaatactaataatgctttcttgtgcatcagtttttatttttcttttaaattgatttgcctcccttttttcatgttgtagggtttgatgaaaacattgagtctcagggagaactcatcctacaggaatccttccaagtgtgggacccaaaaaccttaattcgaaagggtcgagaacggcatctcttcctttttgaaatgtccttagtatttagtaaagaagtgaaagattccagtgggagaagcaagtacctttataaaagcaaattgtttgtaagtataggcgttcagaattgtaagtctaaaggtaacacaattgcagtctttttgtaggtagagaagaattgttcattgtcttcagtttaacctcccaatctgtcctgaaatgttcaagtctgaattgtggtagggttttcatcttcagtgaaattatttcccaccctcaagtccactagagggtgctctggagtttatagacttaggaaacttgctcttcttaaatcctgtatcatataactgcaggataagaaaacatttcataagtgaaatcatttatctccggtgtgcttaactagctttataaataaaataatcatatctatgactaagttcttattataattaatttttcaaccataaacattggagtatatggaaacagccttactgggtggctcacatttaaaaataaatgtatgaaatataagtgcatgagtaaatttatggttgtttataacagtgaaatgtcattattagagaaaatatacttaagccaaagtacagtctgaaagatccacagccccagctatgtggagacagctgcccctgagtgcttggcagatccggtgatgcattttaattcgtaacctgtcattgtacttcttggcaagagcaacatacctgctgccatttt

SEQ ID NO: 35665 - DNA, 1026 bp, Homo sapiens
tgccatcagcggctttgggatgtttgggggacggtggagctaaggcttatcgaatattgggagatgagccagagtgtaatgggactctggtgtatgaacctgcatgtcaccccttgtgtctcttgcatgctttttcatctctttggtattttcagtgactgtgagttactcccctgtatgtcagccttctagagcctgttcttcagtggaagccattgtgttcataagatttttgttcatatgtgatagtgggttgttttgcagtgaatatgtgattatcagcccaatgtgctctggctagtactggcataaagccctatatgatatcagttgcaccgatagctaaatttaaataactgtattttcttcctaaggtctaacattttaaggtatactcaaaacctggaaacttgcaacttatataaaccgcttatccagactagctacagtagtagatgccaaaaggtgcttccaaaaaatagtgacagatactttagccagatctggactttcatttaggatgtcgtaaatgctcatggtacagttgacaaataagactcttcttatttgtcaggcttcgccaggtacaagttttctagggaattttgggtaatacctttctgacttccaaggagaaagtaaaggaaacgatgttctcattaatttcagggattgctgcatggtgttggtgtagagaggcaggcgatggtgatggtgggaatggtagtgtaatgatgatgtaggtggaggtggtggagacgctgtggtggtggtgatggcggtgaaagtttagatggcagtgagggtggagatggtggtggtatggattttggtggtcacggtggtatagatggtggtgagagggtaagggtgtagaggaaggtagtggtatagatttggtgatgggggtatgggtacagatggtggcagtggtgtagatggtggtgatgagggtatagatggtggtggcatagactttggtggtgatggtggtgaggttgtagatggaggtcatcgtgtagaatt

SEQ ID NO: 35666 - DNA, 1035 bp, Homo sapiens
aaaaaaaaaaaaagtctggatcaagtgatgtcgtgcgtgctcagtctgcaggtgcttgctgacaatctagtctgtgtggttctcagaggacatttcttgagagttgtaatggagtcaaggtgaatctgccatcggggattggcagttggtgagcttggaacattgggcacatttcttctgtccacacctcagttgctcatttataagacggggctgcaggagtctcccacccgcagagtccttatgggagtggatgacagcatgcgagaagccctcggctaggcacagggggctggaggtggtggcagctgcgccgctgttccctgagtccagcaaaggaggccgcaaggctgtggggatttgttcagtttcctgctggcagtatgccccctactgaccagtgcgcagtgtttgcctcaatagcctcagaggcgttttggtggcagtgagggtggctgtgttggtttatttgcccagggctgcttaaaaggtcttggggctggagaatgatggattattgcaatagtcagagatctggagtaatatacgtgctataaaacaaaaaaggttttgatgaaaacgtatttttaaatagtcatttatttggtagcatattaaacgtcggatgtggttgcttttctgctaaaaagtcattttgaaaatagaaactcaaggaatgcaggaaacctgggtgtggttagggcaaggtctggaaagggccgttccgtatcctaagcaacgctaacaccttgttaaggcttccagcatagagaacaagcaggactggataaagcatatccgcgaagtcatccaggagcggacgatccacctgaagggagccctgaaggagcccattcacatccctaagaccgctcccgccacaagacagaagggaaggaggtgcgtgtctgggcgccactggaggtttgtggatgtgggagggaggggcgaggcggtgttagctcaccctgcttcaaaaatcctttctctcaaacattttgaggaatacattttttaaactgccatttgtggata

SEQ ID NO: 35667 - DNA, 1086 bp, Homo sapiens
ggaggagacccactcctaacagcttctgtaagtcacatgcctaccaccactggcactgggggactcagggtgactgtgcccagccccatctccgccctcccagtccagggatggaaagttcacagaagagtagggtgagcctgcttctggtgatgaaggcagacacacacacgtgtaactccagctgtggctcacttcagaattgaagtgccatggaggacaggcacgagagggacttctcggagccagtggggagcttagaatagaggggacgtgggggctttcagcaagagggatggtatgggctacttacaggcaggacccctcaggaggaggagggaggtgcttctggccactgggggggacctttgcctcctatgctaaggcctttgtgtgtgagggttttgcataagaggatgacgtgtttttagaaggtctcctgccagcagtgtttagatggcttggaaggagaacctggagtctgtgagggaggaagctcaggagcccctgcgggacccagtgaagtgattggtatgggagtgcagagaaaggaagtgatcggagagccgcgcaacatctgctcgacagcatttggagggaaaagagtggggttttttagcttgagtgacttgatggtgatactgttacccaaaagacaacaccggaagaaaaagagatttagggggtgggagggcatgatgagtcatgtcccagactctgcattgcggggacagggaagcatccagttgcccagcagggatcgaaagtagtctgcagttgggatgcttgctttgctcgggaggagtcagcttgagggtgtggttgaagagtccctgcagggggacagtggagaagcagcagagacagaacctgggacagtccagagaccaggagctgctctcgggattcttatgtagaaaaaacaatgaaaagattcttaggtaggagggatgttaatgagcgcatgagccctgtccccacggagtttactgtctaagggaacacacaccagggctcaggccatctgaagcagacagtcatgagaagaccatgcacttgttttaccggcagaggccatggggtgtg

SEQ ID NO: 35668 - DNA, 1046 bp, Homo sapiens
tagtctgttctgcagaggggccctggtgaacttaagcatgcctcaaataacacttgttctgaaggatttcttccgcatgtgcctttcctgtggtgtgttcttacttcctggtgtttgcaattgcaggctagccaaggcgaaagaactaggcattcatcacacttggcttcgtccggaaaacttctggtggaggttgggtttttgaatgttgctacgttgtaccattttgtttttccctatgatactctccgatattcttgtacctggaaagtcactctgcccctcacaaaccctctaatgccctatttttaccaagaaggtgtttcttaatgagcaagacctgctgtgaacttatgccagccagtggttaggggctcagaactgtatccatttttttcttttttcccttatttaattatttatttatttattttattttattttattttattttattttattttattttattttattttattttttcctgtaatgcaaggaaactcataagattgttcctggccaggcacggtgactcacgcctctaatcccagcactttgggaagctgaggtgggtggcttacctgaggtcaaaagttcggaccagcctgaccaacatggtgaaaccccgtctctactaaaaataggaaaaattagctgggtgtggcggcagacgcctgtaatcccagctactcgagaggctgaggcaggaaaatcgcttggacccaggaggcagaggttgtagggagcagagatcgcaccattgcactccagcctgggcaacagagcaagactccatctgaaaaaaaaaaaaaaaaagattgtttgttcccttgcagtgttaggagctgcgcagcaacagacagcaggtgtgggtcagaagtaacatggaaacggagggcgtcttcaaccacaaggataggaagcggtagggcgtgggtgaggtcctgaccatgtccacgtccaggaaaccaggcagcttgaccagaatctctgtctaggagacagaggccatcatcaaaaagtcgggcaacaagggatgagga

SEQ ID NO: 35669 - DNA, 1592 bp, Homo sapiens
aagggaggagtgagtggtgagcttggaggatgcgttcttcctgtcaggaggcctgagatggggcgggcgcaggaggcctcccagggtcttgccagctctgacattctgagttcagagttcttagaaggctttatgagcaaaggccgattcaaaactgccgtttccttacaccaacccatcatgtgatgacaggtggcctttttgcttgtgctttcaaatatgtctagaagaaaacacccacttataaaaattaacctttaccactctaaaaggcattcacaattttaaagttttttctcctttggatagagaaaaagtatggttcagtacctgcattttatttcgaagaagttcagagtatgagtcatctgcagtgaatgagaaaattaaagggaaaaaaaacatgagaaataaaaccttttgcttgtgggtgacttgagcctctaaacccaggggctttaactcaggatgctacgttttactatggtaaaatctgtgccaaaaacagtcccccatagtttaccacaactccagtgggcactaccaagatcagctctcaggcttgaccagactggctgcagtagttaagagaagacgcagggactgtctttcgtaagtgtagtgatacatgattgctattaatcaaatggggcatttttttctaactcaagttaaaaatgagaaagagacatattttcattcggaactgtccgaaatgttgacttttctgtgggtccaccctgcttttctccaagctctccttgcttctctccaagctctctcccaagggttttcttgtccacccgaatagtttacttttccacttgactgtcttagcaactttttcaaatctgaagtattcagattccctctcccaccatctccccacttgttcacccaagaacatggctaacgcacgtgagggtctctccactgcccaccacagtttttaaaaactggtaaactccacataacaaaatgtatcatcttaaccattcttaagtctacagatcagtggcattaagtaccttcacattgttatgcagccgtcattaccattcacatctagaattcttttttccgtcttacagaactgaacctctgtgcccatggaacaaaaccctccgctctctcctcccagcccctggcactgcccctttcctttctgtctccatgagtttgactgttgtaggtgcctcatgtgagtagaaagtcatgtagtcttgtccttttgggactgtttatttcttgtagaagattccgtgttctgacttttgtcagaatttcctttctttttaaggctgaatagcatccccttgtatgcagatgccacattgagttcaacattcatctgctgatgggcacttgggttgcttctgccttttgactcttgtgaataatgctgctatgaacatggatgtacaagtaatctcttcaagtccctcctttcagtccttctgggtgtatacccagaaatgcaattgatggatcatatggtactgttgtctgaatgtttgcgtccttccaaaatccgtatgttgaaatctaaccgccaatgtgatggtattaagaggtggactgttgggtggtaa

SEQ ID NO: 35670 - DNA, 1027 bp, Homo sapiens
tccagctgtggctatcaggagccctgtctgtgaacttctgacgtgctcccaacttgttttagagcactcctttactttctggcactataggatgtaccaggctcatattgtattttgcctgccacagtcctggagtcagccatttctccaagaagccctcctggtccgttttgttggagaatggtcttagaaactaaggtttgggtgctaggtatgctcattgctgtgtgttgccatggcttcaggccctcttagcagatgtgtgtgtaccaacccatgcatacataaacatctgtattttctgtttcccctcctccatcctcccctgcccccatctccgtctcttcttgtattcatctgttttcacactgctgagactaggcaatttacaaaagaaagaggtttattggacttacagttccatgtgactggggaggcgtcacaatcttgatggaaggcaaggaggaacaagtcacatcttacatggatggcagcaggcaaagcaagagagagcttgtgtaggggaactcctctttgtaaaaccgtcaggtcttatgagacttattcactgtcacaagtacagcacgggaaaaacttgcccccatgattcaattacttcccaccaggtccctcccacaacacgtgggaattcaagatgagatttgggtggggacacagccaaaccgtatcattccacccctggtccctcccaaatctcatgtcatcacctttcaaaagcaatcatactttccaaacagtcccccaaagtcttatttcagcaataactcaaaagtccacagtcaaaagtctcatccaaaacaaggcaagtcccttccacctatgagcctgtaaaatcaaaagcaggttagttacttcctagatacgatgggggtatagatattgggtaaatacagccattccaaatggaagaaattggccaaaacaaaggggctacagaccccatgcaagtctgaaatccagcagagcagtcaaatcttaaaactcagaaatgatctcctttgactcc

SEQ ID NO: 35671 - DNA, 1031 bp, Homo sapiens
gagacaaacgttatgtccttaaagcagcactatcttgatggatcttctgttctctctgtgacattttaaattgtgtgtccagccatcaaagtaaaatgtcaaaaattatcaaaaataccaaaaaacagaagttcttgttttccttcacaaactccgttaaatttctacattacacgtgttctcttccgccaagtgcctgtgacgtttgtctctgacccaccccattcgctccattttcacatctctctcctttctttgcaaaattcaactccatctgcactaaacctgtctcactgtttcattccttttcgaggtcctgttcattgacaattcaggcttctgacatcatttcctgaccccctttacttacttgctaatgttctcacacggcagatagactcattcagcagatcaaatgaggtttaagactcaaagctttaacctcattgtcccctttctcaagcctttcagtagcttccagtttcctttctggttacatcacattgtcgcttctgtaatttgttcccagttaaccaagtcacccacctgttttcacctccttctccttcccaccctcacggccatggttttgaaccagggtttcttcccacggtctgttgaggtcactaacccctgtgtcgtcttctcctgaaccgagtctgttcagattctcagaccagatccctggccatgccaccatggtagaaataggccttggcgtcaaaacttatttccagggaaattttgccagtgatttggacttccttcctttccttttgcctcgcctcctctcccatcggtcatttactcacctccgcatttccgctggttccgcgtttctgtctagtggctcaggttgtcgcccttcagggcatgcctttaattgagataatttctctttacttactgtataaaatgccctgtcccatctgacacgctctgcagtctctcacctacatgactggaaggagggaggggacccagaaggcgtcttccttcctcactccctcatctgtgcgatgctacacctc

SEQ ID NO: 35672 - DNA, 1063 bp, Homo sapiens
ggatctatcacgggaccgtttaaagggaaaaacaaccttacgctttgcttttggtgttttaagaagaatatgaagcctaacgtgggcccataaatgccagactcccctctgcagcagttggtgagagagccgttggagcgcctgagacagttttctctgggtgccctggatatagcatcttgatttttatagtagttaattgtcttaaactcagaaagaaactagaagtctgtgctgttttcacgttctttttcctttgaggattttaaaattttattatgcaacaaatgtggaggtggggacaaaaccaaaattttaacttttttttaactgaggaagtaaaaaaaggcaacattcttcttagcaaagccataaaaaacagcacaaataaaattgtttatactgtcaagttagataaagcagacatgagaaaaattattaatataaagaattcaagatagtacatgttttcttaaggttcaacaaagaacacttcctcaaagaaattgtaagcagctcagagccacactacaggttgagatatgtggcgaatattccaggtgacttttcgtcagaccaaggcaagggcatccaggtctagtgtggagggcaccgaggaacaggggagcgcacacacaccacagaagctggaagtcagacccgacagttcccacgcagtggacattctcctctgaagccattgtgtggtgtgggacaagggagcgaacatatggaaactttcaaagagagagtaagaatgtttctccgctaaggaaaagatccaatttccaaggaagacaagaaagaacttctaagatacgctttcctaaaaactccttatagttcgcatgcaagaatttacattttcagttctctggctgcttcctgtgaggaagaatgaagatatgtttttaataagtgaggagcggcattacagcacagtgatgtaaccagttggctattaggccgcattacatttctttttttttatcaagtcacatcaggaggtgctgtttggtgtgtgagtctcagggcggacctccctccagatgtacacaaagcc

SEQ ID NO: 35673 - DNA, 1030 bp, Homo sapiens
gatgctcgggctggcgctgctttctctctgcctgctttctttccagtggctgcgcagtgattgacatgtgctttaaaacagaaatgttttgtgcttggaacctgaaacgtgttccgtggtgaccaccttgggagggggctgtgtctgggagatggtttatgggggggccactgggaatgtgaggagcaactgggaacagagcactgcacatccattgtgtgttgtaagacctttttaatatctggggactgctttttattatccctttttcttataaatggcatgtaaagagtgtaaagtaatctgtgctacaaattgccttatgattttagttggctttatgtctgtttcaggtttaattttgtttggaggttttcagactagagaaaacaacatgtcctaacatatttagactctggctctccatgagaactacagccatatgataagataatacaaagttagctggggagagggatgcttccaacgttgccattgtattcaagggagtgtctgtgccagattctggctttatctgcggaactagggaaaagacgtgaagatgtgattcctgcaaaggttatttgagaggtcggtaagcttcactttgaggaaaaggcaacaggatacaaaagagacaaggtgaggggagttgggtctgcagatgcccatggaatgctgccctgttccagaggccagctttgtttcagtaacctttgacagctctctgtccagaccatacagccgaaaaaaggagtctctcacagggtgccacctgcatgccagcaggaatgctctctaccagaatttgggtcttggcctgggtcactttcagtgtttgccttcactttcttgtcagccgttatccgcgtatatgcttcggaagtgggcggcaagacgcagagagccaaggggatttgctgagacttaacggggcacttccagttcattaagagctctatggagaagggtctttcggggtgcagggatcccccaaagaaagggggtagggtgtcggatcaaaaggggg

SEQ ID NO: 35674 - DNA, 2139 bp, Homo sapiens
catatgcatcacattttaaaaggaagaatgattctgggtaatatccaagaaataaatcccaaagtaactttacagtgcccatgaaatcactgagtgtgattgcaaagcccgtcttacacctgcaagcagtctggggcttcatgtgttagagtactttgggaaaaggcagttttcctgcttcctgaagttcattggggcatccccctgtccaaatgtgaaccagtcttgcttggagtaatctgcacagaagcctgttttatgtgctgacattgccattgtcaataacttacacagacatgagccaggagagttttactgctaagcgattgttaagaaaataagagaaggtaaggtcaagaagaactgtaaatcttcttttatgacgtttccaatgggagagcctagttctacggataagagagtggaactattgggttggttatcattctgaaatcagtattcccttttataggacagatggaatctattccagtgctatacgtattcccctgactcaagctcaggaaaaacataatctggtgactctccttaacactgaacagactcttacacaaagtgaactgtgtgctttataattcttgaattctcttgaagtcttttttttttttttctttctgtttgggttaggaatatggattctcaccactgcaatttttgtttttataaattaaagggaaacattccaaagactaaatataggataaagaaatttctttgctgaagaaatacataatatgaacctattctgaaagtatccaagtggatgaacagtactgcctcaaattaaagctgtcagtacatggaatattcagtttcacatgaataaacaaaaaccacagaagtacttgtcacaatgttggattgtttcgactgtgaagactgattgtgtcacacaagttgctgtgcaaactaaattctatctcaaatcgttttttgccctttaagtatctttaagtgaatggtttaagacaggatgtgcagtataggatagtgggaatggtgtgttgctgtagaagccagtttgtccctgctcacccctacctgtgtgatcttataagttcttgataatctcgctgagctgcagtttcctcatgtgtttaaaacaaacaaacaaaagaagatagagaatgctcgctattatggttattatgctctccaaaatctacattgaaggttctatttcattttaagcaaactgcattttaaaaataattttgttcccttgcttccatgttaaacacgaaaaaagagtgttacacattgaatttgtatatatttttagccaagaagcaaagaaacttgaagttatttggtattatagccttttttagagtgaatataaaatcttgaaatattagaatgtttttgaagttaatattaaaattagactgaaacctcccccaaaaagtgcccaagaaacccacaggtcccaggttaggagccttcaggcaaagtggcttttcctagttttggaattcttttcttatttctagacaaggagcaggcaccctcctcgtttaactgtaatctgtctttggtatgtgctctttctaagtatatctcttcactagattttgggggaacacaaatttatagtttttcattctgaaaaatttcctccaggtgctcaaagttggcctcagggacacgtgagcaagtccataaacagagtgagtcggcctgggagctgggtaacaagccatggaattcatccatggagtcttcctcatttcctcttcctgtctccaaggagtggcagtgggggctgggcagccataaagatgctcctattaattttttgcaattctcatataaaaccatacaaatatgagcaaaccacataccccccgccaaatatctagtttctctgaaactatatgtgctaagtggaaaactcccagacagagcgagcagcagaagggaacatagcacccttaggcagccactaatcacgttggacacatcttctagtctgtttatatgtaaaatgatgcttcttttgttgatacttttaatatttgactataagaaaccatctcaatcatatccattgtccagtttctcagatgcgcagttgagaaaccttgctattgctacttcttgttaaaatcaacaatt

SEQ ID NO: 35675 - DNA, 1378 bp, Homo sapiens
taattggtgttcttagcagaggcgttcctttcattccctttgtctccatctccgcgcttgctttgttcctgcctggaataactccagccctccctccctccctcgctcccttcctctatcctcactgtgatcactccgaggcttgacaggcagggaagagttcctcacaggaagacttaacaacaggaaggtgcgggacattcttagaaagccgccttctccccaggcactggcagcactggagagacagcgtttgaaccccatgtgggatacatggagaactccaaaagcagttgctccagccctcttttctttttgtctttggcctttattgttgtggtggttttagtatgtgataacccaaaaaagtgggagacagctctcaataaatgacaaaatggtgatttgaaaaataaaatgcagtgccattcagtgcatgtgggtgggcagggggaagagagggggacaagatgtcataaaatcaaattagttcaggtcttggtgttgcatcccgtaatgctttgtgtgcttgggagtagatggtacctgtggggtgcatgcacctgggggcgctttacctcctccagtctgtgcgacatgtcttcatcctgtttccaagtgcttattagctttagttgagcagcattttccttttgatgggggagttactcaaatataattgtaaaaggaattcctaattggttacagcttttgtttctttgtttttgaattaaccagggactgtataatataatgtactagatatttgctttgtggtttattggggggaaataatcttctggttcctcattctacatagctgtagctctttctaagctaatattccatcccttgaaactctgaaactttagctaacctttgctgtagacagtgtaaagtggctgggcgtggtggctcacacctgtaatcccaatactttgggaggccgaggtgggcagatcacttgaggccaggagttcaagaccaggctggccaacatggtgaaaacctgtctctactaaaatacaaaaatattagtcgggtgtggtggcgggcacctataattccagctgctcgggaggctaaggcaggagaatcacttgaacccaggaggcggaggtcacagtgagccaagatcaagccactgcactccagcctgggtgacacagcgagactgtcccataaataaataaataaagagaaatagtagttggcaggctgattgcagaatactccaaagccacgttttttccccttaatgctgttattaaaattagtatgttgtcatgtggctctgtgaaaacatgtataagttagcatggtttatagtaaattttcttgaatgtaggtaaaagatgtttccatgctagcattctga

SEQ ID NO: 35676 - DNA, 1044 bp, Homo sapiens
gtaactatttctttgcataatagatgcatctttttttttttgagacagggtctcactcacccagactggagtgcggtggcacaattctggctcactgcaacctctgcctcctgggttcaagcgactctcctgcctcagcttcccgagtagctgggactacaggcatgcgacacgatgccaactaatttttgtaattttagtagaaacagggtttcatcatgttggccaggctggtctcgaactcctgacctcaagtgatccacctgcatcagcctcccaaagtgctgggattacaggcgtgagccaccgtgccctgcccagattgatctttcatggtatttctcaggtcagttctgtcctgagcccccaccccgacactgctttacatgacaggcagtgttcacgtacacttagtctggactctgccttctgagacagcaaagcagtaacacaagtgagagatgagtcgctagaagggttgccttatttgctttgaattatcatctttgaataaataattcacaaactcatgaacttgactaaaattagatgttacttgtgttcacttcaaaactgatcaggatataccagtaactcaggacatcaccattcatagtggttgacttatcagtcagtatgcataggctgagaaataatagcttgcagctggtttgttggctcacctgtttgtcatttattcagtgtatactcattaagctccaggtgtatgccacgctgcctgctggcagctgggtatgtagttagaaacaaccagacatggtgccctggagtctaaggtcatggttggcttcctgccttcacagttgcccagctaggaaaatgttgtgtccgaaattgttgggttcttggtctcactgacttcaagaatgaagccgtggatcttcgtggtgttacagtttttaaagatggtgtgtccggaggttgttccttctgatgttcagacgtgtttggagtttcttccttttggtgggttcgtgggctcactggcttcaggagtgaagctgcagaccttcgcggtgagtg

SEQ ID NO: 35677 - DNA, 1058 bp, Homo sapiens
cattcctgtagtcccagctactcaggaggccaaagcaagaggatcacttgaggccaggagttcaagaccagcttgagtaacatagtgagaccctgtctcttaaaaaaaaaaataaaaggtcagctgctgttgtctttgtcaccattatcatgtcctctccatttcccttgcaggacttcctcaagtattccaaaaaggccagcctggatacatcagaattagaggtacatgcatcagcggctgtgggcacccaaatccccaccagcctcttttcctaatccccaagtgtctcctaacagtggtctggccctgggagggggtcaaagcagtggatgacagagtctctccagtgcatctccataagccctgcacactagagggtggggaggaagaacagaacttcatcaggtcagagggtgagcacgtcagattttccctagaggaacttgagctttcactcttctctctcccctcccacagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacgg

SEQ ID NO: 35678 - DNA, 1029 bp, Homo sapiens
atgagtgagtcagggaaggcacatggaggaggtggccaccaccccagggagcccaattagacaagtcagcttggattggacatggtttaaggaaacgcattcccagtgacaacctggggagaggtgaggaagcccacgtgaagatagggatgggcagatgctcggcctgggctggactgcaggtcaggtgagcgggccgaaagaggggagaggaaactaagtggggagaggaggctggatgagtggggtcgggagggccaggctcccgtggaggcctagaatcacagtggcagctgtgcttcccaggggctgcctggcagcaggaccacgtggggctcccccacttagtgcttcttttcacaggaagactcttgaaaggatgctttctgttcctgtggacatgtacacagggttcattactcacaggtgatttacagttggcacttttataataaaatcctctttgtagtgtatttatgattcattaaccatgtaaaaccctgtggacgttaagtaaatactgtggactcttgatctctcacggctgtgaaaggaggcgtggggaggagagagcaacttagcctcgaggtggtgcggccaggtgaacggggaggaccatctgtagcagtgctgtccaatagaagcaaaaagaggccacatatgcaagtttagatttttctagtaaacacattttaaaaataaaagtaaaagcagtttttactaacatgtatttaatttaatgaaatacatccaaagtattagatttcaacatgaaatcaatatttgaaaaatcattagtgaactattttgcattcttccttcacactaagccccagtgtctgtgtgtcctttatgcagccaccacatctccactcgcatgagccgtgtggcaggtgcccggtggccacgcgcagctgctgtgagggacagtgcgtggcgatagccttcttacccaagaagctccacgggaaacaagctcaggcaggtgctgttcttcttgcaggtccagggatggatgggatcatggtg

SEQ ID NO: 35679 - DNA, 1049 bp, Homo sapiens
cccccccaggagggtctgtctcaccccttcccagtcaatctctccctcccaaggtaatcactgttctgatttctatcattcatagatatgtttgccttttaagtaaaactcatatattacatgcttttttaaagtaggttgtaccttttattttgaggccattgtagattcacatccaattgttatgaaatgtacccttaggctgggtgtggtggctcacgcctgtaatcccagcactttgggaggccaaggtaggcagatcacctgaggttaggagttcaagaccagcctgaccaacatggagaaactctgtctctactaaaaatacaaaaaattagccgggcttggtagtacatacctgtaattccagctactcagggggccgaggcaggagaatcgcttgaacccaggaggcggaggttgcggtgagccaagatcgcaccactgcactccagcctgggcaagaagagcaaaactccatctcaaaaaaaaaaaaaaaaaaaagaaatgtaccctttgcctgtgataacatacacgatcgtacatcatcacaaccaggatactgacactaacactgtcaagatgcagaatatttccacgactaccagggccctcctgttgcccttttatggccacacttacttcccttctgccaccacacccttctttaacccctgccaaccacttacatgtgctccatttctataactttggcacgttgagaatgttatttaaacgaaatcacacagtatgtagccttttgaaacaggtgttttctacgagcatcattatctggaaattaatccagattgttgtatcaagaggtttttttttctttttattactgagtagtagttcacagtgtggatgggccacaactgaaccattcacccattgaaggacatctgaggttttttttagctttgggttgttaagaaatagtttgcatgaacattcattgtacagattttcatatgaacataagttttcatttctctgggataagacaattggaagatcatattgtagtcacatattacatgttttag

SEQ ID NO: 35680 - DNA, 1209 bp, Homo sapiens
acggaaatgcaaagagcatgaaaagccaaagcaatcttgaagaacaatgaagctggaagcaattatataaccagttatcaagacctattataaactttcagtcatcaggacatggcgttgatacaaggacagacaaccccatgggacagcataatttgtctttgtttttttccgggttgtattaaaatttatttatttatttttagagacggggtctctgtcgcccaggctggagtgcagtggcatgatcttggctcactgccacctctgcctcctgggttcaagccattctcctgcctcaacctcctgagtagctgggattataggcacccgccgccacgcctgggtaattttttgtatttttagtagagtcagggtttcaccatattggtcaggctggtctcaaactcttgacctcaagtgatccacctgcctcagcctcccaaagtgctgggattacaggcatgagccactgtgcccagcccaggttgtattagaatttaaagaagtcatgattgcttggaagaagatcctagaattaacatcaccctgcaaatgactgccacttggaagaaaggcctgggctgcagccataggtcagtgaaccatcaggatgttgaagccagggatggttaaactttcctgttaagaaagaaggcagagagagtggtaggcagtggagagagagagagggctgaagccataagcttgttcagaaagtgatatcactattactttaagaatatttgttctattttttttcattaacttcctcttggaagatgatgtatggtttgtaccagctgactagattagcattgatttgtgtgatcccagcactaggccaatactcaagtgttccttatgcttcctagataagagggcccgatgagcccaggctgtcactgattggacactgataatgctaatgaaaacctccaaaggtaaatcaaaaacaaactaaaggatcactcagataggatcagttaaataaatcaaggtacattcacacaaggaaatactgtactatttatttatcaaatcagtaaagtcatctctctgcatggattggaaaaatcactaagataaataaaataatttttttaaggcagagcacaagacagtttgtatggaaccctgaatgtagggaaggagttcaaatgtttattttttatttaaccttcataatgacatataattaatcccgtg

SEQ ID NO: 35681 - DNA, 1034 bp, Homo sapiens
cctgcttgtatgctaggtgcatgtttaacttcataagaaactgccaagctgcgttccaaagtggcccagccattttgtattcccaccaacaatgtataagcaatgtttcagttgtttcacattctcaccagcacttgatattgtcaggtttttgtttttagccattctaatagttgtgaattggtatcattgtgcttttagtgtgcattccccaatgagtaatgatgttgagcatttttcatgtgcttatttgtcatccctgttatcttcttggagaaatggctattcaaatcttttgctcattttttatgtttttttttaaattattgagtcttgagagttctttattctgaatacagtgctttgtcagatatatgatttacatatattttctccagtctgtggcttctgattttcttaacaatgtaaggcagtgcattcttgataagtaacctgagtttttattttaaatgcagtatgtctaatataggaactacatttaaggatagaggtgcaaagaaatataaaatatgtgtgtgtgtgcgcacgtgtgtgtgtgttcaattttcttaatatcttttatttaaacttgtttctattagttccatttcatctagcaaatgcttgtcaaatatatgcaatgtgctagcccagttgctaattgctgaggacaaagatataaaaatacaacagaggccaggagccgtggcttatgcctgtaatcccagcactttgggaggccaagttgggagtatctctggaggccagtagtttaagaccaacctgggcaacagagcaagactccatcttgccaaaaaataaaaaaatgtagccagacatggtggtcatgcctatggtcatagttacttttgggagactatgatgggaggattgcttgaccctaggagtttaaggttacactgagctatgattgcaccactgtactccagcctgggtgatagagtgtgtattagtctgttttcatgctgctgataaagacaatcaagatgatatttgggtggggacacggccaa

SEQ ID NO: 35682 - DNA, 1050 bp, Homo sapiens
tgtggatgtattttctgccccaccccacccccagatgctgctacagttcggagtagggataaagtccactttctcccaacctcatgaagagcctgctttgaggcccagagctgggatgtctctaagaatcaaaccttattgagagtggctgcattgaccccggatacctctggaagtcacatggagtagcatgagccagtcgtggaaagtccacttgcagaagaggggtggaattttggcctgggtgccggtactttcctgtatttgatgtgttgttcacccatctctgaaccgcaaagtggtgaagaaaggctgggttgagtggtctttgcttttcctgtgcctgtgtgggaaggtgtgttagtgtaatattggttgacactgtctcaccaacattgccttagtgttgacattagtctcataggagaggctaagttaagtatgaactgcagggttcaagtccagagagttgaattaaaaaaagccatacttagttcttatagacgactaaggggaacaacttttaaaaagttcataatggtgagtgattaaaattctgtcttgttagctttgcatatacattagaattgattttttttctgtacgtatttacttgaatcaaaaattgaaaaactggcttcacagaaatgccttcggcttcactaagttctgcttttaactcacagcttttgctcttgggaatagtataattttgtgtctgtacagtaagcatgtttaaaataagttttcaaaaattggttggtatgcaggtctttgaacagaacaagtggtaccagttataatttagtatgcaacgttatatagcttactcagttggatatgttgccttaatatcaaaaataaaatattttatctccaggttaagagaaaataggtaaataggccgggcgcggtggctcacacctgtaatcccagcacttttggaggctgaggcaggcagatcacctcagagtcaggagttcacgaccagcctggccaatgtggtgaaaccctgtctccactaaaaatacaaaaattagccgggtgtgg

SEQ ID NO: 35683 - DNA, 1015 bp, Homo sapiens
cggattgcttgagtccaggagttcgagaccggcctgggcaaacaaggagaccttgtgtctacaaaaaatacaaaaattaatcgggcgtggtggtgtacgtttgtggtgccagctactcaggaggcggaggtgggaggatcgcttgagcctgggagtttgaggatgtagtgagccgtgattgcattactgcactccaacctgggtaacagtgagaccttgtctcaaaaaaaaaataaaaaataaaaatataaaccttatttctcaacataagctccatcagtttcaagccacttttaaatgatgataccagccatttgttggactcatccctaaagaactgacaggcctgggaatttaacaatgtgaatgcagcagtcttttttgcattattagctgaagaaaaatgtgtgtcctttaaagcttcttaagattaggaaacaaaaggaagtcagaaggagccagatcaggactgtaaggtggatgcctaatgatttctcattgaaattcttgccgttgtttgatgttttttcttgctttaattttagcagaactcatgttgctctaataggggctcttttcaagctgatgtcttatccttcttagtgccttagactagatcctgttcatacatgttataacaagttagtatgagtttattatggtgccaaaaaaaattgaaatccgtccatagctttttcataaaactcattttccatgaaccttagaagacccttgtctgtgctcttctgttttgagaactggcttctgtttttggtgaacaaaagcattgtcatgtgtgattaggaacaaatgatacacagtgtggtttttataatacttcttgagcccccctcaagcaattggtgaactcttcactgtggtagccacaggagatattctttgtagtgatgtgtggcggggccgcaccgttccagtcttccatgaaacttgaagaatgctctgtctctactctgtggttgttcaaaatttcatgtagggtgcagtgtcctcatta

SEQ ID NO: 35684 - DNA, 1010 bp, Homo sapiens
ggtacatgccactgtgcccagtgaatttttaaactttttttttttatagaaatggggtcttgctatgttgcctgtactggcagaactgtattaataactgctaaacaaggtcaggttcctcataggatattgtaggatttaattattctttaatgatctgttgacttggaggtgaactttttttcctttctaaattttatagcagtgaagtgacacacctgtgcccagcctaattctaggatttttctcctgacacacccaagactgttggaagagtcttacttcccatgctgtcatcagtcaggctgtgcctcagcttgcctttcaaactgcagattgtgttgataactagagggaaacaaagtaacaaatactccaggaataaaaaaaatggaaactagcaatgtagttcagctgtcacttctttcatgaactaagtgagcacagctcacttaaccctgcctctgattttcaattgtatgttttatcttaatagatcgattagatagttaaactagacatagtatcatttctctgaatgttaaaacttgagtatatgtgttaacattatttaaccaaactttttctacctttttttggtggattttttaaatgccagaaactaggttttatttttcttattgggaaaggagaaggtttggcttcaccctggaccttctcacatgctcagaagcactgtcccgagccatgtgttaggtggtggttgagaggctgcagtgagtcccatagcctgaaggtggttggtgtgaggacgtgctgtgggcatggcctgctgtggaatgtcctggccgtggttggagtcctgcaaggcagattgtgctttggctcaaccaaaagcaccatttcactccagcagccctcctcagggtggtactttctaagttcctgacttctagatttaggtcctccatcctaagcccacatcacagatttgcagaattaattctggaaacaaagttaggttttatagactttgtggtttcttacag

SEQ ID NO: 35685 - DNA, 1031 bp, Homo sapiens
tttgaggttagagggataagtttagtaaattattattcaggagcccctacgcccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaaaattctaattattacataactttcttattgtagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggtaagttgtgcttttgagcatgtattaccccaaaataaagcagctttactgatcaaacttgatgtcacagtttttgtaggtcagaaattcagggacagcttagttggatggttctggctcaggatgtcatgaggctgcagttgtatgttcagggctgcagtcatctgaaggcttgactggggctggaagatctacttccagtgttgttcactcatgtggctgtgggcaggaggcttcagttccttactggtagttagtaggagggttcag

SEQ ID NO: 35686 - DNA, 1019 bp, Homo sapiens
tacaggatccttatcagacatatgatccattcttgattatctgctttttttttttttttatttaaatcgaaaaggattggggctgggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatg

SEQ ID NO: 35687 - DNA, 1034 bp, Homo sapiens
tgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgataagattttctttgcttaaggagaacggacattgccttggtatgtttttttttttttttccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacc

SEQ ID NO: 35688 - DNA, 1044 bp, Homo sapiens
tccaccgccttttcccactcaagaaagtggagagaaaaacagggatgcaggctgtgggtcttgtggaagccctttacaaccattaaataaagaacaccagctgcattatgtgtgtttagaacgagaagttgtttgtacagtatttttctattgaccgcttccgtcttgcctgaaacctgggcattctttctgtagtttctctgaattttctgtctcacctcctcacccctacccttgccttttgtctgggctcggttgcctgttcatgttctttgcctctgacattaaactctccctagttgcctgtgtgcttgagacgtcttaacaagttgtcctctaagtggtgccattgatgtacagtcccattggagagcacgagtatgtttccttaggctcttacaacactggctttatcaaacattttgatctttgctgagctgatggttggaagtctgacttgcgtttcttgagaaaggctgagcatgttttcatttgcgtaaaccattttcaggtcctttcctgggagccatctgttcatgtcttctgtaaccacttttgagttttctatctgaatttcacagaaacgagatagatgtagggtgggagcagtaggaaggaaaggcggaccaaggggtgttagagattccatgtcaggccctttggttgcaagtaacaataactcactcagagtattttagttcacaaagggtttggccttcttcagggacaagaagagagcattgaagaccagaaggttacgggagggagggctgtcttgctggtgtcctagagttggcatgttcagggtaggaatatgggaatgcctgcatccattcaccaaagagtgccagccctggggccaggcatggttccaaacttggggatgtaggggtgagccggccaaggcacagtcctcccagccctctccatcctcaccccaaccccatgcccaccctccccaaccctccccatccataccctctgtgctcaccctccgcatctgcacctccccctttgcccaccctccccatctgtacctcccgc

SEQ ID NO: 35689 - DNA, 1029 bp, Homo sapiens
cacacgtgaattgcaagcagctgccctgatggtgccatcaggggcggtggagatacaggccgctctcctcagccatttcctttagaccaagagagcttttattgtgtagcagatgaaagacccgatgagaatttgaggtgtatagtataatgtaaagtttggaaataatgattgtacttgttaattctgtattggtctttggaatcaagggtttctgaacctgagataagcagcttttttgtttcataaaagctctagtcatttttctgtgttgaaagtggaccacagtaatgttcatggatttgttggctgaagcacttccatgtggcttagaagcttagcagacacggcacctccgcctttgtgaactgtcattggccactctgcaaatcctggtggtgcagtagtttagaactgtgtagaaaagatctggttgtagaggacaggaggctgatccagaggcgtctagtcacttgcctgaatcacagctaaaaagcagcagacagaatgaggactcacagctcctgatttattttttccttttgtttaaagcccagtgtattgaactgggcagtcagcatggtatttactgttttatattgtccaggtaagaaacctggagcttattgggagcagaattacaaatataagcaatgccaaccttccctgcaccttagcattacctttaatagtgtcaaaaaaaaaaaaaaaaaaaaaaaaaaaaaaaaaaaaaaacttagaaggaggcatagttttctccacagtttttgagaaattctccacgatttttctcctgagctaagccagtgagaccacagaggataaagaggaaggcgtggaaggcagagataccagggggcagggcttggtgggactccactggcggtggggggttgaggaggaggtttccaggtgggaggtaaatgtgcctcctctagatggagatgtcaggggaaagcatgggttggggacgtagatttgccccttgtggtattaagagtaccactccccacagggacagtgaatgat

SEQ ID NO: 35690 - DNA, 1044 bp, Homo sapiens
ctgctgccctttccaatgagggctgcgctctccccgactcctcacagtcacctgtagactgcttctccttcctcctccctaaagcctcaagcttggaatctcacattatcaaaatattccaccttgtacagcatccgtcagtcacctctgggacagctccaggcttgccgtcattctctcccacttactgcctgtcctagttcctggtcacttccctgccatgttgcctgttcttacaataaatggcctctcagggatcaggttctcagccccagccccacctcagccactgctgggtcactgcagaccttgccattatcgacacaccaacaggccaaggcaaggacattgtcctctgtctgccaaccccgctggtcccccatccacggatcccaccaacccttcattgtggccaccttttcgatgtcctgtctcccctctttcctcagcttacatgacatgctcagtaatgaccatcatttccctaccctgcttttctttcattatatttgccaggcaaagccccagctgtgctgaggttcagatctctaccatctcagcccacacccctcagctgccatggctggggaagcccaaccgcaggggacagccagtgtcctgagatgcacgtcacgcaccgtgagcaggctctctgagtggcctggccgtcactctgctgccccggcctgttcactctgctactctcttgaccaactgtttccccacccatgtgtcctcgttcttccaccctcatatacctcccttttctcagacaatgatgtggcttcctacttcactgagaaaaacaaaagtgatcagaagggcccttgcgcaagctctcggactgcatctctgctccgcccatgaccagagaggctgcccgagctcctgtcttggactgcccagtccttgtgtgcacagccacattggtatcactgtcccctctcccatcggcagcatcgcatgtctgcgggtcattccccaaagcaagccataggctgaatttcgccccatctacgctggctttctgaaatccatgtccac

SEQ ID NO: 35691 - DNA, 1040 bp, Homo sapiens
attcagtcatcttacagaaatatgaggagtttattaggaagatcattcagctttgtatgcatacatgcatttacagtcaaaccacacaggaacaaattgaaaactaaacaaaaaataccttaggacaaagagctgaaaagtctaattcactgtcatctttgtgacttttttctttgtctgcttctgttgaggaaaaaatttggaagctttcagtttcctagccaactcagacatagtgcatttatttcattatgtattcttaccccacatttctcatattctccaaatacaaatatatatttctcatattcttaactacaaatataattaaatgtttgcacataacaagcttcacatatttgcaaaggaaatgatccacattagtggctctcttaatattgtccctgaaacagcaaaagcatcctccctgggaactttttagaaatgcagattctcaggccctaccctagacctactgaatcagaaactctgggctggggcctagcaatctgtcctttaataagccctccacgtgactccgatacattctagtttgagaacctataaggtcataagccaagttaaaaagtaagagatgattatattggcttttcctgtattttctttttctttgtgatagtccaacccaaaataaaactaagtaaatcataagtagcacaataaagagtgttgaagccttttctttctcccctgacactgtggattaaaaagtcaatttatttaattgtatatttgagaaaagaaggaaagcccaaataggaaaaggatatatataactttgagggagattagcttctataataatatttagtaaaaagctaaaagtatcctcaaatgtattaaagaatttcctaaaaatagctcgctaatgtctcatttcatgcatagaatctaaaatataaactttacctaccagatctctcacgtttcttctgattaatatattctccaattccaaaatccagtttcagcagaactgacttaattttgctgtaaattttttgtccaatatcattaca

SEQ ID NO: 35692 - DNA, 1053 bp, Homo sapiens
atttcatgttcctcactccttcctagaaccagaagagatgaggtgtgattgaccaataccaacgtgccatcatgcaggaccaaccctttccaggaaaacagagcacttcatgtgcagaatccaaatactcagcagaaaccaagatctacgcttagtggttggttgatgtttaacacaggtgtcatctgcacacacacacatacacacgctgagttgctacgtaatgaaactctaggttttcccagagagccttatttggaaaacacataactagaaaaaagatctcctgtgaatgctgggcaaggcttggggaacagatcttttccatggtgtgtagctgtcttcccaccatccttggcactgatcaccatgcaacataaggcccaactaacataaaaggaaatgaaaatacctaaggcttcaaaacattttgagtttgtactaagttcctaaacaaacaatacaagtcttctgtgactgacgctcaactaagggagaaaattcattaccagtagctttattaatatttcctccttagtttcagagagaccatgcactttccaagttcaaaaggaaataggttctttggttcatctttctatccatctcccctccctctcgccagccttccagctttctctcacactcttgccttcactaaggagtgaactcaccacacactccagccacaagataaagaccatttaagagtcacccccgatgaccatcatccccaactttccatcctcgtagccagtccagttcaagtagttcccagggagaagtcactacaagccccagcctctacatggccatgccatctatcaaatgggctttgctcaaggatctgtaactgtaaatgactcccaaaaaagccccagcagatgccatctggttaagttttccttcttacggaaaaactagtcaggtgttttgatgaaggccattctccaatcaagcaattctttatcaaagaagcctaagccagggcaaagtcctttttcagcagctgaagaatttctggttttacctgccagtgaaactctaagggaa

SEQ ID NO: 35693 - DNA, 1089 bp, Homo sapiens
ctccgtcccccaccgcgccgcgccccgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaaccgcattcttttcatgaatattcatcgaacgcttggccaggctccttatctgcgtccccagagacatttccgccttgaaacgaactcggtggacagcccttgcccatgtaattctcactctg

SEQ ID NO: 35694 - DNA, 1048 bp, Homo sapiens
ccctttctgttttctctggactccgaactcattgtttcattaaggattccaaaaggcgaatggcgtccagatggaaatctgatgggggcagaaagaaggcagtcgttggggtgaagctggttgattaggttcgcaatgattcctttttccccattacctaacagaagccatgatatacctttgatggctgattttctttcagatgatctattttccaggttatggccatttagatttattttcaggtagtttgtttttaccacacaaaaagggacttattgtgtatattaaataggagccaaatatgatattttttgcagtggtaggttatgtttaatagggttttatgcttaagtactgtcagtacatcctggtggaataacgcgtggcagcaatggaaatcatctcttttgtcctttttgatgagaacttgatattgaccacgtttaatatatcagggcccatctactggctacggtggctgtctagctgtcttctaggtggcatggattgtaccctctgtactccttagtattgagtaggttattatgatttagagagctacgttctttcttttttcttttcctttaggttgtgtttttggcgaggggtatgttggaatatagaacaaattcaatagcaaatatataccagcatgtccccaattcagtaaatcttaggtttttgagtgagataatatttaaatcgatttttaaaaattattacagaattaaaatatttctatcagttcgcttattcttttagccagctagctttttgccaagctttagcagatagagaaattgagccttttgataaaaagcaccaacaatgacagtggcatttctgttctttaactggtactcagtctgccattgtgacgtgtagaagagaaccttatctccccacatcaccctagtttaaaggtccaatgggagagccctaaacatttaggctgtctatccttggaggcctcttcataatcctggatttactaggatccataatcctcctggatcttatggtgcaagaggtgatgcgttctgtc

SEQ ID NO: 35695 - DNA, 2129 bp, Homo sapiens
ttttaatttcacaattaagaacagtttgaagccattttcatttcatggtcaagcggagtatgacatcagagagaaactttcatttggaggagatttgatcactctaaaatggatgtctgtgttatttacggtagttttgtaaaaattgcaaaatccacacccatttttaaaaacaaggtgtcatgtatatacacatgtacacatacacatacttgtttatacacactctaaaatcttatgaataacttgaaatcaaactggttggtatagaatattattttatagtgctttgatactggtctttggaacataatcaatttctgtctttctaaatatgtgtttgaaagggaaagcctagcaagtctattaataagctcacttcccatttatcccagtgtacctggagcattaagctaagacgttcatccacaggcttaaaaacttacatcaagcactactgaactttacaagctggaataaacaatgcctactaaataaaagatttataaaattgttctgtcttatttttgtgatctcttgtaaatgttttttttttttttttttttaaatatccaaagaagacctgtgaactattatttgtcagaagcaattgcccttggtatctgattctgttgaaagaaatgcgttgatttgtccagacctttatcttaatgtagtttgtacctacttatttcacatcttctttctcttcttaatgatggtcttagctggtaccctggaaaccaggtaactgctggggaaaaacactgagtagatatatagacaacttgaatattctctgaaaatgggcatggaatctttattgttatatcaaattttctctaattatatctaatcctttaaatttattgtatctcttaagacattagataagccagtgaacatgagcttttttctttggcttaattatagtggacaactattaggaaggaactgtgaggttgcaaatagaatattttgaaagataaagtactctttatgtgttttggggtaatgtttttggagtggtttctcaggaaatcgtataaagactggatttgaagaatctaataattcctattttggggttgtaataagaactacatatgatatctaaaaatgacttaagtgtggaatggctggctctgaagggctcctcaacctctcagtctcaattagtgatatcaattacactgaaagtgttttcaacaactgaaagtgtcaatcaacactttcagtgtaattgacatcactaactaatttcagtatattcagctgtatttttgttccagcttgattaatgaagcccgggggaccccaggagtattaagttagaagtaggatgtctcaatcctaaaggggaccaaatatcatggttcctattttctgtccttgtgtttgtagatatttgaaattctgtattatatgggaattagcctgaaagtggatttcatgatatcaagatggccaccttccttgaattccccaggtctgcttatacttatacttatgtaacttaagaagtggcatttaagttctcttgagaaaatacaagggtagtcttgaaaccacagcagtgcccagcctgccaaaggaaggcttttgtgaaacgcctttccagccacagcctttgaggcagacgtctaggtaagtgtcacatgagaacagatgtctggtaaatgctctcaagagtaaaaatcaaccatacagagtccatttctcaccagaatatagttcaattgtaattttgaggagccacaagcctaagaaggaagcagtgtgattaaaacagcattctccttttccctctagaagtcagaaatgggatgaaatgggaggcagagagaatgaaatagtgtgtttttcttctgcaccctaaggatttaaataacataaaaaattatttcttaatgttttacagactttccatactcagtacatttttgaacaaaaatagggaaagctgagattttttgactcaacaaggccgtcagtgctgagaggtggtgattgagcaggcttggaagtctaggaatacattcctgaaagctttagagatttagaaatagaaaccatctgcaagcaccacaggggcccagggcataaggaaacacttcaggataatatag

SEQ ID NO: 35696 - DNA, 1574 bp, Homo sapiens
aatccaagcatgacattcctctgcttaagattttaggcctaactctccattaaacctggaataaaacaccggctctcagcatgttcaccttctattttcgtctcttacctccgttcctacacactctctcacccaccctcttcagccataccaacaggctcccaggtctcccagggctccaagctcatgcctactgctttttctgcctggaatattcttttccccactgttgaagttactcctagttcagatctcagcttaaatgtcactcttgcaaagatgttcccacacctcctggcactgggcatttttgtccctgcatttgccagaattgatgagattatgtaacgtctctgctcctctagattaaaacatccaggaggcagggatgtgtctgttttgtggacccataacagtgccctataacaatttctgatccataccaagcaccccatgtctgttcagtgttgaaggttgtctacagtacattatgttcatggagagcacgtgtcttctgaacatcgcctttggcagctgagatgacttccataaatgggccaaaatttcacctcatcagttgtgcttactatgaagatgaatagctgatgaactccaattacagtaattattctgtttccaggcaataaccttagcagtagttgttctaaagccctgagacattacaagtaatgagtactgatggctcatgcatctgagtgtcctcccaaggtagagtccgaaatgaaaaatgaagctgtgtattatttgagggagacaaatagtattacattgtgggaacctttcagaaacacaacacgatgagtgaaagctgaggatgattgtggttacactcctcgtctgtccttccaggttattgaatgcttttggtctgctttggatcaatcattattgaacaacttaactgaatgcattttagtaacagcctttgtgaagctgcgaacatcaggtccctagaaaagcaggtggcttgaaatctttacacattagtcaattataaacctaatgaagtaaaaacgaatttagctctaattctgcgctgtgactacttactctgcatcgtgagttctacgaggttaggaccttgctttgttcatctttggatgtcagtttctagcacctaaccgaacctgtggtccagtaaagggctggatacgtggaagggcatgtttcatggtcatgtgacatcatgctgtgcaaataaggcacatttcagaacgctgtcctttactttcacatccaggaaccagcttgtaacgaacctttggcaaacatcaccgtggatttttctttttcttttttttttggaggaggaggtggggcacaactaagacatcatttgtgatttactccccctcctcttccatgtcacatacctcttagatggtcaacattcaccttctgctgtctcatttctgagacatgagacagccatcggacttagttttaactaggattattagaaatatttttgtgtccatcttgagatctctcatcagatcaatgtctagttttcttttgctgattcttattgatggaattcttattaaataaaa

SEQ ID NO: 35697 - DNA, 1072 bp, Homo sapiens
ggggattcttgttctcagtggccttctctcttttggatggatatacacagtttgattggcactcctattgacactttatttggtttgtgacttgtttgtctcggtgcctttctattaatatattttttctatttaaactaccctctttttttcagtacagcactggacattttctttgaaatcttccagattcatttggttgtcttcctcatctcagctgtcttatgcaggaaaagtggtcactgttcagtcaattcattctacgtagctggctatctgagttttttttttatcgaaaccaaaataaaacttaaaagaaacagaagaagctgagtctccctcccctccctttcaactaacacctactgatgtttatcttggaaataatttgacgtctatttgatgaaacctgtagttaagtgttaatggagactaacgtcaagcttcagaacagtgaggagaaacctttagtattgtgtgtctagcatttgatgcaagtgctctgtggaaaccatggaagctgggataaaaatgctcgcctgatccccagatagtctcatctgaatgtactgaggcatcaccgcattcattccaaatctgaacctgacctacttttccccttcatctcctgccatctcttccctagtttgtcatcttcttttccagcaccacgaatggttcatgctttctgataaatatctgatgtatggcatcaattatatgactatttaaacatgactcatagtgaactgtatttaaatattgatatgactccatgcgttttcaaagaatgtgtggaatgttctttttgagtgtcagttattaatcatctgttttccgttcaactttggttatcttcagtaaattttaatatctttcccttcaagaggacttcccagctgtctgatcaacgggtaggaaaggacagttggttcagtgcttgctcatgttagccctgtaagaagtcagctcagtttagttcatccaatagctggggaataaaaccacacaattcccttccttacttgatatcaatcaacacttgactaaatcttacatcctgtcttcagct

SEQ ID NO: 35698 - DNA, 1045 bp, Homo sapiens
ctcagcctcccaaagtgcggggattacaggtgtgagccactgcacccggcccagctctttcgtaaagaaagccttggcaaatgtggaaattctccctattcactacggtaaataattcttgaggttactaaactcagtatctaaataaaacagatcagtgtgttagtacatggaacagaaggccatatttttggttataaccgttgaccccacactcaccctggggtcttggtgtcaatgtcaggatgtgtttaaataccctaggctgtcaatcttgtaatacaactttggttatctttgttctagagccttgcaaagtaaagctgatcctagttaggacccagttaggaatttggatatatgtgttgtatttgcatgtgatactgcccttcatttgaaaacacaggcttaaattagtgaagtagaactcttttagtccagattacccccaaaatctgtgaatttgtactaattcaaaatcctctttgctggtaaccgttgtaatgaggtctttggaaattttatcctggtagcatggaggtgttgcttcttttcatttgtctagttttgtagtcagaactgtttatagagatgtaattttaaagtgaccctatgctatggtttgaatatatgtgttccaccaaaattcctacgttggaacctaatgcccagtgtgatggtattaagtaagagctggggccttttgggaaatgtcgaggtcatgattattccaccttcactaatgggattagtgctcttatagaacatgttgggaaaaaaataaaaataaagataaataaataaataaataaataaataaataaataacaggttggagcccaggagtttgaagctggggtgagccgtgatcatgccactgcactccatcctgggcaacagagtgaggctctggccgggcatggtggctcacgcctgtaatcccagcactttggtaggccgatgtaggcagatcacctgaggtcagaagtttgaaaccagcctggccaacatggtgaaatcctgtctctactgaaaaatacaaaaa

SEQ ID NO: 35699 - DNA, 1047 bp, Homo sapiens
ggccactggatctcagagctttttatccaggtgcccagaggctgagaaaatgccccataggttctataaaggacatggatcctgacttcatacaggtcaacaactatgttactgtgtttttatctggtttagaggatgggaaacccatcagtgttattatgccttcattcaattatggaagaaatcggttgaataccagactgcccaatgaatgtagtttctgtatattttcaggcttttagactgatctgaagttgtgcctctatgcacgaatgctgcttcttcaaaaggtgccagtggctgggggtcaactttgatgtggcctataaagttcctggcccagcacttaggcctgcctttcaggacataacctctcagctggatttaagaaatagcatctctttcagtgtgaggcagcggcaggaatgaagtgtgttcgtgtccgtgtgctggcgcttcgtatgtacatttttgttgcgtctttaacttagaaaatcagtagactttatgagtatcagaggataaatgtactgcagaggatgagaaaatatttagcgtttttgtggtctctcttcagcagtgcctccctctttcctggaaaagggcattggtgaccagagaaattgtgattctgtttgcatcctaggccaccatggagttgacttatgtgtagactggccatagcccagggtcatccctcccctctctgtcttgttctcagttgcttgtcatcatttccattcaaacacttgaatattccagatctgggatagtgggcagatggtttcatgctattcaatattctagtaaatatcttttcaatggttacctgtagtcagtcacattgtcagaattctcacttcagctatacgtgtgacaatcccttggctcacacttaaatttaacccagtgcttgtaaactgtggaaattaaaggacctagttgataccaaatgtccgttatctggagtagcctctgtcggtagctggatgccttcatttgatgtgaaaacaattgtgtcatagttgaaaataaaagaatgttttt

SEQ ID NO: 35700 - DNA, 1047 bp, Homo sapiens
cgatctacacgctgttagatttagattttgctgcatagaacagaaaacctaaaactaaaatggcttacgtgagagaaaaggttaactcttcatatgttaaattccagaaatgggttctagggctgatctggtagttgaggggtgtgatcaagtttccagatttcagatatccaaaataccctgattttatcattacacattgtatacaaatatcaaaatatcacatgtacccccaaaatatataatgtgattatatgtcaatacaaaaccattaaatatcccaaataccccgattttatcattacacattgtatacaagtatcaaaatatcacatgtacccccaaaatacataaaatggttatacatcaatacaaaagcattaaacatcccaaataccctgattttattattacacattgtatacaagtatcaacatatcacatgtacccctaaaatatataaaatgattttacatcaatacaaaaccattaaatatatgttaaaaagatttcagactcatctctcagctcttccttccacagtgttggtttctgtggaagggtccaaacagcggctggagctccaactgtctttgtctagcagcaggaggaggtagggaagaacaaaagctttctcagaaggccatgcagtatttcagctcatattttgttttctagcacctagcagtggagttatgaacatattttagtggaacatatttagtggaacataagcattggatgtgagggtagcggtggtggtggtgaaagttggtccagaaagactcccacatttctggctgggcgatggggtggatgtggttctaatctcttgggagggagcagaggagaaagaaggttcgggtaggtgagaaaggtagtgatgagctcacttggggaaatgttgagtttgaaggacatcctgttgggtcagttgtagaccactatgtgcatgagtctgaagctcaagaaataatctagtgggcgctagagtgtagacaaagaatcctcagtatcccagagggctttcaaaacccttcaactgga

SEQ ID NO: 35701 - DNA, 2176 bp, Homo sapiens
agtgcagtggcgtgataatggctcactacagcctcaccctactgggctcaagtaattctcccaccttagccttcccagtagctgggactacaggcgtacgccaccatgcccagctaattctttgtattttttgcagagatgggggtctcactatgtttcccaggctggtctggaacccctggactgaagtgatcctcctaccttggcctcccaaagtgctgggattacaggcatgagctaccatgtctggcttataatgatcttttacaagtgtaatgatggttttaggagaacagatgcacagtatgacattagattccccactttcttctctattttgtttctttctgtgtagtcttgctggaattctgattaatcatggtccttcccaatctctcagaatgacccatatctttcagaactattgtcttaatcatgaagaccctcaattaccaaattgagaagtttatgttgctttgaccaccatctgtgtgcatcccgatacctggggttacagactggaatctgtgatcaagggagagcgtggatacttgctttattaacaaatttacgtgtgttttactcaccagtgatgagaagaccaccgacacattcaggaggctttatggaacagagaaatccttcaacattaattactgtatctagtgtttttttttgttttatgcaaaagatgtacgtagctattttggaaaagcattataagtagaacttgcatgttgatagctttaggatgtgttcagattacaaatctccatttgtactatacttgagtttttggtaatttgaactagactagatctttaagggaaaaaatatatatatattttttctcagagaacaaaccaggaaaactttagcatcttgaaggtaaattagtgttgattatgacaagtgagaataattaatttgcaaatagtcataagcagattatctttttagcagttagttctcatttatttgtaattgaaaaaacaaatatctgctaacataattgtaattcatcttttgtgttcatttttaaagtgcctgttcctttccagacaagctgcactcatgcatggcagtgttacaagggtgggcttgtagactgagtttgggaagtgctatgaatctactaggatcacctatcacaatcaagattccataattccaagtaaaggaagatgcttttgcctgacttagatgatggttcggattctagtgtagttttttttggaaatgcagttctgtcactttcacagctatgttaccaatgaaataagtctgtgtgaataagtaaagggaggtaagttgataaaagcattcagtttgcaacggatctgcagtgcatcatggtgctcaatacagtttttgaataatcacatttatttatcagattttaattggagaagatttgcagatcccacctttgaatcattacaaagtatgaatcctgtcatctagaatactgaaatttagtatgtaccatgcttaggactgatccgaagacattttaggtttgaataagaaaaaagaggcaaagaggcccaatataaaaacagagagaataaatcttaaagcaccatctatgttggatatccttattgcaagagatcccacattggacagacgatttcagttgacaccaaaggaagtaagaattttctgagactgacgggtatcttggtaaatgttccctctttgcaggtggtcgtagataatttcaattcaccctctgctttcttcgaactgacgaaggtgtagctttgatattttcccctcttcatgttacatgatcatttattctaactggcaacattttatttatttatttatttggacccattgttccaaacatgtaaaagatttggacctgcaaatctttctatgttagtatttattgtattagtgtttgagatacctggaattttggagatgaagtgactcaatccatttattttctagaagaaatcttagagatgtgagggacaggtgtagattcacaagagctaggacatgctgttctaacaaaaatcctccttccctttggttcaatttttaatctattttaggtccttccatttcacattaatgacatagtaatctacccacttaaaactataataagttcactaggtttttttttcccattaaaacagactcatgagtcatagtt

SEQ ID NO: 35702 - DNA, 1029 bp, Homo sapiens
ttttttccctcttattccaacatttgcttcaggtaggtttgaccaatatcttggattctttccacttgtgtaattataaacccaacttgttggtgatggatttgcttgtagatgcaactcagttgtaactttgtgttacttaaaaaaaattgttagtggattggctggtgtataattcttgttaacctttgcagctctgaattagtagatgatagttgcttgtccaagggtacacagttaatgtgctgcagccacacattgaactttgtcttgaaactttgattcattccctgcatctttgtaagcagatatatttttttctgattataagatggaaacagaatgaaaaggagatgacttcttgtcttgattgcaatgatgaagctgcaatcaaaccagaaataacactccagtctctgacacacattgttgcatatttatgttgggttttgctatagacttggagccatcttctccattgtcatctgtctgatctcatccttaataactttattctgctggttctagatgaaatggttaataaatccaaatttgcattttcaaagtagaaactttatagtggatagggcctttgtatgattcaaactgccctatataggaagtgcttagatattataataatgcagggaaagaagatataaataggaatggcatgtaaagtagtgaacatagtaactttcaaatcatatggagaaatttgatatcattttcttattttatatggcagttaatgtatgccagtgattcttattacattacagaaccatggtattgttaattgacagagcaacgtaaatgtaaaaatgtgttaatgaaaaatctaattggagatatcatggagcacatgtggtaattatgggaaggacccagtgcatgtaacccccttggcttgtgggtggataactcctggaaattgtgcattgtgcaaggttgcattttctgaagaagggcaatggtatattggggggcttgccatttttcatccaaaaaccatatcatgcgaagact

SEQ ID NO: 35703 - DNA, 1063 bp, Homo sapiens
agtgatgaagaggtggtgaggggacagcaaaaaatgcaattacatttcttctctttatttttattttttgagacaagagttttgctcttgttgcccagggtggagtgcaattgtgcgatctcggctcaccgcaacctccacttcccaggttcaagcgattctcctgcctcagcctcctgagtagctgggattacaggcatgcaccaccacatctggctaattttgtatttttagtagagacggggtttctccatgttggtcaggctggtcttcaactcttgacctcagatgatctgcccgcctcggcctcccaaagtgctaggattacaggtgtgagccaccacacacagccccctcttctctttctctgatcactccaatactcgttctaattgggaggaatggatttaactaatctttggtttttatctctgtgtagaaactgatttcttggcagaatggactgttaatatatttaaaaagactgaaaacctcttagaatcttaagtagtaaaatattcagagcgaagaagtagagattttacctttacaatatggtgacaacagataactgtaaaaacttctttttcaaatagaaccagcaggagcatgcatggaacacatataccaaacatctttctgataacattaaacatttttaaaagatgttaaatgttcttttcattgtggtgcttcagattcctgattctagaacttgtgtgtgtggaacctgtgtgctaactattctgttggaatttaccagcaaagaattatctaagaattttcaaactaaatgatgggggaaggaactaacatttttgcagtccctggaaatgtaaaatgttgtactcacatggcctcacattaaattcccattaaattgacatttaaaaaaatttttttattttaaaggaaacggaaggacgatgagattaaataacttgcccaaggattctgggtgggtgtgctgtggaggtgggatttttatactctgccatgacccaatgtgcaaagtctccttgaaattcaattcttgtccaatatttaccagattaaactcagt

SEQ ID NO: 35704 - DNA, 1057 bp, Homo sapiens
ggccaacgtgatgaaaccctgtctctactaaagatacaaaaattaacccggtgtgggtggcgggcacctgtagtcccagttactcgggaggctgaggcaggagaatcgcttgaacctgggaggcggaggttgcagtgagcctagatcgtgccattgcactccagcctgggcgacgagagcaaaactctgtctaaaaaaaaaaaaatgggcacaatctgttggaaagagcttgggatttggaattgggggacctaggtttaaggcccagccccacagtctactagatgaggaacattggatgggttttccaatttctgatccttcataaccctgttgtgtgtgtatcatctaccttggacgtttcttgaagagattaagattttgggtgtagtagcttataaacagcaaagtactttataaatattattttaaattcttgcaatttttcttagtaaagcatgtatacattttacctaagaggaacttagggagttattaaatttttaaattattgaaaaattgtctcaagactatgatctcctttgatttttgtggacaaattattgaactttcttgatttactattacatctttggactgcagtttctacctctgatctaaacacatgaatctaaattgattatctctttgaaagatctacttagctttagcatgtaaatagaaaataacattggaataatttatggaagtagtattcatcattatatgggaagttactcataagagatttttttttttttttagtgttcttccagacttggcaattagattacatttagactgtggaattaaaagtgattccctgtgagctctcctagcaaattatgaaattgaagagagagagaacgggttgcgggaaccctagtttcctaccgtgagacagtttgacttacttttctttaaaagttgaaaattctcatatgggcattatttatctcatgcttggtattggagtctttccctgggtattcatagtacacttgaggaaactaagactttgacccttttaatagcaagtttgtctgtatgtgggggt

SEQ ID NO: 35705 - DNA, 1033 bp, Homo sapiens
catctttcaaaatgtggtctttttgcagtacagctggaatgtctctgcctttcccaccatgcacctttgtaaaggggcggcttctgtctcgctggtgtaacagatttcttccctgtgtcccctttctcttctgtcaatgaatcatgggtggctgtcagctggggaccactctcagtgtctcatgcactgaatgcaacatggacacaaacttacgatagggccaggtgggggacagcaagaggtgagcaccggaaattgcatgaggtaggagtcactggctggtagtgggtgagggacacgtggtagggacagttcagcagctggatcagggtggaaatccaaatcctgacagctgagaagtggcacagacctgcttctgtggggacaagtgtccactggccctggccaactggcctccagggggcattgttggaacatgcgatcatcccaaagcatttcagcttgaagaagatctaggacacagtttgttgttaccacctcagagcatttagatgggatgtgatggatggaattgaagttaaaaacccattcaccatttctaggtagtacagtaggctcctaatttacagaaatgcttgtgaaattgggaatcatgataaaatcctcatacctcctcctcttttaaccaaatctttctaaaatgcacaattataatttcttacctttaggaaaaagtaattatgttatatgtgttatatacactatgtaaatatagttcattaaatcattctttggcgtttgaagactttctaattcattacttcattccagacatcaatgacaacagcacataccgagcaggtacacatatgagctacctactaatatgccctgattttgattgtattttgtgaaaaccttggtatgggttatttttaaatgaatgttttcccaaattttaagctgaaactaggatgcgtcaaaattatcttggtcataatcttgtcaatgatgtcgtctaaaggccaccaggaacacacctgtagcccagcaaagttgaggccatcaactg

SEQ ID NO: 35706 - DNA, 1147 bp, Homo sapiens
tggtttgccaggggctcccaggcctctagccgcagactgaaggctgcactgtgagcctccctacctttgaagtttgggactcagactggcttcttggctcctcagcttgcagtcggcctattgtgagacttccccttgtgatcatgtgagccaattctcctgataaactcaccttcatatatacatctatcctattagttctgtccgtttagagaaccctgactgatacacaggccatgctcagatggagtgctgtctggaaatgggagtaattctgtggttgaatgtcttaattgtcctggaaggtgggagaaatggaatgaggctggtgctacaattgatgtaaaagcagcagctgctcacataagccggggtgggggctgcctaggcgtatttgtggtattgaccacgttcttgtttttgtttgtgaccaggccagattacagaggggtattgatttgccttgcccccgcccccaccatcacagtgtgtccctgtccagtgttggtgctgtgtggcattggcttgtgtccataggagtccatcaaggcagagcggcagagtgggaaggcaggtcagcttccagctcttccaggctgcatgtcccactcaatatcctgtaagttctgatctggcagatactgaatactcaagggttcacattctcttagcctagaggtggctgcaataatgaaaggcatttggctgatgtgttttcaaaggagagggaagctgtctgtgtttgttacctgcggctgcataacaaatgaccacagcctagtgactcgaaacatcacacaccagttacctccgctctcagtaggtcagaagttcaggcatagaccagctgtggcctccactctgagtctcagcaggctacaatcagggctcaatcagggctgtggtcctgtcagaggctctctcaggttgttggtggttgtaggactgaagttcctgtttttggggggtagtcagctggtgtattagtctattttcacactagtgatcaagacatacctgagactgggtactttatttaaaaaaaaaaaagagatttaatggactcacagttccatgtggctggggaggcctcaccatcatggtggaaggcaaaaggcccaccttacatggcagcaggcaagagaga

SEQ ID NO: 35707 - DNA, 1049 bp, Homo sapiens
cagttcaacccaatggaaatggattgaaagagtgaaagtcactggtctcaaagaatctacggaatttagcattttgaaaatcacatagcaattttgggtaggtattcacctgcactaaaaaaccaggcaaacatccgactcccaggataaagtgactgagagcagtagaagacttgttgagccttaaggaataagaggaaaattacgttatgaagtgcaggaacagcacagacccagacgaggggacgcagcccggagccagtaacccggcgccacctcctccccagggcgcagcgctggctgatccccagataccgtgatcacacgtcccgggtcctgagagcgcctcataggtagacagttctttgggacttctgggatgcagcacttgaagagaggtttacctaaactttcctcctgggagcctgtgatcatttgaaagtaacagaagaaagttgtcaggctgaggaaagtttcaacaggcacttggtgagaatgggaagcatccattcattgtgaaatcgcggggacagaggaggaattcacgggatcagagcactgagaaactccagaggcttctggttcaccgccctgattccacagatgtgggtcagaggcagagatggaagttggaatggacaagcctgccctctccttggctctccatggctctgtcctcaggctgtttctgcaatttgacatgaggcctggccccagggaaaccagtggggcctcatctcctccctgtgctgctctgaggtggagccttctcagggtcagtccagctctggagcccctctccagctcggtcaccaaagctgtctggtcccagggcggtgctgagtgacaggcatgccagccaatccaatcggcaatttcatatccaatgcatgtgactgataaagagataacgccctgtctccaagacacaggctttacataaacagctttaatgacttcttcacttagagacaagactccttagtggtggaacctcaggcatccgtgcaggacgtaagaaagctgccgtatatacatgaactgagaag

SEQ ID NO: 35708 - DNA, 1116 bp, Homo sapiens
taccagatggagataattacagctttaaaaatttttattttttcattttatttcacatattgacattaaatttttattgacacataataattgtacatatatatggggtacaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatctgttaagccaaccaaagattggaaatattgggaaaaaaaattgcgtctgtactgaacatgtacagacttttttcttgtccttattccttacacaatatagtacaataactatttgcatgacatttacatcggatattatgagtgatctagagttgatatgaagtatatgggaggatgtgcaaaggtgatgtgcaaatactatgtcattttatatcagggacttgagtatcctttgttatcctcaggagatcctgaaactagtcctccatggatactgagggctgactgtctagtcctatcctcacggaactttcattgtaatgagggaagactgactataaacaaaatatatgtaataggtggtggtaagtaccgtggagaagtaacaaatggggcaaagtgagttatacagctccatccttagaaaccttggagtacttttcttagtttatactcgtggtggtttccttttgtctcctttattacatgggactctgacatgtgcccatagctagggtggcagtaggatctacccgaaaagcgtcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcataactctgatggaattgaagtcatgaggcagcagagagcttaaattagagctttaaaaa

SEQ ID NO: 35709 - DNA, 1067 bp, Homo sapiens
tgtgttctggcaggggaagatgggacagagaggatgggagggtgtctgagcctttcccggactgacggaacctgtgtcttctctcttttgtggacaggatggtgattgctcacaccaaagccttggacccctcccagcctgtgacctttgtgaccaactccacctacgcagcagacaagggggtgagcctgggggtccccaccccatttctccctgcctttgcctgggcttgtcctgaagcctgctcatgggaagagctggaaagaaccatgtgctgccagtctgagctttttattttgttttacttagaaagatagagacagggtcttgccatgttgcccaggctggtctcgaactcctgggctcaagtggtcctcctgcctcggccttccagagggctggggtgacaggcgtgtgccaccgcactcagccgcagccagtctgttttcaaagatggtctttgggttaatgacaattctctctctgcttactctctaggcagtgtggctttctgaatttaaggaggctgggcatagggagatgggatttgtttgcccagtttggactcagcattttttgtactcgatttaatagactcataaaatgtcaaaggtttaagtgagcttagagttcatctggcccaaacctggctgatcagaatctccaggggaagttttattgaaatgccagatctctgcattctgagatcctgatttagtaactccagggttggaacctgagtttttttttgtttttgttttttttttttgtgaaggcaaggtcttactctgttgctctggctggagtgcagtggtgtgatcacagctcactgcagccttgaattcctgggcctaagcaaccctcttgcctcagccttccaagtagctgggactccgggtgtacaccactgtgcccggctaattttaaatgtttttgtagagatgggatctcactatgttgcccaggccagtctcaaactcttgagctcaagtgatcctcctgccttagcctcctaaagtgctgggattacaggcatgagccaccgtgcctggctgatactagcattc

SEQ ID NO: 35710 - DNA, 1202 bp, Homo sapiens
tcatccatacaaaagaacaagatcatgtcctttgcaggaacatgggtggagctggagaccattatcctcagctccacccatcctcagctcccactaacgcaggaacagaaaaacaaatgcagcatgttcttatttataaatgtgagccaaatgataagaacacatggactcatagaggagaacaccacacactcggacctacctgagagtagtgggtgggaaaagggagaggttcaggaaaagtaactaatgggtactaagcttaatacctgggtgacaacataacctgtacaacaaatccccatgacacgagtttacctgtataacaaacctgcacgtgtactcctgaacttaaactaaaagttaacaaaaggccaggtgcagtgtttcacgcacgtaatcccagcactttgggaggctgacacgggtggatcacctgaggtcaggagttcaagaccagcccgaccaactaaatacaaaaaattagctagatgtggtggcatgtaatcccagctcctctggaggccaaggcaggagaatcgcttgaatccagaaggcagaggttgcactgagccgagattgtgccactgcactccagcctgggcaataagagtgaaactctgtctcaaaaaaaaaaaaaacaaaaagttaacaaaacgggcttctctagttctaaagcaccaacacagaggtgatcaaaatactctaagaagcactgggaaacattgaggggatggttcaaacatcagagctaaggcctaatttcccaacagtcattatttctgtggtattcggcatattagagacgtataggttcctcacctaatccttgttttgtcattttatttttaatacatatgaaagtcataataacaaaaaaaattcatacatcagcagctcagctagaaataaaagtctcaatctactggaagcccctgtgaacttgtatcaaattcctttctctcttcatagaggaaataatgactcctaaaatgtggtaatgaacaaatatctctaattgtttaaaatttagtatatgtgcaagtctccacagacacaatttaatcatgatcatatatttttagaagttaaaaacgtgtctatcatcagggcgtggtggttcatgcctgtaatcccagcactttgggaggcctaagcgggtggatcacctgaggtcaggcgttcgagaccatcctggccaa

SEQ ID NO: 35711 - DNA, 1029 bp, Homo sapiens
tgaactttgttattaagaaaatcactcaaaccgaaacgtataaagtggacgcaatgtagagaataagtgtgtttttgcaaaggaaaaagattttgaaaaagtcaatattttgagaaatagcctctcagagtttctattcctacattgatcatgaacgaaactgaagcaaaatagtaataaaattagtaacttattattaaaataatttaaaatacaacattcataaacctgtgtgtgcatctaacagtatcaaaataaatcagaactttttggaactgttagaaagcatccatactcacagtaaaaaattatgatctgataggccaagaatacattggtaatgaataaggaatatctaaaaaaaaatgcattaataagcttaattaaatgggtatataaacaaactgtcacacaacaaagataaaaaatatatactatttaataaagtaattcttttaaattttaaaaaatacaaacattctcatttaattctgaaagtaaatatcatataaatcattctgtaagaaataaaattaattagtaaatctataaattaacttttttcagatagtgatagaatcatttttatatcccttcaatcatcaatataatggactaaatacacagacttattaaaaatttattattattattttgagatggagtctcactctgtcacccaggcttgagtgccgtggcacaatcttggctctctgcaacctccgcctcctgggttcaagctattctcctgcctcagcctcccgagtagctaggactacaggcacaagccaccacgtctggctaatttttgtattcttactaacaaggaggttttaccaggttggccaggctggtctcgaactcctgacctcaggtgatccgcctgcctcagcctcccaacgtgctgggattacaggggtgagccaccgcgcccggcccacattatttttatacaatataaagacaaactagagcacattattgaatatatttcatgtgtcattgctttatttcaggaattaagtctga

SEQ ID NO: 35712 - DNA, 1023 bp, Homo sapiens
tggtgttcaaaatcaagctcactgaaaaattgcacatattcgccactccactttttttctccagacttttctctttcttgggtttccccctaatgttctgtcttctttgcagatgtttctttccgcattttaaatgctgagatttcccagagctaatttcatctcttcatgtcttcgtgctactaaatgtgatccatatattgcagggggtactcacacagaatttgcataagatagaccggaacttgaagttctgccatttaccactcaactttgcaactttgggaaacacactttatatccatgtccatctgagaattcatccctcaaatgggaaaatagagtttaacatctgaatccatttggtagattaaaagaaataataaatataaaataattagcacagcatagtacccagaaagcaatactaatgaccaccataactcccaattctctatcccaagcttgacttcctacacacacatttgtcaactacaacctgatgtctcatagaatctctaactcagcaagttcagaactaaattcataataattcatctgtttctagctctttctcctcccttccttctacagtgatacagggtcctctctaaacattctgagtcatgggttatttgagtgagtgagaatataagccaaattaaagaagcaaaaatgcaacacattctagaatctttctccctaaagctatagctagtcattactataatattaaaggtcctgccctcttaagatgttatatattgaatcattttctatccccgttgtcactatagtgtcataattcaggcttatattttacctggtctcaaaaattacaatacattcttatctatctagagacgcattcacacatgcactaagatagatttttccaacatataaataattacattatctaatttcacttatagcaaaaattttacttatactttggcttatagcaaaaatttcctgattttttgtatattatagcaatatgaaatcttaccaaatttggaa

SEQ ID NO: 35713 - DNA, 1069 bp, Homo sapiens
tttgcacagtttttgtattcgcataatgaatgaacagcattgtcacgagcatttttaagtgccttaggatgggactgtcatccagccattaaatcctgcaaattcagttctgaggggaataaaaaagaaatacaggaacatagagtgagagttgtattttgtatttcctttgtcccttttgcacagtttcagaatgcattgacaaatcagtttctgtagcaatgggattcagattctggatttttttttaaaaagaacataagcttctgaggctagaagtagagaatgacctccagtggctggtgtcaaaagaagagaacagccaataaattatatttgtcctagatctgacaacccatgtagaattacattggtacagaactaaccagtaccctgttgatgtcgaagatgtttcttattccccaaatatgtgaacctaattatgactgtattataatctagcagatctcactaagtatattccaatggctatatgcagtcttagaattgaacacacagagcacaccattgtgttgccgatggcataaaaacttgaagaaactccaagatgaccagaactcagaagtctgcagtcatagtaagtgaaatgacaaaaaaaaagtagagaacagttagatttcttgggtaaaggctgaacaatctactgatgcaagaaacagaggaggagtttcctcttaggacttgagaagattcattgatagaaaaaggactctgtaaaaatgagcagatagtgtttgatataaggcaatgatttgactgtatgatgggtgccttgatcaggtttggaggtaataatttgcatggcaacctaatatataccgtcaggtaaaacctcctgaaaattacatgaatgataccagatagcacatgtgtcctattttgatacataccctggtcctgctgagattgtgcctttgctatgaagcaaggcctctttgaggcacattattgtacttagacaaggccctgcattctagagaaagagacaagctgggaaaaaagattttgtacacgctcaaagaatgaatgtccatttgagagtataaac

SEQ ID NO: 35714 - DNA, 1065 bp, Homo sapiens
tttaaaacttaaacagaatgcagattgcaataatatagcagagatgtgcacaaaattgtgagtcactttaaaaactgttaaccctgcaatgtattcttgtatggaacagtgcagtaaaataaacataactgaagcagaaatatttctgtctcctagaaacgcatatataatattaaaactgacaaataataccccctttgtatggcattccgtaatttaatgtgttaccttgttttcatcattgaaattaatagttttttttttttttttactgaaataaagaaacatttatgaaaagaacacatgataacatatttttttttggtccaagagaaaaagttagcatctgatgttggaaaatgatcaatgataagaaatgagattttgcaaaataaagtcattgaatatgttatggaaaatacagcctctgtccctcattatcatggtgtgcaaactgaggagttaaacaattgagatctctgtgatctagtacccccatctcgcctgttatttccaactctgaagacagaaatctatcaccagatggatgcagtatatctatatctacatctatatctatatctatatctatatctatcaatattatctgtatctatgtctctatctaatctatcattttttggtagctacttaatcctctattgaaattagatttcatattgagacaggattgttcccctgacctcccttcatgggcgggaagtggagtggcctgttacccttagcctgctgctggccactccttgcaagagggagtgtgcgagcaagcaagtgcaggaaccagaagaaaggaacactggaatcagctagctgcttctctctggtaggagcaggctctatgcgttccacagcagcatccaatcccctgccctcttggcacccatttcttgttcggggtccagaaagaatcaggtcactaattgaagggtagtgtatgcagaggattttactgggcaatggatgtggttctcagtggaatggggagttggaaaggggatggtgcgggaagaaagtgatctttccctgaagccgcaccctctgaag

SEQ ID NO: 35715 - DNA, 1038 bp, Homo sapiens
tttgaggaatttcagactgattttcacagaggctgaatgatttacattaccaccagtgattaaggagggctccagtttcttcagatctacatcaataattattttccatgtttttagttatagccacttttgcaggtttgatagtagtaactttgtgtggttttgattggcatttgtctaataactaatgacactgaacatcttttcatgtgtttattggccatttgtatatctttggagaaatgtctacccatgtccatgatttatttatttaaattgggttgtttgtctttttgttgttgattgtacgtattctttgtatattctgggtatgaggcacttattagaaatatgatttgcaaacattttctcctcttctctaggttatcattttcttgataacgtgaaatgtgttactctatatgtgtatgttgaaaccctaacccagaatgttactgtatttgaagttagggaatttaaggttaaatgaggttatacctgtgggatctttgataggaatggtgtccttataagaagaggaagaagagccatggatttactcataggggaatacctatgtgaagacaatgagaaagtgaccatctgaaagccaaaaagagaggccccaggagaaactaaacctgcagacaccttgaccttggacttcctgtttccaaaactataagaaaataatttatattgtttaagctacccagtctgtagcattttgtcttaggaaacctagaaaaacaatacatgttttttttttttaatgcccaaagtgttttaattttgatgaaatacaactatctgttttttttcttttattgcttaattttgttggtcttatagctaaagaattcattgacaaatctaaggtcatttggatttaatcatgttttcttctatggctttcatggttttagtgcttatatttatggcaatgatacatgttcagttaattttttatatgttgtgaggtaggagtccagttttattcttttgcatgtagatattcagttgtctaaacattatttt

SEQ ID NO: 35716 - DNA, 1050 bp, Homo sapiens
ccgacagtcctagctaaacttcgctaactccgctgcctttgccgccaccatgcccaaaacgatcagtgtgcgtgtgaccaccatggacgcagagctggagtttaccatccagcccaacaccaccgggaagcagctatttgaccaggtggtgaaaactattggcttgagggaagtttgtttctttggtctgcagtaccaggacaccaaaggtttctccacctggctgaaactcaattaagaaggtgactgcccaggaagtgcggaaggaaagccccctgctctttaagttcagtgccaagttctaccctgaggatgtgtccgaccgaggaattgattcaggacaccactcagcgtctgttccttctgcaagtgaaagagggcattctcagtgatgatatttactgccggcctgagactgctgtgctgctggcctcccatgctgtccagtctaagtatgggaacttcagtaaggaggtgcataagtctggctacctggccggagacgagttgctcccacagagagtcctggaacagcacaaactcagcaaggaccagtgggaggagcggatccaggtgtggcatgaggaacaccgtggcatgctcagggaggatgctgtcctggagtatctgaagattgctcaagatctggagatgtatggtgtaaactacttcagcatcaagaaaaagaaaggctcagagctgtggctgggggtggatgcactgggtctcaacatctatgagcagcatgacagactaactcccaagataggctttccttggagtgaaatcaggagcatttctttcaatgataagaactttgtcatcaagcccattgacaaaagagccccggactttgtcttctatgctccctggctgcagattaacaagcggatcttggccttgtgcatggggaaccgtgaactatacatgcgccgtcgcaagcctgacaccattgaggtgcagcagatgaaggcacgggcccgggaggagaagcaccagaagcagatggagcgtgctatgctggaaaatgagaagaagcgtgaaatggca

SEQ ID NO: 35717 - DNA, 1049 bp, Homo sapiens
gagtatatagaggcttagctctatttttgaaatgactctctaaggtcttacaaattgaaaaagcaaaactcaagacaaaaaaaaaattaatttgcaaaagtcagtattatctacaggaattaacaaagaaaaagactcaaatctctgaatatttaatgtgtgggtttatgagtttttttttttttttgctttgttttgcttttttgagatggagtctcactctgtcacccaggctggagtgcagtggcgtgatcttggctcactgcaacctctgcctcccaggttcaagtgattctcctgcctcagcctcctgagtagctgggactataggtgcccactaccatgcacggctaatttttgtacatttagtagagacggtctcaccatattggccaggctggtcttgcactactgaccttgtggtccacccaccttggcctcccaaagtgctgggattacagttgtgagccaccgtgcccggccaagtttaatatgttgttcgatttgttactttcctttgtctccgcttcccctctctgaattaaaatcaatgccttgatttgtcaaacaaatatgtagtgagtacccactatgtataaatctttgcatcatttgccacaaaaaaaggctgatatcaattatataaagcattagaatgtactagaaacaataaggaaaaaagtgacagataaatacaacagaaatatatctaatattgctttaaagttataatttgtaattttaattcaacctgtagcagtctggttagttttaagtatttattgaaattctatggactgtatttgtaaactgagaattaaaacaaatagcctgcagattttctgtattgacttattagaatggtatatataaattgcctgcctgatataaagtaagtcacttcatatatagtagttactgttactatatttggggaaaaccatgaaagtttcatgaaaaaaagtgtcctttgagcttttacaaaccagcttagtaggtagagtctgaaagttaaatgtgtgtgtgtgcacgtgtgtgtgccatggccc

SEQ ID NO: 35718 - DNA, 1035 bp, Homo sapiens
ttacagaaagcgtaactagagagagacattaacttgcagatgatttgtttctggctaatgttgtgacaggagtgtagcatttcctttcttctcagtttcctatctcacttaccttttgaaaagacatgattccatattatatttattctgtttctctctttctttattcatttaccctactttactgaaaaatctcaaacatcatagaaacatgcatgtcttggttctccaagtttgaaaggaaaataatgtagaaagctctgttttttttgccctggcatttatatactctccaatctcactactcccatatcactcttctacctctcttagagcaaaattgcctcttaaaaaaggacattgcacccagcatggtggctcatgcctgtaatcccacaactttgggaaattgcgccagtgcactccagtctgggagacagagcgagactccatctaaaaaaaaaaaaaaaaaaaaagtacattgctgattccatttcagcatcactcaattaccattctctaactgtctctgatttgtctttaccaaaagccacatctggcataattggcaaaagactttttttttttccccaccattccaatgaacacaaaaatgacattctcaacatcaaatcaaatgatcacatttttattcatattttactccaactgaaatgaaggatataactaatttgtccatttttctttaagcacatatctgtattcattttgataacccagcactcttgattgttcccttactgaatgtttgtctcttagtatcctttgcccattctactcctttaaaaaaactgttgcagtaaccaaagagttatttttgattccacttctttgtcaaactaaagtcagctctttgaggcttctggattttgatattaaatatgtgtttagcagttcaaattttatatatgtatattctagctcagatccagaaatctatttccttcttatcattctcacttggattcctcaagcaatttaacatgctctaaatatttcttccatgtttattta

SEQ ID NO: 35719 - DNA, 1026 bp, Homo sapiens
gaaaatagttttgtaatagtgatgtccctgaaaaagtctcaggaaccactctagggaccacactttgagacctgtggtcttaaaatgttgtggataaaattacacttgggaaaaaataaaaataaaagttttaatgttgtctctatgtttcttttccagagaattaagtattgaaaattggattatgcctgcagtttatgctggccatttttcacatgtaatatggtttcatcccacatgggctcagcagatcagagagggcagacaccactttttagtaggcaaagacacttctaccacaacaatcaggtaatttcctcatatttgtgaatatggaagtgattgaatgtttctatcttattttggattcctataataacttcataagtctctgcacacaaatagggtcagattaagcctcgacttctccaaagagttctcaaaacacgaagaacaaacttttaagtctcttgatattcttcatgtaccatttatatttagttgctggtcaaattagattttgaatgtgatcattatcctccggaatttgggcttcattggtgattaactccttaagccattgaagtatcttatagatttatacattcagtagtacattttactgtttcctgtcagtataactgttgtctgctgaatttgccgcagtggctcacgcctgtaatcccagcactttgggaggccgaggtgggcagaagacgaggtcaagagatcgagatcatcctggctaacatggtgaaacaccgtctctactaaaaatacaaaaacaaattagccgggcgtggtggcaggcgcctgtagtcccagctactcaggaggctgaggcaggagaatggcgtgaacccaggagacagagcttgcagtgagctgagatcgtgccactgtactccagcctgggcaacagagtgagactctgtctcaaaaacaaaacaaaaaacaaacaaacaaaaaaacagtaattagcagtgaaagggcaaaattatctcactttgatttttttataaatcc

SEQ ID NO: 35720 - DNA, 1130 bp, Homo sapiens
tttggggaaccctagttccttctacctttttgcaccaccgtctctagaatattgcccctgtccttatagtccagggtggcttgccacctctgtgttcatatgccagtcagcagggaacaggagaacaaagctctgcatgcttttcttccattcacaaccaccggccttaatttaatcacatggccacaccaggctgcaaggcagactgaaatgtagtctttatatggggcagctgtgtgtccagctaagaatttgaggaatgctatttctacagaagaacaggaagtataaatactagagactgctctcagtttttgtcaaataggtccgttcttatatttctgccataccatagtgaaatgtcaactgatttgcccattcttcttaaaaatcgttttttcctctgattcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggtaaataattgtgtttttaacacatagatcttgagaattgtatggcttttctctagatgaggaaccagcaaactctttaaacagccagctagcaattattttaggctttggggttcacattctctactaatacccttttctgttgttttctaaaccttttaaagttgtatataccattcttaacttgagggccatacacaaacaggctataggctgtggattgccaactcctgctctagatagtattcattattttgcatttattaattggggtaatgtatacatggg

SEQ ID NO: 35721 - DNA, 1035 bp, Homo sapiens
ctaccccagccagaaactaacattctcaaaagctactaccaaaaaaaccccacaaatttgccaatccatgaaagtatcataggaagtctacctttccaaggaatttggcattgtggccctgctcttgccaaatgctctccagcattgttggtatcaaggtggtctggttgagtaaacttgaccaaacaaaaattaactgttttttgcttttctgtttttgttttgctgatcaaaaaagcccttcagggtctcttgtgcatccaggaggtcattgtagatatcaataatatagtgcctaagtgccactttattgccaagtctagattgatacttttttcagataaaccagctttttatgtaaagagtaagggaaaaagttaaatctttaattctgacctgccataaatacccaaagatataaactgtcttccaccacccccctcataactaagacatccttcctgagtcactcttaatcatgaaacttgattttctcaattggccagtcttctgatctttagtatctctttagttcagtaatttttacctacctacttgatttattttcctttaaaaggtgaaatgacatttaaagaaaaacaaacacccatcattcctcagtcccaacacagcagttcttttcactcttgcttgtaactttcaggccttacccacatgtgttcctatagagttgcatgtagctaaaattatagtgtgctgcctaactttgtgctaataacgaaggacacacattatcattgcctcacagtggatggcacctgaccccatttttccaaggattctattttccagtgaatttttgtcaccgagttaatttcccaagtctgatagcatgaatgcttatttgtgctgtgaaaagcagagcagcctgactcagctttccattttcataggataatatgtgccaaaaaaggtttattttcttggtaaaatcagaattgtagaattgtgctatttttaatttttaaaatttttggttagagcttatagacattacttttatgattattttgc

SEQ ID NO: 35722 - DNA, 1028 bp, Homo sapiens
gtcttctcaaggttgtatgtgtcataattggtccaaaatgaatttctttgcttaatttctagttaaagcgaaaatacttctcatgcctctgtttgagctcccaaggtatttgcaagcctaaattgcttggccttttgacttgcaagtggttaatttatttctacctctcctgtttccagcctgcagtttgggtattcagaggctaaagagccttttcagggtgtctggtatttttgttgatgttgttttgctttgttttacatttccaaatccaggaaacggctgtggttaagaggttaagaggcccagaatgatagggctcccatatttaccaggcaaccatggtacccagcgcagcacagagcctgcttactcaggattggttttatttatatttttttaaattgaggtaaaattaaccattttaaagtgtacaattcagtggcatttagtatgtccgcaatgttgtgcaactgtctgtgtaattccaaaacattttcatcatccctcaaaagagaccctgtatccattaagcggtcactcgctattggcccctctgcagctcttggcaaccactaagctgaaccctgtgtctatggatataactcttcgggatggtttatataagtgaaataatacaaccttctgtgtattattccacttatatgtattctgtgaccttctgtgtctggcttcttacgcttagcataatgttgtcgtctgtgttgtagcacgtatcccaaccttcatttctttatatggccaaatagtattctatcatgtggatgcaccacattttgtgtatccattcatctgttgatgaacatttgggctgtttctaccttttgactactgtcaacactgttttgttactatgaacatccatgctgagtatttgtttgaataacttatcagttcattggggcatatacttaagagtggaattgctcagtcatatggttattctgtgtttacctttttgagggctcagcgttggtttcagtggtttagctcctgggctgccatta

SEQ ID NO: 35723 - DNA, 1057 bp, Homo sapiens
caaatattctttctgattagccagtccatcttcacctttggaggatgttatatgaatagcattagtactcttttcccctgctgaattctgccatacatacattgattttgacctactctgaatctctttagtgttgagtatgtcatgtattttcatattaggttatattcttttttcttttttttttttttgatacagggtcttactctgctgcccaggctggagtgcagtggcacaatcatggctcactgaagcctcaaccttcccgggctcaggtgatcctccagcctcagcatccccaatggctgggattacaggcatgcgccaccatgcccggccaatctttgtatttttttgtagagataggtattcgccatgttgcccagggctcaagcgatccacccatctcggcctcccaaagtgctgggactacagacgtgagccactgtgcctggcctatattctactgcttgtcgttgcttgtattttcttttctggtacagtggaagtctgtcatatttttatgctattgtatcttgcatgatgcctagcatattgaaaataataaataaattgctcatggaatgaatagtttaaatcatcgctagaaataggggaatggctcttttgaaggcaggcctatggcatccaggttcttttaggacaaatctttcacctgttccttcatccttcagttcatccattcattcgtccatctatccccagcaaccactgagagggtgcccactctctgtcagattctcagctaggatattggtgcctcagatatgaaagaaatggaagaaacatgccccacggaagaaactgaaagaccaggtatgcatgatgtgtagtttgctaatccagacaatgactgtgcattttgagaggctagtaggtgagaaaatgaaataaagaattctagactcagctaattggctcaggcggcatcaaatatagagttttctgtcctagtctttccttttcttccctttaattgtgcctgtttgtaaccaaagcacaagtaacttcttactaatgtggtaagagctttata

SEQ ID NO: 35724 - DNA, 1095 bp, Homo sapiens
ttactagaaatcggaaatgcctttttcgtttgattaagagttactggtttgtgagggcagtgactgagatgtcattatctgtgtttttggaagctgcagggctctgagtctagccctcaggagctcttagcatcagtgaaccttgccagcatcagcaggcccccagctcctgcccacagagcacctccctgccaggggccacagtccctagggcctccggtatcaggcggtcaggatgacagtatcctaagaaaaccctttcccctagccagtccccagcatgcggcacactgtctacctcagccatgagcctctgtccttgcgtgtgtgcagtttcttgtttagaacagacccacaagaaataaagaaactcatgaacctcaacaaaataaccacctaccgcaaggacagaatgatgtttacgagccacaatggaaggaaggaaccactttggcaaattcatcactggaatttgaatgatgcgtatgtgttcttacatataatttgaagttgagaacgtggaacattgagaagaagagactgagaggttgtgacgtcatcaagaaagcagaagaggtagccccagaccctctttcctggcatggagacagtgactcagcaccatgcagaccagttctctttgtgaaaaatccagaaaccagaggctcctatacctcaggtgagcgcttcaccagcctcatcaaagctggtcatctgacatcaagctggaaatggccaactgcaagcagtcttcaaaggatctgaaaatacaaagaatttgaaagtaaaggagaggagggagccctctgattaaaaaaaaaaaaaaaaaagtcatagtgtagacctttaatctctgagagtagtgagctcgggctctgacttgactgaaggcaccaaaatagctaagcccagaaggttatttattatatacgaatgggatggtctggccgtggaattcctctggaagacaagctgcagaactgcaggagagggcacctgctgcccgtcacggatgtccacccaatcctgctcaggaggaactcggggactcagggaacctgaaactttttacacgcttccatccacactcattcc

SEQ ID NO: 35725 - DNA, 1052 bp, Homo sapiens
tgaaaacaaacacaatatatgtttagacccactgtgtctatgttaactggcctgtcattgctccttcctcccccaaggcaggcttttctgccctttacattgttacgaacattgtatttattgtagccatttagttgtggagaaaccatggctgcccccaaacttgaaacatcggcatattagtcagggttctacagagaaacagaactgagaggatatatatgcacacacatacagacatatatctacatacgtgtgtgtatgtgtgtgtgtacagtcatgcactgaataataacgtttcagtaaccagtggattgcatatacgatgatggtcccatatgactataatggaacatatacaaaaaaacctgctaatggcacttgatattggcgttgcaggactagtaggggagatgattgatagtaatggtgctgagacatttggttttccatatgaaaaaatatataaataatctagttttgtgtaagtacactgcgtgatttttacacaatgacaattacttgacgacacatttctcagaacatatccctatcattaagcaaagcatgactacatatgtatatatgtgtgtacatatatatatgtatatagagagatcctgagagcaattgagatttaagaaatttggtcacagatcctagcactttgggagactgaggcaggagaattgcttgagccaggagtttgagaaccagcctgggcaacataatgagaccccatctctacaaaaaatttaaaaattagctgggcatggtagcatgtgcctgtagtcgcagctactcaggaggctgaggtaggaggattacctgagcccaggaggtgaaggctgcagtgagtcatgatagagccactgctgtactccagtttgggtgacagagtgaagccttgtctcaccaaaagaaaaaaaaaaaattggttcacagctcacatgattgtggaggatgacaagtcccaaatctgcagggccagctagaagattgaaaattctttttatttatttatttatttatttatttatttatttatttat

SEQ ID NO: 35726 - DNA, 1088 bp, Homo sapiens
cagtccatcggccaactggtcgtcacttgggtggacccttgaacgcgtctgtctgctgtgctgtctaggaagggtgtgtggggttctaactggcacctctctgtctgttgcagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggccctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacgggtaaggtttggtttgattatggaaccagaattttatttatcgtgtgtgtttgtttgtttttgcagcccagcccatgcgggaaatacaagctgggctcagaaccagaattttgaaagaaatattgtttgaagttgcttttaaggtttaaaaaatatacctaagatgacctcgcattgagaagccaacaaatgcattaagaaaagtgatcagaggagaatgacaaaaaagctccagtcattttatcctacttaaataaagagctagtcaagtgatcctaagtggaaaactcaagccttctgtgttaaaatttgagtcatgtgaggtccagataaagtacttcactgcatcgttatttatcgctgctgtcaccagtggaatcgctgctgcaaggccaagaattcctgatggcagctgacaccacaaacatctaagcctcagtattacacaggaagggtattcaatacacagggaag

SEQ ID NO: 35727 - DNA, 1012 bp, Homo sapiens
aagagaagaggaagagtttcagtataatagggtgtgaaatgggtgatacttattaagttggagcctgtctccctttttatatttttaacaaagaaaaaaaaatggaagtaatggttgtctttgccaaatctgcaattgtaaagctcagctcggaagagtttgtttagcacatcaatcaggagacccgtatccggcttccgttgccatcaagcaaatcagttctaacatttttggaatcacaagtttggaaaaatcttggagaacttttgggcgattcaggttttagaaggaataagggacctgtttcttacaaggaaagaagagcaaagcaggaccttccgattctgtgagtctgatatgggtgtttgattcttcgttggtggaactgccaggggtatgggagcctgaaagccagtatcctcgagtgtagaaatgaggcctgtggaaagaaaggagaggacctcttgtgttttatttggactgaataattgatcaaatgtccgctctaaatgtttccaaatgtgtccgggcagtaaggacttctgttacagcatctgaatgtatcatttttggttgattcgtggtgtcctagatgggaaactctctcttgtttcggggttgacctggttttttctggcaaattgaacttagagtctaatacaaagaacaatgaataccaagggtgtaaacctgtgattagcattaaaacagaaagacacggagtctgactggaaggcagatcttcggagtagtactgttaatcctgaaagacaccagcatggagctctgcatctatggggagcgcatgttcttcccctgaggccttgaggatagagggttaccacttaggctgcttctatgggcagtgtgggctgagctcacagtctctctgagcccagggcaatcacagcagcctctgcttatggattccccactctgcccctgggtcaagaacagtctgcccttctctttggacttccacttgctatttatgtaacttcaggattcacct

SEQ ID NO: 35728 - DNA, 1050 bp, Homo sapiens
aatcccagcactttgggaggctgagatgggcaggtcacttgaggttaggtatttgagaccagcctggccaacatggtgaaacccccatctctactaaaaatacaaaaattagctgggcatggtggcgtgcgcctgtagtcccagctactcgggaggctgaggcacgagaattgcttaaaccctggaggcggaggttgcagtgagccaagattgcaccactgctctccagcctgggtgatagagcaaaactctgtctccaaaaaaaaagaaaagaaaatgactgacaaggtttccactgaactctaagacagataaaaatgaggagcggatttttcaggaatgttaaacactcattgtttagaagaaaatactgtttgttgttgaacccctgaagtaccatcaggttctgtgatgcacagtttgagaactgctttcttgggaaggagcttagagcaataaaactataagatggcagaaggaatgtccaacacagtggggttcaaatgacaaacctggaagccttttccacttcctcgttgataaagtggagacaatgacatctacctcaagtcttactgtgagtaagaaaagaactgaacacatacattgtggagctcaatgttgggtgtgcagctggaccctgctgcatttttgttctctttcgtctgtctttgcttgggaacaggtcacttcactttgattgggagtaagtttgaggagaaaacaagacattcctggaagcgtgttgccacttgaggctcaggtgggataacgaggagcacaaaaggcagaagccaagaaaaggccccaccatgccacagccaaaagcaaccacagatgtaaaatggcacagtggatctggcagttctccttaaaacgttaaacacagagtcaccatatgactcatcagttccgctgctatgtatatacccaagagaactgaaaacgtatgtctgcacaaaaacctgtacatgaaagttcaaagaagcgttattcataatagccagaaagtggaaacaacccaaatctcccttaaccaacgaatggata

SEQ ID NO: 35729 - DNA, 1007 bp, Homo sapiens
ttttcttttttttttttttgagacggagtctcgctctgtcaccaggctggagtgcagtagcacgaatctcggctcactgcaacctccgcctcctgggttcaagagattctcctgcctcagtctcctgagtagctgggactacaggcatgcgccaccacccccagccaatttttgtatttttagtagagacgggatttcacctggttggccaggatggtctcgatctcttgacctcgccatctgcctgccttggcctcccaaagtgctgggattacaggtgtgagccacggcgcccagcctaggccttattttcagagtggctttcatggatctagtagtgtaggcattatgaaataatatgatacttaatttcattgccattacagcttgatgtacatcaaacatcaatacataagcagttctctaaatgtattaaagagttgtaccaaagaaaaatcaatagacttatcttttaaagtctgaagtgattggggcagaatcgtgactagagagaagatactagagatgcttacttcctggttccttcagctctgattttgaagaactttcttccatagggatgtagtctacctgaggtgacatctgtgatagtaaagagactggagaattatctcataattatttagtacctgtgtcttgaaaggtcagaatagttgaggcaggaaactttaatccatatttttcttcagagttaggcacaaagggtcagtaatactgctttagtttatttgatgatttaaggatacttgatacttttaaattatttaatttaaaatgattataactggtcattttaatctggggcaggagtccatagaattgttttttaatttgagttttcttttttgtgtttgaaggaattattcataacctttatcacaggggtccctcctgcacaggaggtgagcggtgtgtgagtgaacattgcagcccgagctctgcctcctgtcagatcagcagcggcattagattctcataggagcgcg

SEQ ID NO: 35730 - DNA, 1050 bp, Homo sapiens
gttgtttccacttcttggctcttgtgaataatgctgctatgaacatgggtgtgcagatgtctcttggagtctgtgctttcaattttttgggatatatattcagaagtaggattgctggatcatatgatagtttaaacagcaatttcctttggttgcagttttgatactgagagtagtacagttgacccttgaacaatgcagggtcaaaatgcaaggcaccaacccctgtgcagttgaaaatctggttataacttttgactttgtcaaaactgctaagtatagcctactgttgactggtagccttaacagtaacataaacagttaacatatatttgtatgttatatgtattatatactgtattcttacaataaagtaagctagagaaaagaaaatattactaagaaaatcataagggagaaaaattacattttactgtactgtatggtgtttatcaataacattagtttacgttgtctgtttataagatatgtcatctgttaataaaatatgtcatctgttagaaattgtaggcaaccacagctgcagatttcagtccgtggtacatatcaagcaattcaacttttttatttttatttttatttttatttttttgcattttaaaattaaagacaggatcttgctgtgttgcccagattggattcaagctcctgggctcaagtgatcctccggcctcagcctcctgagtagctgggatcataggcatgcaccactgcttctggcagtttttttcttgtgatgtcatgccttctctctgcttcttgggagcactttcagcatcactaggggcactttgtataggactcatggtgttatttaaagtttatggtattgcagtaatcatgatgaaaaataatgtgaaaaccgtgagagatcactttttactgcaatacgcaatttgttggagacatgaactgctcagcagagatgattagcatcacatggtgttttacacaaggtgttttaagcagatacttgtaacatttgagtacactgagataacaggaagtggctatgaagttaacactagt

SEQ ID NO: 35731 - DNA, 1030 bp, Homo sapiens
tttcttaaaagttgtagtatgtaatttccccttgaaaacttgaatttcatcattgacaacacatgctgtcagttgtttttttttgaagtgataggctcagtttgtttgtttctgagaaattgtctgccaaatccacaggtctgaacaacgacaatttgtcaatcttggaagttaaaatggtgctccgtgcaaagtgccgctagttcagttcacactccaaacagttctgccggtgcttttccttgagactgccttggaacctcaatgtgcatttcccaagagtaaagacattcttctacctagcctcaatattatcacaacttaaaacatcaataattttatcaactattcagtccgtagtaagtttccccagttcccaaaaatgttcatttcttctcccaatgcagtgtcttgatgaaaattcatgctgttcatttggttatcagtctcttttaatctagaattattccctactattttgttttccacgacattgaccttttgtaagagtccaggccacttgtagtatgtcccatattctagatttgtctgtttcctcatggctcagttcaggttaaatgtcttttgcaagaatgctacataggagatgctgtacctaccgcaccacaccagaaggtacatcaggccaggttgtttcacaactggtcatgtgaattttgatcactaagttatttaaaatggtgattgcccgttcttttttttttttttttttttttttttgagacagagtcttgctctgtctcccaggctggagtgcggtggtgcgatctcggctcactgcaagctccgcctcctgggttcacgccattctcctgcctcagcctcctgagtagctgggactacaggcgcccaccaccacacccggctactttttttgtatttttagtagagacggggtttcaccatgttagccaggatggtcttgatctcctgacctcgtgatccgcccacctcggcctcccaaagtgctgggattacaggtgtgagccaccgtgcccggccttgcccg

SEQ ID NO: 35732 - DNA, 1032 bp, Homo sapiens
catatctcaaaataataagagctatttctgacaaacccacagccaatatcatactgaatgggcaaaaactggaagcgttccttttgaaaacctgcacaagacaaggattccctctctcaccactcctattcaacatagtattggaggttctggccagggaaatcaggcaagagaaagacatagagggtattcaaataggaaaagaggaagtcaaattgtctctgtttgcagatgacatgattgtatatttagaaaaccccattgtgtcagcccaaaatctccttaagctgataagcaacttcagcaaagtctcaggatacaaaatcaatgtgcaaaaatcacaagcattcctatacaccaataatagacagagagccaaatcatgagtgaactcccattcacaattgctatgaagagaatacaatacctaggaatacaacttataagggatgtgaaggaccccttcaaggagaactacaaaccactcttcaaggaaataagagagaacacacacacacacacacacacacacacacacacacacacacacaaagaaagaaataagagaggacacaaacaaatggtaaaacattccatttggataggaaaaaaacattcatggataggaagaatcaatattgtgaaaatggccatactgcccagagtaatttatagattcaatgctatccccatcaagctaccattgactttcttcacagaattagaaaaaaacgactttaaatttcatagggaaccaaaaaagagctcgtatagccaagacaatcctaagcaaaaagaacaaagctggaggcatcacactacctgacttcaaactatactacaaggctacagtaaccaaaacagcacggcactggtaccaaaacagagatatagaccaatggaacagaacataggccccagaaataatgccacaaatctacaaccatctgatcttcaacaaacctgacaaaaagaagtaatggggaaaggattccctatttaataaatggtgttgggaaaactggctagcca

SEQ ID NO: 35733 - DNA, 1029 bp, Homo sapiens
cgccgaagccgcgggaaaccctggactccatcccgggatttgtccccgtgtcgaagatggtatccaggtcgccgaaaacttcccggaagtttagaccaagacctacttattatctacggtgtccgggaaggtccatgattgttccacataaagtcagaagggaggaaaggcgcacgcgcattggggacttgactctggaaagcgtccagaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgccc

SEQ ID NO: 35734 - DNA, 1050 bp, Homo sapiens
ctatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttccca

SEQ ID NO: 35735 - DNA, 1046 bp, Homo sapiens
ctcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccag

SEQ ID NO: 35736 - DNA, 1493 bp, Homo sapiens
acccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttg

SEQ ID NO: 35737 - DNA, 1089 bp, Homo sapiens
acttttctgtttctctcacaggtcaacagtgaccttgagactcctgtatgtagctaattataattgttatttggaattgatatcatttttctattttgagaaaatgttcacgtttctctttttttctgagacaggatctcgctctgtcccttaggctggagtgcagtggtgcaatcttagctcaccgcagccttgacctcctgggctcaagcagtcctcccaccttagcctccctggagctggcactacaggtgtgtaccaccactcctggtgaatttttgtatttttgtagagacagggtttcatcatgttacccgggctggtctcaaactcctgagctcaagcaatccgcctgctgtggcctcccaaaagtgctgggattacaggtatgagccaccatgccctgcctgagccttttttattattattattttttttgcattggaaaaaaactatttaaaacataggcatagaaattatagccaataacggtatatttaccatccagaatttccttgggctacttttgatttttgaggaaagactcctaagtcttaagtgcagaagacttgtatagacttggacaattcacctcgaagaagagggtaaaaattgggagttccaggggaggccaatggcattgagcagcagcacgaaggtcagaaaaggtgcaggacccaggcccttggctgtgagaaccgtgtaacaaatgtttgtcaggctttgttggtgagctcacagattccatgctgaggctcttaatctgacaagaatgctcaagtaatttgaacatctcctcccatgaaagctgacatattggtgattgatcctttttcaaaaatgaaaggaattacttctgttgccgagacaggagaggcatacacagtggcctcttctcagccacccagaggatgtgggaacttgtgagacaggaggctcatggacaaccggctgcattttctttcttctctaggaaagacagccaagacaggggtggactcacgcgtataatcccagcactttgggaggctgaggcaggtggatcacttgaggtcaggagttcaagacgagcctggccaacatggtgaa

SEQ ID NO: 35738 - DNA, 1047 bp, Homo sapiens
atcctggccaggcgtggtggctcatgcctgtaatcccagcactttgggaggcacaggccggaggaacgtttgaggccagcagtgcaagaccagcctgggcaacacagagactctgtttctacaagaaatacaaaaattagttgggtgtggtgatgcacacctgtagtcccagctactcaggaggctgaggtgggaggatcacttgagcccaggagtttgaggctgcagagagctatgatggtgccactacactccagcctgggcaacagagaaagactctgtctcttaaaaaaaagaaaaaaaaaaaggaatggaatcatataatgtgtggtcttttctgtctgactttcacttaacaaaatgtgtttgagcttcatccatgcttcaccatggatcagcttgctattcctttttattgctgggtagtattccattatatggaattgccacagattatttacctagttgacaaacatttctgttttactttttccacaattacaaatgctacttctataaatattcggtctttgtgtggacatatgttttcatttctctcgtaggtgggaatagcattgctgagtcatgtggtaaatgtacatttaactttgtaagaaattgtcacactgcatttcacaatgactataccattttacattttcaccaataatgtttgaggattggatctctatgtttaaacttgatgggcccttttgggtttcaagataggtgaaacttaaggaatggactttggaggaagatgtgaaggggcttacccatacacggtcacttggggtcagttgctgggcactctgtgaggtggtttttctcttcagaggtgaacacggtggtgtgtttagacggtggtattgtaatgaacatcaaaagataagtaacacagaacaggacaagcattttagagatcatcttaaaaataacctcgatttaagggataattgcatggagtttcttagtcctagagtgatttttatattccagaggtagcttgttttgattaagccatgctttttaaattgaatggagtta

SEQ ID NO: 35739 - DNA, 1031 bp, Homo sapiens
catgttttacaccataaaagtatatacaatttttatttgtcaattaaaataaatattaataagaaggaaaaaattaaggttttggttaatttgaaaatgtcagaagcttctaggaagtatatcgtaagtggaaatatgttatttaccactcctcagctgttaactgaccaccttcccaacgcaaccctgctctgtctccttcccatgacccaagttgtaatccaatcaggagagaataccttatttggaaacctacatatgtcctttttttctctgcttaggtgttgaaaagtctcctctagagctttggaaggctgaatgcactaaacatgaagagcttgaaagcgaagttcaggaagagtgacgtgagtatgcggtgactcacagtctggctgttccttcttctccatggagctgcagaaacgctcctccccaccttgataaggcgctgttgggttaataaactacagacactcaagtgctcttggccccagctcagggtagcttctgtagatggcatgctctaggttccttgctgtttgtgtgcatagctttcaaaaacaatgtttttttatttttatttttaattttggggatctgtgccttgtagagaaaggaaccgtcacattaaacatcttcaaaggaagaatcagtaaaaacctcaacatttctaaagttgccagaaatcctgattcagaatgtcgtttttagaagaagctagtctctctcatgcgggtggtttaggaatgacatattagcatggttcatctttggctttaggaaacgtgttcaactctctgttaagggttttgtggtaaaatggtatctactgctgcccgtacctttcctccccccgaattccagggactcgtactcatttgttatctaaccaatccataaaagactctggattggaggaagcagttatgatgtcagagttatgaaataaagtctcccccaggagaagagggagaaaaacatagcagaggggttgtacacgataatatttttttaaaaggtcaccccataaa

SEQ ID NO: 35740 - DNA, 1073 bp, Homo sapiens
tttcattgtaatagggaagtagcggacattccattaaaaaaatcaaaacagccagtttaaagtgacagtctccatgagagattaaattgatggtatacctttacatagcatctactaactactgtagctttcagccaaggaaatgcacacaccccatgaatcttaaagaaccaggcatatcctgctcagacagaggtttgagtttcttgcctattaagataacagttggcggtggggtgtggtggctcacacctgtaatcctagcactttgggaggccaaggtgggtggatcacctgatgtcaggagttcgagaccagcctggccaacatggcaaaaccccatctctactaaaaatacaaaaattagccaggcatggtggtgcatgctcgtaatcccagctactcgggaggctgaggcaggagaatcgcttgaacccagggggtggaggttgcagtgagctgagatcacaccacttcacttcagcctgggcgacagagcgaaactccgtctgttaaaaaaaaaataataataaaagataacagctctcatgaggatcaacaaccaactctaccaacgtatttttttcaaggagtttttagtcatttataataagtttttacaattgctcactcctcctttcgtcaccacacatacatgcacatacacacaatgggagtatttaaaatccaagtctctggcgtgaacctgggaagcggagcttgcagtgagccgagatcacgccactgcactccagcctgggcgatagagcgagactccatctcaaaaaatataaaataaaataaaatccaagtctctctgtagacataggaactatggccaaatctattttaagctaagccttttttttttttaatagacataattttaaaaaaatcagcaatgaccccactgggtggaggtaggagactttactaaagttctagagagaaatttggtcaaatttgtgccgtgctacgtgttttctaggtcttttcagcctgatttaaatggagaatctgctcactgcctgattttgcctggtattagtttgctaggactgccataacaaagg

SEQ ID NO: 35741 - DNA, 1038 bp, Homo sapiens
ccgtgccattgcactcccagcctgggcaacaagagtgaaactccatttcaaaagaaaggaagaaaaaacaaaagcaaaaacaagaaaaacagaacaatttattgccccataaggctacctttgatgtatcagagtaaaagaaagcaggacaaaaatcagttatgctagaaaagagataacttagggaagttcacttaagggaaatacaacaaaatgctctttgtttttagtagaatattaaagtatgggtgtggatttttatcccccttcttacagtgtttggttatgtggttatgttttgtttctaaggccttaaaataaatagataaaaatgtatactatagtaaattgagaaaatatactcatatacatatatttaaattacatacttatcttcacctaaaataaagatactttgtctaacaaagtaatattagggatttattttatgttttaagtgaatgataaattatcttgcaatgatatacctcagatgaactcttctattaaacatctgtgtatttgtgcatctacttatttactttagaacgggcaagagaaaatggccttgggacttttgacctgtggaagttttgcattttccagcctggatatgtggaggctgtgggcaaagccatcttacttccacattgtttttctgtttcccagttcctgggcactcagctgcctaagtgcttctcttttgcaggaacaaaaagaaaaaaaggtaataagcatctcagaactcatctggggaaaaaaaaataaagaaatgaatagttaatttgctgctactgtgataaactttctttgtaaacattgtcatctcaacttctgttttgatagaggacagttgaaaacactgtgcttgcactggctggctgaagtttacacttattcaaagcaaggcagttgagaattaacccaaaaacgaatgacctgaccttccaggagtcctgatgcggccagggggccatgtgctcagggaggctttgcagggcagtcatcccaggagctcggtggagtggagggagaggt

SEQ ID NO: 35742 - DNA, 1597 bp, Homo sapiens
gggacatcagtgagttgactttctcttcaggaaaaagaaaatgagagcgagagaaagagagtgcactacaaaactcttattagcactgaaaccttggaatctttccaagtgacaagagtagggacattccaaatatcaataagcagcaaagggatcaaagtcattttgtgtaaatcttcaggctgcttatttgtgccattttgctacattgctgctgaagggccccagctgagttttataagcaaatctaaacatttcctattgtaatgaaatgtaaaacagcagattcctttatttgtggaacatatccataaaattgtttttatggctaagtttgttttcaaacaaactttgaaacaatgggtgccttggcaaaaaacgatggtgtgaccctcttcaataaatagtgtgggaaaattggatatccatatgtagaagaatgaaattggaccctcctctctccctatatacaaatatcaactcacaatggattcaagacttaaatgtaagacctgaaactgtaaaactaccagaataaaacataggggaaacacttcaaaacattggtctaggcaaagatttcattgctaagacctcaaaagcgtagacagctataacaaaaatagacaaatcggattatattaaactaaaaagttttggcacagcaaaggaaagaacaaagtgaagagacaacctgtcgaatgagagaaaaatatttgcaaactattcatcaaggaactaatatccggaatacacaaggaactcaaataacttgaccatcaaaaaataaataatcccattaaaaagtgggctaaggacatgaatagatatttctcaaaaaaagacatacaaatggccacagctatatgaaaaaaaatactcaacatcactaagcatcagggaaatgcaaatcaaaaccacaatgagatgttatcctaccccagttagaatgactattattacaaaggaaaaataacagattctggaaggatgcagagaaaagaaaactcatacactgttggtgggaatgtaaattggttaaactactgtgaaaaataaaatggagcttcctcaaaaaattagaactactgtacatccagcacttccacaactgggtgtttatccaaaggaacagaaattgtgaagtcctagctaaagcaatcagacaagagaaagaaacagcatccaaattggaaaggaaaaagccaagttattcttgtttgcagatgatatgattttatattggaaaaaaaccaaagactccaccacaaaactattagaactgataaacaagcctgggcgcagtggcccacatctgtaatcccagcagtttgggaggctgaggtgggcagatcatttgaggtcaggagtttgagaccagcctggccaacatggtgaaatcctgtgtctacttaaaaaaaaaaaaaatagccagacattgtggcacctcccatagcaggcactgtgcctgtcatcccagctacttgggaggctgaggaaggagaatctcttgaacccgagaggcagaggttgcagtgagccgagattgcaccattgccctctagccttggtgacagagtgagactctgcacaaaaa

SEQ ID NO: 35743 - DNA, 2044 bp, Homo sapiens
ctactaaaagtacaaaaattagctgggcatgatggtgcgcacctttaatcccagctacttaggcggctgaggcaggagaatcacttacacccaagaggcagagattgcagtgagccgagatcgcgccactgcactctagcttggcaacagggcgagactccgtctcaaaaaaaaaaaaagaaaagaaaaaaatacaaaaattagttgggcctggtggcaggcacctgtagtcccagctactcaggaggctgaggcaggagaattacttgaacccaggaggcagaggttgcagtgagccaagatcgggccactgcactccagcatgggcgacagagcgagtgtcttgtggtggggagcagggacaaagtttacttatatggaatctaaaaaagttgaacccatagaagcagagagtagaatgataattgggggagtggtgggaggtattggggagatgttggctagacggtacaacatttcatccagataaaaggaataagttcaagagatccatggtacaacatggtgactatagttaataacaatgcattggattctgaaaatcactcagggagcagattttaagtgttttcatcacaaaaaatgataagtgtgtgagattaattagctccatggccttttcacattatgtacgtatttgcagacatcatgatgtacatggtaaatacatacaacttttatttgtcaactaaaaaataaattaattttttcaaaaataaggtgtggaagttaccagcttctacctgttattctcctcattctttcctgaatgcagaatattgaggaaatgccaaaaattatatttcaggaacttctctatttataatgaaatattctagattggatcctgggacagaaaaaggccattattcgaaaaactggcgcaatttgaataaagttgtaatttagatagtagtaatttaccaattgacaaatgtataatggctacatctgttgtaaacattagaagaaataagtgaaggtttctatcttgcaacttttttataaatcttaaattgctccaaatacaaagtgctaaagtttttttaaaaagagacaaagataagaacttactagataagcagtcttcttacccaattaagtttatattaattccaatcaaagagacagaaacttgtgttattctctgttgtcttactgagaattgtatagttaatttttttcctgactataaaagtaatatgtatttattttacaaatgttagaaaatccattaggttttatccacctggttctgtagatttgtggttgcaaaacattttaaggaagtgggaggatatttccatttaatatctgtttaatatactgagaaattgtactcaagggggaaataaaatttataattgttaacatgaaatttcgatattttatatttacttactttcccttatttagaattattaaagatgtttttttttaacttggatacacattaatctgaaacagattctatcaacctatcatttccctcactttagactttactaataaactcttcagatgaatttctatgtaagacaaggcaactatactcttatagttagtacgataatatcttctgatatgactgtgcctcaaagaagcagtgcaatccgaagaatatcacaaattatgatttttcagaggtagagtataagactgtcatttctgaaaaaacaacaacaaaaaaaaacaagataaaaagtgacatttattcctacgttagcttagggaggagacaaaagtgatatctaggccaggctcggtggctcacagctcatgcctgtaatcccagcacttcgggaggccaaagcgggtggatcatgaggtcaggagatcgagaccgtcctggctaacacagtgaaaccccgtctctactaaaaatacaaaaaattagtcaggtgtggtggcgggcacctgtagtcccagctactgggaaggctgaggcaggagaatcgcttgaacctgggaggcagaggttgcagtgaaccaacattgtgccactgcactccagtctgggcga

SEQ ID NO: 35744 - DNA, 1075 bp, Homo sapiens
atttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaaga

SEQ ID NO: 35745 - DNA, 1029 bp, Homo sapiens
acttattcagccttcacaatgatgctaatttttgtttttcaggtatgataatcatagagaggccctacttaaaggtgggtttgatggcgaatatcaagatgacagcttagatttgctacgctatttcaccgttacctgttattctggttatggagatgatgaaaaggtaagataaatgaactcacccttgatttctcatcaagtacttcattaagactcacatacaaagagaattcttaaaactattctgtaatagaaagtgaagcagtgttcattttgaaaactgaagatgcattgccttcatgtttaagctgtcagtgtataaaaacctctagttgaaatctaaatgtattgcagggactgaactttgtcccaaaattcttcaacattaaaatttttcattttgtattttaaaatctttttctgtgatcaggctgcaaaagtattaagaatttgtttttgttactgttttttagggattttacacggtgtatcgtaatgtttttgaaatgattgccaaggaagaactagaatctgtgttagaggaagaggttgatgatttcccaacttttggagactcccagagtgactatgatacggtaaaataaaaatgcattgttctataattagtatttatcactgtgtcatttttaaattttattttactttttgagatggtctcactctgtcacccaggctgcagtgcagtggtatgatcatatctcacagcagcctcaaactcctgggcttaagcaatcctcctacctcagcctcctgagtagctgggaacacaagtgtgcgccacgacatctagctaatttgtcaattgttttgtagagatggggtcttgctaagtttcccaggctgatcttgaactcctggcctccctccttggcctcccaaaagattgggattacaggcatgagccacagctcccagcttctcatttccttgttttaaaacaattggttctagttctcgaacctatcccatgacctctctttgtctctcttcctttctgaagtagct

SEQ ID NO: 35746 - DNA, 1050 bp, Homo sapiens
tctaaagttttgttattaaaaagttactgtaaatgcattgtgtccagagcattatagcatacttttaaaaattattcacttcttaagaattctactcatcccaccctcatcttttgaaaattaacactttacctacatgacttaaaatcatctgaagacttttaataagttgctgagtttcatgtttcaaaacctgttatctactactggagcaattaaaattaaccatacaacaggtaacaggtttaagtgactttgccttggttttaactaagcacaggttttaagtttgtaagcgtggataggttgggagcaagctctctagtgggaatggattttaaacctaagtagtaagtgaaaaccatgcagaggcgtgcttgtcgctgtgagactgtgctgtatgtgtctagactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaatattatttttattttatttatcttttttgttttttaagtgaagctggaaatctccttgcttatttgacatctcccaatttttaaatgtggcaaataattaaaaataatgttgtatgggccaaaggtagtcggctgagctagtctaattcaagtaatttgattaacaaattcttttctgaccatgtcctaaacagtgtgtacttctagctgcataatatgacaaatggacatgtttacaagtgtgactatttttttttttttttgagacggagtctcgctctgtcgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgac

SEQ ID NO: 35747 - DNA, 1062 bp, Homo sapiens
tttagtcagttggtttttgtggactatactgatagtaattattcagttgtaataaagccaaaagcttattaaaaaaaagtttataatgttaaactttacatgtaatatgttaacttatggcctatccgtcttacagtgatggaatgttataaacttataaactaagtttattaagtatttaagagtaagtcacagttgtaaatgtgtttggaccaaatcttgctcaagaggtaaactaagaaaagaccttttttgaaaaactgcttcgtggtagaactatgaaagtgggatttaattttttaaacttagctgacatccaagactttaaagatgttttatatcttcttctaagtagacttaggaaaagaacttgaaagttaaggtgctttatttggagcctttccttatagtacagtgctgcttttaaaaagccaactcaaatccttaggattatttttttttaggtaaagaaataaaaaaatttaatttctaatttgttagcatattttagatttgtgctctgatcaaagagggttcttactgtaggcttccctgtcataggtaaagacagtgatgaggccgaggacgctgagctctatgatgacctttactgcccagcatgtgacaaatcgttcaagacagaaaaggcgtaagtttattaatttaatttaatttaattttgagacagggtctcactctgtcaccaaggcaggagtgcagtggcacagtcatgactcaccacagcctcgacctgttgaactcagatgatcctcccatgtcagcctcccaagtagctagggctacaggaacctgccatcatggccagctaaaaaactgcagttacttttgcaccaacctaaatattttctttggagatggggttttgccatgttgtccaggttggtcttgaactcctggattcaagtgttccacctgcctcagcctttcaaagtgctaggattgcaagcgtgagccactgcatccagttaaaaggagtaagtttagtatctctgaacttgtgttttctttttttttttttttttttttttggagacagagtct

SEQ ID NO: 35748 - DNA, 1357 bp, Homo sapiens
cgtcaactataatatttatagaacatattatcactatattaaaagcagtttttatacctggcagttgataagctaattactatccattgaactacagccttgtgttattctctaaaatgacaatgtgaatactttattttccttttaatgctttaagatattaaatatttttaatcttttacttctgttttactactttatcactagtgtttcaacttttttttttttccacttactcttcacagagtcaagtatttgacatttcgatttatatttgctcttaggctttctaaaaaacagaagaaaaagaaacagaaaccagcacaggtatgttagaaaggttttgttaacattaaatgccaacgataaagttgcagtgctcttatttattcagtgtagtctgtgttaaggagagaaacttatactccataattttatgttgattgtaagattgattaaaaaggaattagaaatattttccttttttagtgcttccccccccttgtatgtatgtaataacaaacttaattatgactgccagtgtgtttaacaagtatgcatgtagaattcccctggtatgaattagctgaattttcagtattttaaaaatctgaatacatctcacaaaaggcttttaagtcaagacaacaattaaaatcttgaaataggaaaatctgggattggtcatttttttatctcagtttattctgccaacaacataaacattgcaaaaggaacatttggttagaaacttgtaatgattgtgagtcttgaaaaaatgtttctatttttctgaagtttaagtaatttaaatatttcacagctgaagtccaaattcattctctgtcttaaggactatttttaaataaaatggtattatgttgttatacctataaaaataaagtgaatttgtccattttaccaaggacatttggatttatggcattttagtataatctagttatattaacttacattaagtattaaatatttttaagaaaacacattaatgctttttaataaaacttcagatttggtttatttatccaaatggttataataatatatttaatagtcttttttaaaatcagtttcctattcaaaaaatgatatatgacacatgagttaatcacttaaaattgtaatttggaactttttgcttcagttataaaaccgcatagcaaatatgtgttctttttataaattgacatctaccatcatccatccaaacaccttataattattagtttggaacactttctctttcctttgtgtatgtcagtaccattacagtaaggacaaaataaatggagagagatttatgtttaacctgagcctgtattaccttgattaatgg

SEQ ID NO: 35749 - DNA, 1056 bp, Homo sapiens
tattacttttcaatctaaagccttggtgataagaattacatgtgtcaagttctggagattaattgtgaagcataaactcttcctcttttttagtccatgaggtacatgctattgaaagtctcaggacccttaaagttaatcgtgttgattagtgggatttaacctccaagaacatctgcctttgttgaacgtgtttattacctgtccactctgttaaaacatctttattttacaattgtttgatgcttaatcttgatattaaaacctaaaacactactttcaagtgataacgcttacttttatttatgattttttgcccttctcagagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaat

SEQ ID NO: 35750 - DNA, 1054 bp, Homo sapiens
ggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtaattttaaactcactggcttgaaatgtgtgctttctgtacaatgaagttattgctttccatatatccttgaatcttcagattaacgaaatgaacaaattttcggttacagatcagctctcaaacactaaagtccttaatggcaaggtcttttctgatagcttcatggatagtattgatgatcagatttcttctgtgttattgtcttaaaaataagcatttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttg

SEQ ID NO: 35751 - DNA, 1001 bp, Homo sapiens
acacatgttctcattaagtgggtggagatagacatctatagagcaaaatttggtaataatataagccacttttttttgcatgtatttaatctttatcagaatcatctctgtctgactcattgttttggtgcttctcaaatattgccatgcttcctgtccctttcaccactatcaaacagcaggttccttcttcttcattcccatatggcctgatctttgaaatctcgtaggaagtttgttgcatatgccactcaatttgcattcctagggctaatattggtctgaaatttagccagtgatgaacttgagccacacctctacgctataaagggacttcttttcttaagcggaatctatactcatgattaggtgatgtgctcattgtgtgcagttctatacaggatcaagtactcagcatctttttttttaatggggtaaattctaaaaaaacaagactaagacttggacatgatggcatctaggaagtagaattccaggtgggaacagaggtggctcactgtttctcttgttacaagaattataaacacttgatttattttctcttatttcaaaaacaaaaaaatatttttaaaatttacagtagactatttcagacaaacaaaaggaataaagatttacatggtataatggatatcttccaacaaacttaaaaaatattattaatccactttccttatataattatacaaaatttatcttttaaaaaattgatggttatgtaggtcatttccaacttttttgctattacaatgttataataaagattatagtttattttcctttccacagatgtgaaaaatctctagcttacatctgtctattaaaaattacaacttcctgaaccttacacaccagtctagctactgcttttccttctcacttataggcagctcctttaatagactacaattgttgtctacattttcttatcattcattagcttttcagtcctctcatattaggtttgcacaatcaatact

SEQ ID NO: 35752 - DNA, 1048 bp, Homo sapiens
gccaccacttgaaccctagcacacacctaccctgaccttggcccatgaaaataccaatttcttctcattctttcacccatctctctaaccataggctctgtggtgataaacagttggtgtccaccagaaagaccatcttaaactactgaatactttgctacttggtgaatgctactttctgtagctccctggcctgcccctttcctgggacccctcaatttccacacagtttagcaaccatagttaagatgaagcacagcactgtctcccaggccctgcaccagtatccatgtctattggttagtgtccttgccatgtcagttattaaatgtcttaaagatcatccctgtacattacagctgcaaacatttacctgctccctattgcctttgccaacccaaccagaccctaggtctctatcagttagtttcagaaaccccaaaacaacagtgaatgaaattagagggaaatctgcttgtctctcatgtaatagaaatcagaaggtaagcagcccatagtgtatgctgtagctccagggttatcaaggactgaggcttctcctttcttttgcctcactgtcctgttgtgtggttttcatcctcaaggttacattcatgatacaagatggttgctgggactccggccacttggcccatgttccagatatcaggaaggaagacagacaaaaaagtagatatctcctatctgaaatagcttctttcaaaagccttcccagaagtcccatataacatttctgcttatatcttattggagagcattcagtcacatggccacacctgacagagtgggaagctgggaaacgtagtctttaactggacacactgtttccctgcataaaattggggttctattttgagagaaaagggagggaaatagtagtgtcaggtcccttcttcacagaagccttcacttggtcctgccaaagatttccagcagagggcatctgagatattgacaccctcacttacagcaggaggagaaggcctggggcagctgaagtccctgggccagttacctgtggctgtga

SEQ ID NO: 35753 - DNA, 1048 bp, Homo sapiens
tggcaattgttacattatcctgagcttgtgggattattctatgtattcatatgtaagagtttcatacttgttgaatagttatttagagattgcttctatgaaagaaaactgcgcttcctgcatccacctttctgttctaaacacagcagccagagtgatcctttttgaacttacgtgagggcctgtcattcctgtgctcagaatcttctagtggtgcctcatagaattcagcgtcaaagccaaaggctttatcatgacctaggaagcctgcatgacctggctgctctctgatttttctacccacctacctctgcgctctacactggcctccttgctatgcctcaaacacacatgctgttccttggatctagaacacgtacaccagatactcacagggctcactccctcactttgttcaagcctttgcttagtgatcgtcatctcagtatggccttccctgaccaccatgttcaaacttaataacatctgctctgaactctctgttctctcccttgccctgtttaatttttctgcacagcacagatcaattttactatatcatataatgtacttattttttgatgtgtgattatctgttccgcattactggaatgaagtcccacgaaggtagtgttttgggtctgatttactactccttcccaacacctaaaatgatacctggcaccatagtaggagctcagtaaatatttgttgaattaagaaatgacaatacccttttgtattgctcttttaggtaaactgtgccttttgtaaacctgaaagaaagcatattagtctgttctcatgttgttaataaagacatacccaagactgggtaattcataaaggaaagaggtttaattgactcacagttcagcctggctggggaggcctcaggaaacgtacaagcttggtggaaggggaagcaaacgtccttctccacatggcggcatcaagtgcagagcaaaggggtcggggaagccacttgtaaaaccataagatcttgtgggaactcacttatcaccagaacagcatcaaattacagggg

SEQ ID NO: 35754 - DNA, 1031 bp, Homo sapiens
cacttatttcaagcactattaaaaaagaaaattctagtacacctaagcatttaaaatgttccttcatgtgcttatatttcacattttctttttttaaattgaattaaactatggatattaaaaccctcttactgtgctattcagtacgtttttagaacatcccttttgttttagaaacaccatctataatccgttgtatttttcccttatttcacattagttcatacacacacatatgtacacatacatatacacgtgtatgttttaagcttcaaatatattataaggcacagctgaaccatgactgttgctattgaatatctatgacagccttatttcataataaaataatgctaactttcgttcctttagtaattttccatgttgctacagtaatcataattgcttgacaaaagtgtcaaatagatttaaaacttcttagaggatcctatttgcctagtaatataataattaattgatttgagcaatcattttttaaatttgtcaacttgaatgctggaatatgattctctggttctagatcacggcagtgctaatgttcacattgaaccatctaaattggaagtatatagaaagagaaagatggaagcttatccctggtgaaatcaagaaaaattctctagtgccttaaaaatatcatagctaattgtatagccaacttaaaaacaaaagttcttttagaatatgcttcaaggagatttagcagcagtgtcctacctgttagtaatgttgttgagggcttccagcatttagtgtgaccgactggccaaattaagtatctcctcttttataggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcaggtaaagatgaaaaatccctggaaaagactatttctaaatttcgaggtagaaacagatcaaagctttttttttt

SEQ ID NO: 35755 - DNA, 1034 bp, Homo sapiens
agacacagggagactgagtaagtcttttccagggtcacattgttagtaggtggctgaaccaacatgtgaacctagtgatacaatattccagaattcttactcttaatcactaagttttactaacacagggcatttggggatgtattagagaagatggcaaatttgagagatgtataatcaaaagaacctggtgattttacaagtagatgtttgcaagctaattctaattatgggtgaaatggatatatgtttattccattgtctttttaattcaaaaagtacattgattgatattcttgtgtatttgcttcatagtaagtcttttattacattatatcatttaatcttcttaataactctgccaagaagtttgataataccatttcacaaatgagtaaactgaggcaaattatcctgtttgatgtctgagagatagtgatatacattttaaactcactgactcaaagacctgtgagcttaactacactcgcctgctttcatctaaatgttgttgatgaatagtgtcttactggtctttttcttctgacgtttttctctttttccagtactctcgcaaaaaactcaaatttagtgcgacttaacctttctgggtgttctggattctctgaatttgccctgcagactttgctaagcagctgttccaggtatgaaagatgtgagacttgattatagactcttatgtcaaacgtaaaattatccctcacatctgtataaaatgggatgaactttttgagctttttgtactttccaggctcttgatttggtgaatgcaaaatcttttgccctcctaactttctgtccaaactcaggagccaagtcaattgagtttgcaagtgatacttgtatagtgatctcttttttgtttatttggaactgttaaaataagggaagtgtagtagtgtctatcaacagtatggttgtaagaaatttgctcacacttaactgtacattcaggttttttcccctatggtatctgtagacctaacttacaattttttatcaaatttggtgtt

SEQ ID NO: 35756 - DNA, 1776 bp, Homo sapiens
taagatgtataaagctatagaaaataattgctaggatctcatgagtgggtagaaattcgagtctttcacctgtgcaaggactcaaatttggactactgccattccaaacacttgcattttcagacaaggtgaacactttctttagcaagctgtaaaagcagcaatcatgtcttcatttcataccactctccccacccagtatttataattactattttaaaactgatcatagtgttatacagtcatttaaaaaaaatgtaaaatacagaaaaacacaaagggaagcaaattatcaataatcttaacatcttgctaggctttttcctgtacaaaaactgtttttttttttaatgggacatggtatattaaatacttcgtaatatgctttttaaccccattttcagtgactacatgatgtcatcatcagtggctatgtgatagtccatcaaatagatatgcaataatttatattaagtcaataacaatatatgcagttgatcagaattctaatggactttcagaatcttcccagtttttctctcctataaacaattttatgagtgacagagacaaatctttagatgcatttctaaggatagattcttaaaagtggaattgctgggtccagcattaagtactattctcaagttttggatagtttctgccaaattttcctccaagaagtttaaactcttcacccacgagcatcctcttagtgtgaaatcccatcactcttggttcttctctgtctgcaggtgaagggaaggcagtgccttgtttatatttctttcccacatctggatctttcactggtttactgaaagattttctgacatgaatcgaggctctgggtgcaaggttgagaaactgctgtaggcaaagtgctgttggttttgtccaaatttggcttaaaatctttccctttgttcctccaagaaagaacagagagcctgtttaccgagttttggcagaaatagtaggtattaaaatgctgcttgctagacacattcaggacagagagacagactgtaaattgaagtgttagttttttaattataccatggggataaaaagtttttaatgtcattaacaatagcacacaccatttcattatatatgagataatatggatttggttttagctcatagactggtaccagatggcctgggttcaaatatccactctgccatttactgggtagacttgagcaagttgctaaacttgcctgttccttagttttctcagcagtaaaatggagataagtagaacccatctcttagagttacaggaaagaataaatgagttaagacatgtacagcatgtggaacatttcttgccacatggtaagagttcaattagtgttggctgttaatactgttccttcccccactacccccatcactacctttccatggagcaatggatgaagcacagaaacatttggtcttggatttgaccttgacttctgtagctgaaatcatctctcctttgaagtaacgggttggattaacgggtggtttctaagatccttctagctcaggttgggtctactgtttatggtgaaatgaaggggacagtgaaaaggaaaccttggcagtgactactgtttactaactacttcctgcccagggaggacagagcttaagtgtgggccagaggaaactaaccctttatcccccaatgtttcgttctttctccagtggtgtcaaagtatgattgcatcagattttgctgatggctagttggctggctagatgattggtccctcaaaattt

SEQ ID NO: 35757 - DNA, 1865 bp, Homo sapiens
tttaatatttaatatattattaccctaaatacaaaaatattatttttgtatttagaacttattatgtggaatgtatttaaatatgttatttgagttggagaaatatttttttccagttgtagtggcaatatttctttttactgatccattatttctcttgttgatctgaggtgctacctttgtaatatattgtttgcttatatatactggtgtttaattttactttttgcttttgtgaatgggatttttttccctattatttttccagcctgctattgctgatacatagataagctaaagattgtcattttacacagttttctttttcggatgattctcttgggctttttgggtagaaaattttatgttccaagatgatcattttttctttctaatagtgtgtggttctaattgcattgccctgaacttccagcatgatgttcaatgatagtagtgataacaaatatccttgtcttgttcctcatttaatagtgaccatcatgtttttttgcttttcctagatctctctactttagttagaagatgccccaatcttgtccatctagacttaaggtatttttttatttgtttattttagatcaaaagttgaaaaatcttgatttctcattaaattgggaaaggatcataatgttgaagcaactaaacagtaggttatttctgtcttctttatctaggatcaatgtgtgattttcaatatcttttcttctgccttcttaacagtgatagtgtcatgctaaagaatgactgctttcaggaatttttccagctcaactacctccaacacctatcactcagtcggtgctatgatataatacctgaaactttactgtaagtatgttttgtttttaatgcttaatagaaggcaggaaacaacagagatgccccttggtgtgaaaatccatttttattaatagacatatgaaaccgaaacattagtaataagtataccacagactggctatgaaagaccagcagagtattgcttaaactggtgaaattgagttgatccagattgttcactaaacatttattgtttagctgtaagcagttttaattactagcttgctgtcttagtatctatgagaagacttagcagagaagcagaagataaccttttcctccaggaaacttgaagtgtaattgggaaggcagacccaatgtgggttagtgtctttttttttttttctttccaaatttttcggattaactccagttgattccaaaactttcatctgggcttaaagttctgtatcttctagtgatgtaagtcctggatagtgaagaaattggaaagatataagcctgtagatggtatgtattgtaagtctgatactgtttttgaacaggggcatgttaaggtctaaaaagtgaagtgaagtgacttattcaaacctgatggtgagttggtggctgacctggatctaaatcctaggtctcctggacagaggcaaaatagtcactatctaatctaatagtttatacaagggttagttttacctgctcagcaacttccacagaatcaagggagtgcaagaaagcagcagcctggtccatctttcctttgggaaacaccatacccaactcatcctgggaatcatatcttgtttgaaaaggttttctgcatttcattccaaagggctggaaaagtctccctaatggcaaatgtacatgtgtagcaattttattaaaaaccacaagaggtcagtatcttagagttgatcaggtgcccaacatgtcttgaatgcggctgctggactcatttatgtagctcatgaactaaaagttaatttagcttccagctcctaggtaggaagggtggtgaatttgaacaaagaactttagtc

SEQ ID NO: 35758 - DNA, 1055 bp, Homo sapiens
tgtccccttgtgaacaagcatatttatttcccttggataatgcttttattttataaattagccttcatcttgtactcagctaacgtatattaaacatttgtggggtttaagacaccttgtagaatgtagaataaatacatttaggggagtagtgggaagactggaagagcaggttaaacacggaaggtcttcagactagctgaacagcctgggttctgtaaacacaagggaagcatcaaaggttttggagcagatgaatgactaacatgagctaggctttaggaggatgccttggaaattggtatatagaataggctagaaggaagaaagacagttataaggaaagtttggggctttttaaaaataattattgacaatgtgaaaatataaaggatgtttctgactttaggtaattgatgtgctcattgatctgtagtaggattttgttgaaattccaaaataaatgttccctttcctgagactttgtactgtatgtcccaaccttgagcaaacagagatgagagagatgaatttctaggcacatagatctgagttaagaaggaaaaaatcattaccaacaccaaacagtatttactttggaaaaacagaatttgtgaaacagaatttgagaaacagaatttgtgaaacagaatttcactgttaacagggttgaatttcatctaatgtgaaatacctaaagggactggcttatctatgcagaaaaaaaatggtaatacgtagggaggtaagatggctattacctcctataaagggtgtgatttttcacccattgtctctacctgtacccaactgtataaccctatctaaaatatcttagggaagtcagtggtagttttcatcacacataatggacttgttgactatgaaccattattaagaagttcatcagtcctgacagcatctccctttaagagatgagcctagttcaaataaaggtcaagttcatatccttaatttgcatgtaacctgtggtggttccaactggtgccgcagtaaaacatttgcttttaccatcactcacttgctagtttctt

SEQ ID NO: 35759 - DNA, 1067 bp, Homo sapiens
ggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccat

SEQ ID NO: 35760 - DNA, 1006 bp, Homo sapiens
gttgtgtctctgcccggctttggtatcaggatgatgctggcctcacaaaatgagttaaggaggattccctctttttctattgattggaatagtttcagaaggaatggtaccagctcctccttgtacctctggtagaatttggctgtgaatctatctggtcctcgactttttttggttggtaggctattaattattgcctcagtttcagagcctgttattggtctattcagggattcaagttcttgctggtttagtcttgggaggatgtatgtgtcgaggaatttatccatttcttctagattttctagtttatttgcgtagaggtgtttatagtattctctgatggtagtttgtatttctgtgggattggtggtgatatcccctttatcattttttattgcgtttgattcttctctcttctttattactcttgctagcggtctatcaattttgttgatcttttcaaaaaaaccagctcctggattcattgattttttgaaggcttttttgtgtgtctgtctccttcaattctgctctgatcttagttatttcttcctttctggtagcttttgaatgtgtttgctcttgcttctctagttctttcaattgtgatgttagggtatcaattctagatctttcctgctttctcttgtgggcatttagtgctataaatttccctctacacactgctttaaatgtaccagagattctgatatgttgtgtctttgttctcattcgtttcaaagaacatctttatttctggcttcatttcgttatgtacccagtagtcattcaggagcaggttgttcaatttccatgtagttgagcagttttgagtgagtttcttaatcctgagttctagtttgatcacactgtggtctgagagacagtttgttataatttctgttcttttacatttgctgaggagtgctttacttctaactatgtggtcaatttttgggataagtgctatgtggtgctgagaagaatgtatattctgttgatt

SEQ ID NO: 35761 - DNA, 1031 bp, Homo sapiens
tggtgtacatactgcatttgatttaaattctctaaatcttaaatttagggtttcttcctttctttccttgtaatttatttattgaagaaactatgttatctgtcctgtgttctacattctggattttgcgtctatccctggagtaataggttaatctttcccctattcccataaactggtggttagatctagcaacaaaaagctctagaccaggggtgattttcccccacccaggagatacttggtaacatctgaagacatttttgatggtcacaagagaagtgctattggcatacaggcaatagaggctaaggatgctgctaaccatccgaaaacaggaaagccccctacaacaaagaattgtctggacaaaatgtcaatagtgtcagtgctccagaggcttgtatcatcaagttctttttttttttttttttagccaggagacacttgataagtaatatcctgttcttctattcagatacatacctgtctgtttcattttcactgctgtcactttacctgctcttgggctcttgattcctaatagaccctatccacaagctccagagacatgagggacactggccaagtgcaaaactttatttctggataaagcgcttgtgtcctatcctggtgaacccaattacacttcaacatttattgaccatccacaatgtgcaggatacaacagcccaggagaagatgcagagcctatgaggaaacaaaggcaagtagtctagagactgggcaaactagaaagaaacctcttgtcactgcataccctaaccatggaacaagcaagatgacaacctcctctttctttactattcctccccacctagccaaatatcccagaaaatcaaagttttcttcaccaagagactaacccttcaagatacaagtcaaagccctaaaagcctatactaatattatggataactcaaaacgtaactgctttgagttactatgttttagcaaatctaaatactaaaatgccggtatttttacatttctctaaataccagaatatc

SEQ ID NO: 35762 - DNA, 1056 bp, Homo sapiens
aatgtctcctttctcatccctgattttatttatttgaatcttctcactttttctcttagtctggctaaattttatcaattttctttgacttttcaaaaaaacaactttttgtttcattgatcttttatattgttttctatatttcatttgtttctgctctgaactttctttctttctttcactaattttgagtttgattgctcctgcgtttctagttcttcaaaatgcaccattagattgtttatttgaaatttttcttctcttttgatgttggcacttatagctgtaaacttccctcttagtactgcttttgctgtatcccgtatgttttggtatgttgtgtttccattatcatttgtttcatgaaaattttcaattttctttttaatttcttcattaacccactggttattcaggagcatattgttcaatttccattcatctgtatagtttccaaaattcctcttgttattgatttctagttttatttcattgtagtcagagaagatgtttcatataatttcaattttctggaatgttttaaggcttgttctgtgacctaacatatggtctgtccttgagaatgatccatgtgctaaggaaaagaatgtgtattttgtagttcttggatgaaattctctctaaatacttgttagatccatttggtctatagtgcagagtaaatccaatgtttctttgttgattttctgactgaagatctgtctaatgctgaaagtggggtgttgaagtctccagctattattgtattatagtctctctctctctctctttagctctaatgatatttgcttgatatacctgggtgctccagtgttgggtacatatataaagttgttatatcctcttgctgaattgacccctttatcattatatagtgactgtctttgtcttttcttaaagtttttctctgaaatctattttgtctgacgtaagtatagcaactcctgctcttttttagtttccatggacatgaatatctttttccatcccttttattttcattctgtgtgtggctttatagaggaaatatgtttc

SEQ ID NO: 35763 - DNA, 1042 bp, Homo sapiens
tataaatattttgatataaattcatctacaagcataagcatagaaccatttgtacaattttatgtcatttctactgtcatttctaagcaatgtcaaagtctgaatgtgccatgccatgacaaaagctcatgtaacaagagcggttagcaatccgagagaacacagtgccaagctccacatcccttagagggcccgtcatgaaagcattagataatggtctgccagggctgttgtggacatccgtctgacaaaaaccacactgggaagagtggttattgtctttcttcctccagaaagaaatttctccctttggactgtggtaagttgtgttagagtgacctcagacatctagctgaaagaaaggaaaagtctttgtcatgttcaagtcacagaacactgactctttccatggctagggaatgaattgcacaataaaaatgaaatctcaggccaaacaatataaagaaatgggtcataagatcagctgcaaggttgggggatatgtataaataggaatgcatagaattgagtggtagttttacctgaaggcattcacaaacacagtaaactagcagctttctctgatgttggtcttggcgcacgcgcacacacacacacacgcacacacacacacacagagtttgcatttgagttctcctttttctgatggtctccttgcacagttcacatttgagttctcctttctctgatattgatctctcacacacacacacatacacacacactcacagagtttacatttgagttctcctttatatggatttgaaagaaatcggtgaatcatcctggctaaatttttataaagcatttccctctgttctctaatactctggcaatgaatttaaattgcactaaaattcagtggagggaggatcacttgagccaggagttcaagatcaatctgggtaacatagtaagttctcatctctccaaaaacattttttaaaaaagtatccgggtgtagtggtacatgtctgtagtcccagctacttgggggggctgaagtgggaggaggatcact

SEQ ID NO: 35764 - DNA, 1048 bp, Homo sapiens
aacattgagtgatgtgtcaaaggcgcttagaaataagagactgccagaaataagtctatagaagctaggatcaccccgctcccaggccagccctggctgctttagttacagtcttaggggatgcaacctgtccacaaataattccccagaatactggtgctaacagtctgagcacagatgggtctcggctgggctctagagcagaacataaaatcaggaaactagagcaaactttactcttcatactgcacagagacatatcagttagtagaacagaggctctgaaagaacagaaaagggaatagatggaaatgggaacacctttgctgtgcaccagcatataacacacaaaaggcaccaggggaacttgggaaattttaaacatatttcattcccagtttctacttgttcataataatttcctttttccagaaaggaaggcaacaagtcctgcttttaattgctatttctggaatagaagatttttaaaaataacaatggattggacatttagaatacctgtaggattatttgtaaattaaattaccacttcacatagccttttttggtgcagtttttggaagaaagcaccaggcctttcttaaaactccaaggttcttctgatgcagttgtctctaagagtcacacaccgtgtgcacataagtccgtgtctccactctacttggtcatcagtcacccagggctctctcatttgggcacccctggtggaacaaggctggggcaggtatttcccaccttcaacaggaaataccaaaggacaaaagaatgagccaggccaaggcccaaatctcccaaggatgtggaaacagaggagtgggggagggttaagaggttgcctccaacactgagtagcttctcaccaggaaacgcctgaaagtttgacagaaacaaaagaccagggaccagcagaactcttacccaggtagattcaccattatggctttgctttctttgtaaaaataagccaatacagcctggcacagtgactcactgctgtaataccagcaactcagggggttaaggcagg

SEQ ID NO: 35765 - DNA, 1021 bp, Homo sapiens
gaaacaaaggcaggctccattgctttagagtggaaaggcaacctcaaatgcctccagtggccacgtgggtgatgcatgtacatgaagctgccctttcaggctattttttgttttcctattttgatagagtcatggatacagagaaatatttctcttcaacaagagaactaagagggacaagtatgatgataaacggagagggacccaactacagaataatatggcaaaaggcaggcaaagagactattgagacaagggccagatcttcctgtttttcaagagtatccagaaatctcaaattttttaagaacctgcagattctttgatacaattcacgaaacaaaccagtgcaaagcaaacgcagtacacccattccaatgtaattccaatggcaggcccattccaaccctcagactaccaatatttgaactcaggtttgaatgtcagaatccaatcattggcagtcctgtgccaaagcttaactgataatgtggaattcactactgaacatcatgtttactgctgactaaacaaattgctattggaaagcctcttctctccatcttctgggtataactgcattgtgtagtagccattctggtcttttctgcaccagaaggaacactggagtaagaactcagaggtcatgctcccataggaaatatttcccagtggggaaatactttatagacttgtttctcctaagttcagttgtcccagggtctgtagacagaaactgaaatgcataaaactattattgtgtttcttggactaagctttttattgtggaagattctagaaaacatgctataagtttaattgtactaaagccacatttaaattctgagacatctaagttatattttttacttgaaacatccgtgtttatgagttgtggctctatagcccttgtaagccatgttcccttttccctgaatttgaaactccaatctttccaaacatccctggtgtgtattagcattccagaggctgccagaaagaagctgggaggaagcctaat

SEQ ID NO: 35766 - DNA, 1034 bp, Homo sapiens
ctttatctggcacattctttgcattgcctagaggacagagtctgcattcttggcaggacaaataagagccttagcagccttcgcaagcccctctaccagctttattgcctgctgctctcctggcagaaaccctgtccctctctcaacgtcctaatgccctcagcacttcatccttagtatgcttccctcttccctagctccatcagaattctttacctacttcaaagtaaattgaaagcttagctttcaatctttccgtaaagttagccctattgatccctccctggagtacctgtcactgtcactcatacattaccagcacatgctgtcatgctccaaactaaactggagggttccactaggaccatgtttgatgtatttttgtggcatctggagcaaagttcatcctgcctgagaagtgtaccatttttaatggttttttgtttgtttgtttttgagatggagtctcgctctgtcgcccaggctggagtgcagtgacgcgacctcagctcactgcaacctctgcatcccgtgttcaagggattctcctgcctcaacctcctgagtagctgggactacaggggcccgccaccacgcccagctaatttttgtatttttagtagagacggggtttcaccatattggccaggctggtctcgaactcctgaccttgtgatccacccgtctcggcctcccaaagtgctgggattataggcatgagtcaccgcgcctggctagttatttttaatcacaaaagcaatgcattctctattagaaatgacacatacaaatattgatgagcataaagtaaaaagtgaaatgctactctgcaaaggtaacaaccgttaacagtgctagacctgttgctggagaagcagtgtgtggtagggaataagtgttcaggctagaaggactgagttggaagcccagcgtggccacttcccagctcagtgaccttcgatgggctactttatctctctctgcctcagtttctttatctacacgatggggataatagtagtatctacctcatt

SEQ ID NO: 35767 - DNA, 1049 bp, Homo sapiens
tcacagggtttacttagcctggaacagagctggacgcatgattgctcctcagtaatcagataaataagatgtgatttacatcagaagctgtaaatgactgagaacattggtgttgcagtaaagattatacttattctaccttaaagtactaaaatcctaatcttgattaaaggttaattctataattggtcagtgactttttaattttacctgccataataattgctagcaactactgggtaaaaaaaatatgctggttattaaacatatgtacttgttattccttctgaaaggtcattgttattattcccattttatagatcaagaaactaggtctcagagaggttgcataatgtctcagggtctccctgctagcaaggggctgagcttgaattcaaactcaaatctacgtgtcactaaagccccctctctctagagccatgtaacccctgatgtggtatgtggcctctagattagtactggatcagtttataattttaaagtgcatttgttcccttaagtcttttctccacatgagctaaatatttttcataatttttctgtactcgtgtacttagccctttacatcatgtgtggttgaacattctattatttggtgagactatgactgtctaattggtcagtgagaatctgacttgtctagcaacaaaagaactccttgagaagaggagctactatttgtacatttgcattgcagccctggttgcagtgatgaactcttgctatagtatgttacaaaattatgtcattgatttgtagattgagtatagttgcttaattattctcacctgctgaatttgcagaatttgtcattcatcattcattcaacaaagctatactgagttcctgcagtgttagtcactgggcatatagtaatcaatgtaaaccatcgtgtattactatacttcaagggctgtgacctggaaaatcactgatatgttattccagaatgaataaaagtgaagttgaacttaaggcatatactttaaaagaatggactttttaataatcattgtagcacaaccaga

SEQ ID NO: 35768 - DNA, 1023 bp, Homo sapiens
gcattctgccagctaggaagcgtgctatctcgatcatcttcccaagacagtcatgcgggaaggtcttttcgctaacaagaaacacaatccaaagtaaagacagcttttgtggaaattgcaaactactcatccagtggtcagttgtaaatcatgattcttttggaaagaaagggagacaggctggggctctggccctcaaagaacttcctctcattaaaccaaagcaatttgctgctctccccaggctctttctgtgcgtaaattcacctacttttcccgccaccatcagtggtcctggtgctgctggtgaatgggcatcatggggagacagggctttccacgtgatagaggtttctttccaaacccaggctttacaggtagatccaagggtggctttcgtcagcctgttgcccccactgcccaacacacactttgctttttgctgctattttctgcggtcctgggtttctaaatcttggcaagaggacagtcattcctttgtgctcggctgttacaatgaggtagccagagaaagggtcttggtctgaggctgtcagctgttactaatcacgactccccggcccatggtgggtcccgctcgcctctccctcttgctctgcttagcacacataaagaagatgaattactctctggttcctcttcaaaaaagcatattgtgcggcacattccaatacagtgagcgaaggatgggctcatgtgaagggtaaatgggtatccaaatcacctcgcagcggggctcgcgccggcagctgtgggcctctgagaagtgaatttcggagctgccccttctgagagtttccggcgacctcgctgagagtgagaggaagtccctgcggtgggccctctggcaaaccacatactgggaagatcgcgggactgtgttaagctgtcatgagagtcaattgaatggtcaagaccagcgtagacagaaataaagcttgaccactcagaggccgccatgggctgcttacccgggagaggcagtctccaccccaaaggtta

SEQ ID NO: 35769 - DNA, 1891 bp, Homo sapiens
taacataaatagcatttttttgcaaaaaacaaccatttcgaccccaaaatttattttatttatttacttgttttgagatggagttccattcctgttgcccaggctagagtgcaatggcacagtcttggctcactgcaacctccgcctcctgggttcaagtgattctcctgcctcagcctcctgagtagctgggattagaggcgcccgccaccacgcctggctaatttttgtatttttagtagagacgggtttcaccatgttggccaggctggtctcgaactcctgacctcaggtgaaccacctgccttggcctcccaaagtgctgagattacaggtgtgagccacggtgcccggcctcgaccccaatatttagtgaaaagaatggtactattttatgttttgcaagttttcttaatgtctggcttaatacaagacagttggagtttcctgtttctgcagtttcacaactgcttcagtgagttgtgacatcacacatcatgtagtctttgcaaaactccactatacattcatgagaaaatgagactgagagggacaaatgacatcttagtattattatgagaatggcttaaagagaaggctcgttccccactgttgggactctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcctaacgtaagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaag

SEQ ID NO: 35770 - DNA, 2176 bp, Homo sapiens
aaaaacagtctacttgagattctttttagggatgtaaagtgaaagtttttactatggcagtaaacttggttcttcatagtaatcattattaaatttcaaaaatatgagcaagctataccaatacaaaattttctttacttgcagccgaaaaatgtattttctaaggcttcttcaactaatttcatatttaattttttggtaccaatccatcatcaaactgtcatagaaatatttgaacatatctgtgttacatgtttgaaataccccattgtggtatttttactttctcaaaataagatgtagtaattaataatataagagtaaataaaaaccaggagtttgagttttatttaatttcatttaatcctcctttctggtgcttattaggaaaagcataatttggaagaaattctaaaattttaaattaagatttcagttttatgtgaagtgattagggagtgtgaggtaaacagtaattccttttagagaaatgtaactttaattctgtttatcacatttacttgccataaaaatgaatgggaaataattgactaggaacctttatagaaggctgacaactaactgttcagttgaacatgcttattttaatatcctgagcgtactaggttaggtttggtggtaatttatggtcttatatagcctttaaaaattgttttaagatggactttttaagcaaagtttttcgttttttcagcagttgtcatttataataattcttcgtattttaaaactagtcctttttcaaggtgacctgagttcatttaaaaatattctgatatccctgtgagagaagtgaccagctttccgtttaatgatgaaatacttgacacttaagagaccatatgatttgtgtagattcatgtagtaagtcagccggaggataagggattccctgacactagtattttcttagattatgttgctttaagaaatgtgtgagctctggtcttgaagctaggtattgctcagtgctgacactgacaccatttgttactttttcaattatctaagttcaaagtgcatttttcttgtctttgagagagaggatacctgtttcttggttgtattttcctggtatgaaaatagagtgggattttagtgtttctggttgatttaaaaggaattttaaactccatgtctcttaaggccatcattgtaattttaaagggtattttatgtgcttagaatattttgcccaaataaattaagtaataaaagtaattttaggtatttgtcttgtgtgtaattttttttttttggtgtaaatctggagtcagttttgttgaattgagttttgtcaagttgcattatgttttaaggcatatttttttctattcccaaagttatatcattaggagagatcattgcttgatgtagcattgccagctaagattttgaggacttatttgccaggagttaagtctgtccccataatatctcatttaatcttttaacatgcccaaaagtagaaacaataattatctacaatgtacagatgaggaacctgaggctggaaaggtttagaaaactgcccatggtcctacaattagtaaatgatcagtctgatttacatttgttcttatggattcaggattctatgtatctagtttcaatgaaattttaatattatcttttgggtgttagttgatgtgatacttgcccagtcacttagtcaagaaaattgtgtacttcaggcaaagaagctgaaatagaattcaggctatatattctgtatttataatacttttaaaaatcaataactctttaccatcttgtgtttaaaacaatttttgttaagcagtctgtgaagcttttagttctttgaagtattttatattgagttgaagatgtttgtcaaagcatctgttgttagaaagacaaagttcagctttagagagtcatttcattcatagaaatgtatatgaccaattgtaggatagtagctagatctataaattagtatgactgatcattttgtaaagtttcagtatttttatagccagagaatgttgatcattatagtcatcaacttgggaggttgtgcgcttattccagaactgttgccagtacatacaaccttataggaattccttttgtgaatacctttaacacatttgaaatagtctttttctcatctttatgacaaatctttatt

SEQ ID NO: 35771 - DNA, 1031 bp, Homo sapiens
cataaaaatatttatgatgaatgtaattatggttaaatacatatattaatgctataaatttattcctcttttaacgttggatcataaagattttcctagttttctatataatgttcataattctttaaaatgttgcccagtattttgtcagtggatgaaccataatttattcattctattcttgcatactttttgcttttactttttttctatataaataatgaggcagtgaacatctttatatgtagttttttccccctttaggggctttattcgcttagagtagaatctcttaagtggaagtaatcctgtaagtggaagttgggtcaaaaggtttgaacatttttatggcctttaatatatatttccaaaactaattttattctgctataatctttattttcattcacatcttaattcattcagtagattcattgtgtttttcatatagaatacacacttcctatgaatattattaggtcatttaaatgctcccgtttcccactattgtgcctgtggtctctttttactatatatttttaacctcttgatgataaacagttgtggcttttcaaacggtgtatatcatttcgaggtattatatagtaaaattagcatgggatctaaactgctattagccaagtggcatttaggccaattcttaacccaagcccatgtcttcaactgtaaactgaagaggttctcagcttttgagatttcatggactagtcagaacaaagcaagaaagtgcttttctgcagaaataaagtggtaaggatattgtagattggaatgtaaaaagaaaagtaatgtctaggtaagacccattacttagtcttaatatttgaaatgtgaaatacccagtgtgatgtgaacatggtcatgatctcatattcattctcttgtacatcaaacactgagtgattcctatgtcttttctcaggagctattaaggcattgcagatggtgaaataaaagacttcaggccgggcacggtggctcacgcttgtaatcccagcactttgggaggc

SEQ ID NO: 35772 - DNA, 1856 bp, Homo sapiens
ccctgttgtctccagtcagtccttggcaaccattaatttaccttctgttgctgtggatttctgtattcatataagtggaatcaaataatgtgcccttttgtgtctggcttcttttaattgctcatctatattgcagcatggatcagtacttcatttctttttaggactgaatatactccattgtatggatataccacattttacttttgctttgtcgcttgatggacgcatggattgttttcaacttttgactattatgaataatgctgttataagcattcatttgtaagtttctgtgtggatatgtttttacttctcctgagtaggtacaaaggggcaaaatttttaggtcatgtggtaactatgtttaactctgaggaactgtcagactgttttccaaagaggtgcatgattttacatttgtagtagcaatgtatgaaggttagactgtctttacatcctcaccaacacttgttattgtctgtctgattgtattggtcctagagggtgtgaagtggtatctctgtgtggctttgatttgcattttcctaatgactgatgatattaaacacctttttatgtgcttattggtcatttgtgtatcttctttggagcaacattcatccaaatcttttgcccatttttaaattgggttatctgcctttttattgttgaattataagttgttagacatattctagatacaagttccttatcagatacgtgatttgcaatatttgctcccattctgtggattgtcttttcactttcttgatagtgtcctttgaagcacatacatttttaattttaaagatctctattgttttcctttggttgcttatgctttgggtgtcataagaaactattgcctaatccaaggacaggaaaagttacacccgtgtttagttttagcacttacatttaatactctgatccattttgagttaatctttttcataaggtatgaggtagggatccaacttcattattatgtacgtgtttatccaattttccattaccatttgttgaaaagactattctttcccattgaatggtcttggcatccctgtcaaaaatcagttgaatgtaaatttaagagtttatttttggctctcaattttattccatcagtccatatgtctgtccttacgccagtactacactgtcttgattactgtggctttgtagtaaggtttgaaagtgaaatgtgtgagtcctccaactttgttctttttcaagattgttttgactcttctggatctctcattttcatatgaagtttaggatgtttgtcattttctgcaaaataggcagctgcaattttgataggggtcgtattaaatctgtagatgagtttggggagtattgcctttacaataatattaaatcttaacaatccaagggcatgggaagacgttccatttttttaaagccctaatttcctttagtgttttgtttgtttgttttgagacaaactctcgctatatggcccaggctggagagcagtggcatgatcttggctcactgtaaagtccgcctccctggttcaagtgattattgttccttagcctccgagtagctgggattacagtcctttgccaccatgcctggctaatttttgtatttttaagagaaggtgcggtttcgccatgttggccaggcttgtctcgaactcctggcctcaagtgatctgcctgccttagcctcccaaagtgctgggattacaggcttgacccaccacacctggccagtgttttgtagatttaaatgtacaaatattgcatttcttttgttaaatttgttcctgtgcattgtgttctttttaatgctattgtaaatggaatagacttttatat

SEQ ID NO: 35773 - DNA, 1048 bp, Homo sapiens
cagactaggggtacttaatgcctgagttgataatcacattattacttcttacactttgtttatagaatctagaaggagttaaacagaaaagtatttttctgttccttccttatgatttagaaaatagaaaaagtcttcgctaaagcctttaatagccttattcttagtgatgatgatgattatattaatagcaatgatggccagtatttgtcatgagctcactgttttgaatatttgactggcattatttaatcttcactacagttcttgaggtataatcagcccttcatatttgagagtcacacatttgcagattcagccaagcacagattggaaatattcaggaaaagaaaccaataaaaaaaatacaaaaacatttaaagtgcagtataaaaactatgtagcatttacattgtatttggtattataagtattctattaatgatgtaaagtatacaggaaggtgtgcattttatatgcaaatactacaccattttaaattagagactttagcgtccatgaatttcatatctacagggatcctggaaccagtcccctcagggccaaaggggactgtctagctataatatctccactttccaaattaggaaactgatgcttacaaagaatgtgacttgctcaagagatgagagaaggaagtcccatgagcaattcagtcaacataattacaatgaatgtatgctctccttaagtttagttagactcctgacctccttgaggtcagggacttaatatgtttatttctttaattctagtaccaagcacagcacccagcatatggcatatgctcgggttttttttgttttgttttgttttgtttttttaataaagaaatgaagttgcgagaggctgattcattagctttagctgtaagtcttctggagggaatccataccaatttcatttacattgcatgattttttttcctttgccttggaataccgcttggcaggggacctagtaagttcctgttcattcttcaagttccagcgtaattccatcttttctttgatgccttccttgtctc

SEQ ID NO: 35774 - DNA, 1030 bp, Homo sapiens
ccacttgaaccttgttgactgtttttctagacttcttaaaactgaaaccaaatagcataccctaattatctagttgagtatttcccagccatatgttgggtgagagctgttggcattttggacaagacacttcttgtgctggactgccctgtgattttgtgtcccactcattactaccagttgcaaccctcaggaattgagtactagaaacaccctcacagttttcatggggttggtgagcaagtaccttctgttgagaattggtctagtcctttgaagaatgctaggtagctctttctaaaataggttaatttcatgtcatagtgtttaggtaaaagcttcacattggacatgaataaaaaggattagagttcagtgtattcaggaaactaatataagatctttgaatcttcttattttgttccaagattgatgaaattcaggagaggacttgctacagtgtttttggagggtaattttgcactactgtttgaatcaaaattttaaattacgcatttgtcattaactccacttctaggaatctagcctgtaggaatcttggagggcataaaaaattatttgccaggatgttcatttgcagtattattggtaatcacaaaaatagtaaaaactaaaaaaaagaacgaaataaccaacaacaatataaccccacctacctgaatgagtattataaatagagaaaaggttaaatgggcatatagtacatgctatacgtttattatttaaaaggaaccaggactctatatcctgaataaatttttaacaatgtattattaaaggaaaaaaagaacagtatgggccatgcacagtggctcacaccagtgatcccagcactttgggaggccaaggtgggcagatcacaaggtcaagagatcgagactatcctggccaacgtggtgaaaccccgcctttactcaaaatacaaaaattagttgggcatggtggtgcacacctgtagtcccagctactcgggaggctgaggcaggagaatcacttgaacctgggaggc

SEQ ID NO: 35775 - DNA, 1040 bp, Homo sapiens
aggatatgtctatttggtttaccactgtatcctcaacaactgctggttgtccctattgtaggtgttaggtattaagtgcatgatagtgaatacataaaggtttacttttttaaaaaaattcaggaaaccagataatcaaaaagaaagaaattaatcacttaataagtttcatctcccagggataagaaaacataggtaaagagagattaaactactccttcaagttcaggcaattcagtattctaattgaaagtgttgtgtttcctttttaagtctagttttgcttttgtgtttatatgtcataattaattgtgttaaaacataattttagaaaccgatctttctatatccctcttttctataccccccaattttacttcactttcttaaacaacaataaaagtctcctgtaacataagaaagcttttcttcctaattatcttctttaggtactttaaaaaaaatcaatcagctatcacatgttatggacaaggggaatcactattgagttaatatcctaagacgttcaaaacccagaaccaaaaaaaaaaaaaaaaccaccaaaaatgctgtttggagagtttcaggtttaattaaagagtttgttcaggtgtttttgctgtttggaatcattatctgagaaattatgctataacacatggtcatttgattctgtttccattagccttctactctgggatatatggctactacattttctttttaataatctgtgtttcacagtaagtttacttttgtggaactctattattaaataaatcagaaatctcacttaaaatttaaaaaattatttttctaatgaaaaattgatattacagaactaaatttttaaaagtttatgtacagaaaggatatagtatttgatgttatcaaaacttacatgttatgattagttcattgaccatgagtatattaatttagaaaaaaatacatccctaatttacatcatccttaatttgtatacttgtcatgtagtgcaggggtccagtggaaatcatagaaaggttgctgtaggtaat

SEQ ID NO: 35776 - DNA, 1034 bp, Homo sapiens
tgcactccagcctgggggacaagagtgagacttcgtctcaaaaaaaaaaaaaaaaaattcatattgttggccataccagtgtgatttacttttatatgataagtcttcttaagaatcagtcaccattttaatttttgatacttattttctcaatgccagagagttgaaagataaccttggcagtgatgacccagaaggtgacataccagtcttgttgcaggccgtcctggcaaggagtcctaatgttttcagggagaaaagcatgcagaacagatatgtacaaagtggtgagtttcttaataactgaattcccatatcaaacttgttttatacatatttaaatccaggtgtcttctttaacaagctggcctatcaggaatgcgatgtttatgccttcagtcaagccaagaacaagaaggaaactaaactgataagattcttgtagtttaatatgtaactaaattccttgagaattagacaaagctttaagtgtattttgttaaatatgttggaatatatcagtttactcagcttaaaaatttttttgttttagaaaatcagaattaatttgaaataagtctttcattaattaaataaatatttgcaaagcttttgaacatgtacattgtagcaggtatatagagttttaatactgattgtgattatattcatggttttctagtaattgatttaatactcctgttgccttagcaacagaaaaattggttaagtattattattaaagaaaaattgattcatggtattataaaataataaaaatattacatccaacacagatataatttttatgtagtcatggagtacctttgggttaagagcattgttctgttcaagcttactgaatttgacaagcccaagtgcctgtttggctctcaagattaaaatagggcaggaatagcttggacaacttcagaaagttcaactttgttaattaaataattgtatttaagaattttatcagccgggcatggtgactcacgcctgtaatcccagcacttttggaagctgaggca

SEQ ID NO: 35777 - DNA, 1092 bp, Homo sapiens
gtaaatatacaatttcccattaatcttttacttaaagggggtagcattcagtgaatctcattttatcagtttttacaaagtcattggaaaaacgatgattttttaaaattttatcattctaaagattacattttaaaatcagcatataagaatggattgtttaataaatgatgttggtgattgtctaggtattttgcaattttagctggattcctggatcactgaaagcaaaagtgttctagattaataagctgtttgtattttttaagtcataaaattataagaaaaacgtgggcgaatttttggtattctaagagttgagaaggcattatttctaagcagaccgaaaacctcgattgtagaaatgagaaaaaaagattaattataaatttgtatataagagaacataaatatataaattacataaatataaaacaaatatgggggatatatgcaacatttattataaacacaaagtattgatttaatataccgaaatctcatacagatcgataagaacaagacaaaaatgaactaaagaagtaaacaggcaatttactggaaaagaatagccaagtcgatacagaaagatttaataaatatatgaaattgtggtcaccttagctcatagagatgcattcaaaattaagatgaaataaaattttatatcagattgataaacatttcagtcttcatagtgatataaattggtgcaacttttttagagaaccgtgtgtttgacagtatctatcatataatttaaaattcatatacctcactcagtagtccaaaatctacctcccttaaaagaaggggaaagggataaaaacatactcagactgttctaacaagttctaccaaacattaaatgaagagatatgctaatcttaatccattccagaaaaaagaaaaacagcaacactttcttaactctttttataaagttaaattacaatctggataccaaaatcaggtgaagtgaggggagtatgagaaaggaaaattataaatcagtcatcacatatgaacattcatgtcctgttcccgaattgaaacaaaatgtttctaattttttctaccactaggtaagat

SEQ ID NO: 35778 - DNA, 1039 bp, Homo sapiens
gaagccaggagtttgagagcagcctgggcaacatagcaagaccccatctctaccaaaaaaagaaaaagccagatgtggtggcagtttcctgtagtcctagctactcagaaggctaaggcaagaggatcacttgaacccaggagtttgaggttacagtgagctatgatcatgccagtgaactccagtctaggtaacagagctgtctgtaaaaaaaataaataaataaaagaatttaaaactatatatatatatatatataaaatctcagtataatattaaatggaaaaacaagttatataaggatagatacatatatcatctatataaaattataatgtaaaaacaacacaatgaattacttaggaatatattcatgcatagcaaaggtataaagataacacataggcagaataaactcagatcaaaatagtggttacctctagggagtaaaaggaaaggaatagaggagagaaataacagataaatggagatcttcaactatatttgtaatgttttagttcttttcaaaaatagattggaatctggcagagtgttaagatttgatgaaactagtcagtacatgagtatctgttatattattctctgtaatttctatatgcttaaaatatttgtgaataattactattctccaagaatgttaagaatcttttattaaacctttttttattcttattaatttcagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgtatgtaatatattatcattaaggtgataaaatagttctaatatttgtcatataacctagtatttccatttcaaaatttgaatgatacctaccgtatatcattatactgggtactgagtacaacatggctcctgcacatacagagcttagtctagagcaggattggtcaagtgtg

SEQ ID NO: 35779 - DNA, 1035 bp, Homo sapiens
tatgatgtgttcagtgtttgacaggatcatgacaagataattgtgtttctatgctaagaaacatgctgaagattagtattatatttcctgtctgtcatgatggctcattttaatgttattgaaaaaaaatggactgtatttagtaattgttgtactacaatgtttgcaacatatgtaaatcagaaatagatgcaaataaagagattgctagaagtcttcattttactggctagggagctgggtttttttttctttgtctttttttttttttaatatagattcaggggatatatgtacaggggtttgttacgtgggtatattgtgtggtggtgagatttgggcttgtagtgaacccgtcacccaaatagtgatcatagtacccattagatagtttttcaaccttggcttcgtccctttttccccctttttgagtcccctgtgtctgttgtttctaactttatgtccgtgtgtacccattgttgaattcccacttataagtgagaacctgtagtgtttcattttctgtttctgcattatttcacttagggtagataatggcctcaaactgcatccatgttgctgcagaggacatgatttcattcttctttatgattgtgtaccacggtgtatatataccacattttgtttatccagtccactcctgatggacgcttaggttgattctgtaactttgctattgtaaatagtgctgtgataaacatatgagtgcaggtgtcttttttataaagtaatttttttccctatggatagaaacccagtagtgggattactaggtcaaatggtagttctattttttgttctttgagaaatctccatactgtttttcataagggttgaactaatttacattcccaccaacagtgtgtaagtgttcccttttctctgcagcctctgttattttttgactttttagtaatagccattctgactggtgtaagattgtatctcattgtggtttaatttgcatttctctgatgattaatgatattgagcattttttaaaatgtttgttgg

SEQ ID NO: 35780 - DNA, 1061 bp, Homo sapiens
aaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcat

SEQ ID NO: 35781 - DNA, 1061 bp, Homo sapiens
ggctaatttttgtatttttagtagagacggggtttcactgtgttagccaggatggtctcgatctcctgacctcgtgatccacccacctcggcctcccaaagtgctgggattacaggtgtgagccactacgcctggcccctttatttcttatctttgtaatcaagcaacctggcggagtccatttataaagagcttcatgaaatggaagaaaggatgtggttaattcagaaaatgtgtgaaacctgtggaatagacaattctgttcaaaatgaaacagcgttcacttttggaggatgatacatgtagagacattgattcctggattttttttctttaaagttggagcaccttcagaaataaaacatttggcctttgaattacattgtttaaactttcaaagttttacagaagttaaaatgatctagaggatactagagaggtcttaattgatagtattcttgttaatgtagggaataagaaagggtaaactactgttgataaatgttgatacctgctttattggatataaggcataggttatctgtgtttggctattgtgagtaatttttttaaaaagaaggagcagagtccttgctctgggaacataatccattgcagagagagcacaagaactagtacatattttaacctttgattattgtgttaattaacaaggaaaatattaattctgggatattagtgttgagtcagtgtgtctgtgatgtgaacttaatctaagcaaaacacttaggtacatttgctttaaaaaaaaaaatcccgtgatggatgaaaggccaaatactttgggttatctgtatttataaacctatgaagattataatgtttccaatatactgcaaaaaaaaaaatttgtattcttagaaattttggaaatgtactcatttgtctatcaaatacagcaactcaggaactatccaggaagtacatctgtaagtggacatgagaaattgtgaaccagagttaggcaatcaagaagcatctattgactatccatatatatgtactcaatattatgtaggtcatgtggaaaagggaagatg

SEQ ID NO: 35782 - DNA, 1026 bp, Homo sapiens
ctatcaggaagatagtcccagtttatttcttcataagaactatttgtgtatgtgtttgtgtgtatgtgtgtaggattaagtagtataatggctcttattgtcttgtcttcttttttattgccttgactcttgtgggaagatatgaacttgaatttctaacttgaaatgtacttttcagttacagacatttatattttaaaagatttgtcatctatttatcctgtgttacatgtttctctcgtcttcagttaaattgtatatattgatttgtctgtttgaagaagttctccgtaatgctaaaggcattaccatgccctcaaatagacagtaataggtaaaagcatatgtatagctcttgtctcagccaccatacacaactgccaagatcatagagaaggaggaggagtggtaagtgtcttccaacacttctcacttgtattgaggggtaacattagattcaaactacttcagacctacacaaaacaaaatttatgtactaccaagaatgtcaagtgtacctcttaccacaaatccacttgctaatgtcagtgaatctctagtttcagaaagtttttagtcagtgcaaattgaaggcattatatcaaaaatgtattatataattacccttcatttttatggtggtgtcatgtttttaaagtcattacataattatatgtatatatgtacacatacatatatattaactatattgtcactttagggttaagagtattatagttgtgttttattaaaataaacagttgatttagaaaacaaatactaatatttttattatgctaacttagttaaaattttccttttatcttcagatttacattttttttttaaatttacctttcattaataggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagat

SEQ ID NO: 35783 - DNA, 1033 bp, Homo sapiens
gttaagcttgacattttgaactattttatttacctaaactttgtttgtgtttgtttggcttgattttgcaggtgatgatgatgaaattcctcaggaactgctcttaggaaaacatcagcttaatgaacttggcagtgaatctgctaaaataaaagcaatgggtataatggataaggtatctcaccaaagtaaaatttataaatttacttcatagaaacatttgaaattaatttaaggttttcagggtaaattataaaatttatgtaaagtaaatagtaaaaagaaaactcattgttgacttctgagagtctaaatgagtttttttgtttttttacaaaagaaaaaagtattctgcagattattctaaagagaatcatattactgcattgaaagaggcatggactttaattttttccagagtttttttttttcattttctcaaatatttagattatttaaatgcagaaatatattaaatttttctttgacatttgctttagtcatttagggtcgttgagtagaagttctaagtgggaaagttttcttactctttaagagggtgacaatgctatttcctccatagctcaaagggaataattgtacagattgtttcttgaataatatataacttttaccaacgattgataaagaatttatattgctattttagctttcaactgacaaaactgtgaaagtcttaaatatcttggagaagaatattcaggatgggtcaaagctttccactttgttaaatcatgtaagtttaagatccatactgttaattttacccttaatgttattaagatctatagtagtcccccacttctctattgtttcattttccattttctcagttacctacagtcaactgtgatctgaaagtaggtgaataatttttattacagtctattgttctgttttttattgtcattaatctcttcccatgcctaatttataaattaagttttatcttaggtatgtatgtataggaaaaaacatagtgtatatcgggtttgatagtatccatggcatg

SEQ ID NO: 35784 - DNA, 1832 bp, Homo sapiens
aggatgtaattgaaagagttatacagtacactaaatttcatttgcagaatacactttatcctcagtatgatcctgtttacagattagatcctcatggaggttagttcgtataatatcaaaattattgtaaatttttgccatgttagatgagtcaaaataggacttaaaatggcaccaaaatttttgaatcatataacttgtaataaacactgattttgattatggatttgactagaatatagtacttgttcaattataatttctttaggaacatttatatataatagaagttatttctacttgtcagggaaaatctcagaaaatactaccttctggtttcatttatcacttcgccctaattttacccaaaatagcagttgtctacaaaatggattgattcaagataaatactccttttcttgttcttaacctttataaatgagcaatgaaatgtatacatttgaagggagtaaggtcatacctaagtatagttcctgaataatgaacttgacgatctattgtataactgcaaattaatttaaagggaaatataatcttactatcctgctccaatggagaaaagtagaaatcaagataaaataatattttagatacagggatttaatagctgctgaagattatctgatgcaagaatgtttctaatagaatatctctagagagtaattttctattttaataaataaaaagctttatcttccaggttctgtagctagaaaattgtgttctcttaattcaaaaaacagtttgagtactgtttattaaaaattattaaaagttgatgttttccttatcttgaatttgtttcattttaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtaagattttttggtaagcattttgtatatttctaaactaaatgattaagtctagtataacctagctcactcaataataagaccagcactatattatcaagaatttttcctgttaagagtatgttatatctaaatcgaagaaataaaacttcaggagttttaaaaagacattttatcaggagacaaacaaatgtagtgtaaattccaaactctaaattctttgaaagatgggttatattttcatgcagatattaaatgtttgttatttctttatattcctgtgacatttgtaaactcaaaaagtagagattagaggactgatagctatgatacaatgtacctgttgtatatgctaacgtgctttgaggatgaagggaaacagagaaaagaatagatgctgattaggtggggaaaagaaaaaatgctttcttagtgttttccagtaagcttatgaatgtattggaatttagtaagatagaatgttactgaaatcaactaaaggtgtatactacttactcttcttttttaaacaggtttcatctatgggaataacaccattttttgtggaaaatgtcagtgaactacagttgtgtgccattaagttagtcactgcagtaagtataatcaatttgtatttttagttaccccacaaataaaacaatattgatgtcatttaatccaaatttccaaaaaataatgaagatacctggttttcagtacattcatttcaatctaaggactattttactaagtcttattagactttattaattgaggatttatttttctgtttggttaatttgttgggttattctgtttttgtcacatttaaaacacttccaaatat

SEQ ID NO: 35785 - DNA, 1039 bp, Homo sapiens
ttttcctcacagagtgtagttcaagttattgtgccattttaaacttatgccactttaaacatttagtgccatattaaacctcaatacattaaactaatttcttcaatgttttccaagatattttttagaataaagttctgtaacgttggtaaatggttgtgttactgaaaaaatagtttactttaaaaataaacttttgaattgagaaaattgaaacatgtttcaggctaaagcataacaaaagtatattttattcacatttataaatatacttctaactttgattcttttcatcacccttaggttgcagcatgcagagatactggatatgactggtttgagcaactgcttcaaaacgtgagtgttcttttgactcctgataacctaaaatttaataggttagttttttgttgttggtgtttttttttttttggactgtatgatttaaaagaacctttttagttcttttggtagggaaaatttatttcaatatgttaggctggatgattttgttaatttctataattaattcagttgcctggttgtggtttttttttttttttttttttttttgaggtggagtctcgctctctcactctgtcgcccaggctggagtgcagtggcacaatcttggttcacttcaacctctgcctcctgggttcaagcaattctcctgcctcagcctccagagtagctaggattacaggtgtccaccaccacactcggctaatttttgtatttttggtagagacggggttttactatgttggccaggctggtctcaaactcctgacctcaggtgacctgcgtgcctcggcctcccaaagtgctgggattataggcatgagccactgcgcctggccttcagttgtctattgtacaagtaagttttctgaatcattaactaaaattctatcttactttctttccagataattttttttctttaatctctgtgattaatagatacaagatttataaatggatcaatatattgcattaaaaatataattacatgatttagtatgttatgcataga

SEQ ID NO: 35786 - DNA, 1052 bp, Homo sapiens
agcctgggagggcaaggctgcagtgagctttgattgtgccactgcactccagcctgagtgacaatgagaccctgtctcagaaaagaccaaactagaatgtgatattaatagctgctttaaggaaattagagaatggggcaggaagaatttgcggttcatagttgaaacctagtacattgaagctgtctgctttatttatttcttcaaattggaggaaaaggggcagtgtgtgtgttatgttactctggttgctgtcagttgttttaatcatttatgcatcttgtggggaaagtttaagcttgtgctgcccaagcttgtgcccaactgtaagccacatgcatttttttaaatgttaacttaatttcaatttttattttatttaattttaatttctcagtcacagtaggtacattgcaagtgcttaataactgcatgtgactcttggaaaccatattggacagcaaagatatagaatatttccattattgcagagaaagttatatttaacagcagtggaactcttcacagaaatcaaatacacatttagattccttcaatatccccagaattagattagctagcttttcttaggaaaacagatataccttatgacttttctgttgacctttgattatgaaagattagattggttttactttttagctatatttagaatgagctctatcctcatctcattattcataacacttttctagcattgtttgtgattttgcaaaggataatgcagaaaagaaatctaccgttatgttttataattgccttttaaggtgcaattcagatgcagttattaattatttaaaataattcaactagtattatgtgatactgtgtttttgattggaatagggagaaagggaaggtcatcttttctacatctttcacgtattaccttaggtcttacacagcaatttaagtactttgtagtaaaattgtttgaaagtattggtaaattactggtttataagatatttttaaacatatatatttttgttttattaatttgcactttgagtattaaattgttaatgaca

SEQ ID NO: 35787 - DNA, 2015 bp, Homo sapiens
atataaataatctagagaagatttaaagtatacgagaggatatgagtagattatatgcaaatactaccccattttatatcagggacttgagaatccacggattttggtatccctgggaggttctggagccaatcccccatggataccgagcaatgactgtacacgtaaagctacccaatgagattaaaaacttatttggaaattttattttggtgttatgattaaggtttatactttaatctgcatgagtagttatttatattagtcttttgaacaaaaatgagtaagaaaagattctaacttacccataccttattaaatcatgtttatgatttctgtaaataaattgaaaccttatcattttattcctcctccatccctttttgaaaattacatatagcacatagagtaaaaattcagacatcatttactaaggagttaaattgatgcaatattaacttcaagccaatgtgtaccttcagatattcagtctggacataatttatacggagtggcaaaactaatagtgttacaagtatttcagagtacaaaaagatgaagttttaacttaagcagcgctattcagaaaatattgcctctagaccagttaataaaagacatcttgcctgggccatagttatcctgagtgaccttgggctagttatctgatcactctatgctttgagtttagtttgttgtttgttaccaataatacttgctatcatcagagatcttcattttttcctcaaataaacattatatacaaataaacatggatgatatattgctacttattaacccgtggttataggattcagcattgtggccttattataatgccatatgaaaaagaaatggaagatatttttagctctggtttattatattgtttcatcaaatgaatatattttaattttttttttaaaataatgtcaatgtagtaccttctgctggggatctgaaaaatgtttgcagacattatttcttaaatcctgaaaacatccctgtgaggtaggtgggtggtaaatattattatccccattttacagatggagaattgaggcacagagagattatgtgactcacccaaggtcacactacaagtcagtggtggagccaggaatagaacccaagactcctgactcctaatccactcccctagccactaggccctgctccctcctcaaggtttcctcttgtgtgaaattctcctttgaaatgcaatttcttgtttttaattcatggggaaagaagtacctgctctaatgcttctctaggtaaggccaccagcatattcttccagtcattttaagttttaattttttgaaataaggagccgtttatataatttattaacatatttattaaatgttttatttaattttaatatgaatatatgatgagatttttcccctctcccataggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactgtaagtgaaaatatatttttaaatttcatagctacatttatattataatggctttatcttctttaatctaaatatctaaatttccttatttgttagatgaagaaattcagttaaatagcagtccttatgctgaggtctatagctgggctttagcatattcttaaattctctaaaatagttttaaaattgtatatgtgtgtaaacattaacattttgagggaggaaagagattatagttctcactgggttctcaaaggggcctctgacacagacacacacacacacacacacacactcacacacagattaagaaccattgagccagaacactagctgtaacgttttgtgattttggttatggcctaattttgaaatatttagtaaagttagtataggtgctcttaatgtgtgtttatc

SEQ ID NO: 35788 - DNA, 1052 bp, Homo sapiens
aggcaggagaatcgcttgatcccgggaggcagaggttgcagtcagctgagattacgccactgtactgcagcctgggcgacagaggctctggcttaaaaaaaaaaaaaaaaaaagggaaaggatgttatagaaactccagatactacttctcccctccagtggtctgagttgcgcggcgctttcccgcctgtccggtagggcggtgccgcgcagaaagccgcggtccctctgcggaaggcgccgctcttggcttcggcggcgccgctgtagcttgaaggcggtacttcctccagcatttgccgcaagttattggcaagttcccctgcagttgtttgggctgtccctgtggctggttctggggtgtgcggccagccatggagcgctctgggcccagcgaaggtgggtttcatgaggcgagtccgggcggggtgggccgtgtcgggggagctggggcgccgcactaactaggccgcctctcttttcctcttgctccagtgacaggctcagacgcgtcgggaccggacccgcagcttgcggtcaccatgggcttcacggggttcggtgagtgactgccccaggcagagaccctcttccttgtgcagaggtttgaagatccgcagagtgggagtggagatcgagctgtcaactcggaattattgtagctcgggtgcataccttgcagtttgtcaatattcttctcccatttgtcttctattctgcgttatccgttggaaccaactcagatgacagttatgagagtctggagagagaggaagagaaaggatttttctaattttaagtcaccaataatgctaaaatgaacatttttgtaaataacagcatttgtacgaggatttttaaaaatacgtaattcggtagggtagatttctaaaagagagtgtagtttattcagaaatataaatacttaaaaagctgaaaaattgggtatgtgccttttaaagcttcttgatgcttattgccgtaatacccatcaaaaaacttgttccaggttataccaaagttaacagaattaagaatgccatttttaccat

SEQ ID NO: 35789 - DNA, 1062 bp, Homo sapiens
aatggtctacatttgtatttgacacttggggtagataattttttttttttttttttgagacgggagtctcactctgtcaccgaggctggaatgtggtggcgccatctccgctcactgcaagcttcgcctcccgggttcatgccattctcctgcctcagcctcctgagtagctgagactacaggcacccgccaccacgcccagctgatttttcgtatttttagtagagatgaggtttcaccgtgttagccaggatggtctcgatctcctgacctcgtgatctgcccgcctcggcctcccaaagtgctgggacaggcgtgagccactgcgcccggccgcacttggggtagataattttttaacacctcccttctttatgtgatgaattatttttagtaataattatgaaatgaaatgaaaagtaatcagaaaagcaacagcttttgtaaatctgtcaatgactgtcaaaatcggtattctttgcgtattccttctcagtacatagtacagcaaatttgtcaatttgcgtctgtctgtagttgatcaaataaagcttctaatttcaattttgtacatttttctttcatatgaaataacagatctatagtatatatacacacatatgcacatgcattcatgtgtgtgcatatgtaaaattaagaaaacaaacaagaataaaataagaataaatttggcagtttcattaaaatttttgttttacagtaagttccagaaattgcaatgttgattgtatattttttcttttatcagttctagtggcttttaaatatctctgtaggttgaaatattttgactgggcactgtggcgcacgcctgtaatcccagtactttgggaggctgaggagtgctgatcacttgaggtcaggagtttgagactagcctggccaacatggtgaaaccttgactctactaagaaaatacaaaaataggctgggcgtagtggctcacgcctgtaatcccagcactttgggaggccgagatgggcggatcacgaggtcaggaggtcgagaccatcctggctaacacggtgaaaacccatctct

SEQ ID NO: 35790 - DNA, 1052 bp, Homo sapiens
aggtgcatgccaccatgcccagctattttttgtacagatggggtcttcatatgttcctcaggctgttcccgaactcatggctttaaatgatcctctcactttgggaggatgacatgaggttgagagtttgagaccagcctggccaacatggtgaaaccccgtctctactaaaaatacaaaaaaataagccgagtgtgctggtacgtgcctgtagtcccagctactcgggaggctaaggcaggagaatcacttgaacccaggaggcagaggttgcagtgagccgagatcacgccaccacttcagcctgggcaacagagtaagactctgtctcaaaaacaaaaaataaataaaagaattatgacatgaaataagcatatgcactatagcaccaacagttcaacagttagcggatccttcttttgtgcaattttctaaacaattaagatgaattaactcatataatcctcctactgctccagtgaagtggaggtacagttatccatcccctttcgacaggtgaggaaactagtattcggaagtgctaagttctctaaggccacgcagtggtaaatggcggagtcaggtttcaaatttagggaagctactccagaatccatgtgcttaaccattatgccctactacactactggttgtgacctgttctgcttctcagggtcatctcgaatctctcctacatttgcctcatgccctatctgtgtaaactgtgaacagtctttggttctgactgtttcatgcattccagaatactttttcttctctctggatgctgatcaatacttagtacacctctattcagtggcattctatgtaagctgtgacgcttgtaaggtactttgtgacagacctatctctttcatcaaggaagacctttttcatttttcagaattatttttccctgtgaaaacagagcattttctccttgtgaaaatcttcactgactcacaaaagtggtgttgaataccttctcttttgtgctacctctgatttgttatattcctgtcttacatttttagtaacagaactgtggagat

SEQ ID NO: 35791 - DNA, 1049 bp, Homo sapiens
cgccgtgttagccaggatggtctcgatctcctgaccttgtgatccgcccacctcagcctcccaaagtgctgggattacaggcatgagccaccgcgcccggcctttgagccaccgcgcccggcctttctggctaactttttgtattttagtagagacgggattttgccatgttggccagggtggtcttgatctcctgaccttcctcgtgatctgcctgccttggcctccgaaagtgctgggattataggcgtgagccaccgcacccggccttttgctcattttaaaatgaggtggtttgtttttttctgttgttgagctgtagaaattaaaaaacatatataatctggattttaatcccttatatataagatttgcgcaaattttctcccatttctctgtagattgtctttttactgtattgattatctcttttgatgcccagaacaccttggcgatattttaaaatctcagatttttttttgttgttgttgaacagagtctcagtcacctgggctggagtacagtggcacgatcttggctcattgcaaccctcacctcctaggttcaagcaattcatgtgcctcagcctcccaagtagttagaattacaggtgtgtgctaccacgcctggctaatttttgtatttttagtagagatggggtttcaccatgttggtcaggctggtctcaaactcctggcctcaagtgatccgcctaccttggccttacaaagtactgggattacaggcatgagccaccgtgcctggcctaaaatctcagactttatcaaattactttctatgactcagagcttaaacttctgttttttggaattgtatacagcctgatttggaactctctctctggcttttatgtatacagttggccctttgagaggaattggctccaggactctcctgctgatccccaaatgcaaggatgctgaagtcccttatataaaaatggcatagtgctgtatatgtataacacatacacccttgctctattttctgcctagcaattcaaactctagtaagggaaaaatacttga

SEQ ID NO: 35792 - DNA, 1044 bp, Homo sapiens
tcaagttggaacaagacactttttttttttgagacaaagtcttgctctgtcactcaggctggagtgcagtggtgccatctcagctcactgcagcctccacctcccaggggtaagcgattctcctgcctcagcctcccgagtagctgggattactggcgctcgccacaacaccgggtaatttttgtatttttagtagagatggggttttgccatgttggccaggccggtcttgaactcctgacctcaggtgatccgcctacctcggcctcccaaagtgctgggattacaggcgtgagccactgcgcccagcctccgagctctgttttctatttttctaattacctccttcatatcgttttggtaaatgatgaatcatatatacagtcagcaacagagatcctgatacttcagtgaatggtagcattgaaagcctcattttgtaattttgctttttaatttgtcatctttcttcttaggagaacagtcaagtttgcaatttattctgttcttccttgataaaaaggaatttgtctcatatttgtcagactgcatgtttgttttacataagatttaacaatttttagttctcctttcttttaaacaaatatttagtagagtttgtattttgtgccatgttcagtgctgggcacagacaaggtctctgtccatatggtgcttatactcttgagggaaggacagatacagaatagaggaaccacaaatggagttgtaattttatattgtgttgtagtgagatgaacactggtggggttagccttattaggaggagaaataacttttaaattgtaacaggagggaagaaggatagcataatgaacgtagaggcaagtgagtttgtaggtggtggtagcagaagtcacttctagatttttaaaactactattcatttatttttgtttttgattgttttttaagacattattgttcgggcataaaaaatgactttgttttcacttgtatattttccttgacatctttagagttcatgtctaattttaacataagtattattatttatgtatg

SEQ ID NO: 35793 - DNA, 1062 bp, Homo sapiens
tgttctggctaaaagtttatcaactttattgatttattttctcctacttgccttctttttctaatattttaagatggatgctttaattattaatttgagacttttcttattttctaatagaaatgctctaagcatttctttaactgtgtcccacaactttcagatgttatattttcatttttattcagttcacttgggattacctttttgacccatgggttattagtgtggtgtttaaatatacaagtatttgagacttttttcttactggcttctaatttaattctcttatgatctagaaacatactttaaaaaaaaaaaaattctggcctcaagtgatcctcccacctcagcctcccaaagtactgggactgtaggcatgagccatcacacccagcccttggaaacatactttgaataattttaatttttaaaatatctgatgaagtgtgttttgttacttagaatatgattttagtgaattttctgtgtgcacttgtaaggaatgtgtactcacttgtcaacacttagtgctgctctctagtcaaagccactgtcgatcttcgcatgactcacattaacatcttcccagttggacctataaattctttttttttctcgtttttcaacaggcttttcttcactgagcagccctatagattctttttttttttttttttttaacagactttccttcactgggcaaccagaatattttttaaaaagtatttagtttctagcctgtgcagtatagcagaaaccacatctctataataaataaaaaatcagctgggtgtagcggtgcttgccttgtagtcccaactacttgggagggtgaggtgggaggatctcttgaattcaggaggttgaggctgcagtgagctgtggtggtcgcaccattgcacttgagcctcagcaacagagtgagaccctcatctgtaaacaaacactcccccccccaaaaaaaaacttaataaaattatttattttggtataattttaaacttaaagaatagctgtaaattaaaaggggtgtaaagcttctttatacttctttttcag

SEQ ID NO: 35794 - DNA, 1025 bp, Homo sapiens
gaattaactctatctggtggtacttgaatatggaatgaaatctatggccagccagcatggttacctgttgtttcaaaacagcaaagttagtgcttgaaatctgtgaagttcatttaaaaaaatgaaaaaaaaaaaaaaaggttagcaaaatcactgatgttaatgaccagccaagtagctattgtaattaatgctgatgggttctgaagaccattggcaagacaggaaccctgaatagatcaaccataagtttgccaaatatggactatttatttttactagagactttgtggagaccaggacttgagacactgtttttgtatgagggtagtagccagtgttaccaaccacttgctatgtgccaggtgaactcttataagcactttgtattaactcatatgactctctcacaagatcagcaattgcaagagccttccttttttcttctcttcctcacttggtttttgtgtgggaatctcaagtaattattttgggacacacttttggcaaggggtgggaggtactatagacttagtggtaagaggagttaaacattgtagcagagtcagtgctgagtttttggtaactagtttcaagtgttaggtatcttctaataaggacatttaactctggttcatggtaattctaaatatcttattaaatcaacatatatttcatggctaatccatacatcaggtaatctaccttgccagagttgactatataataaaaaataaattatttatattttgtattgtatgagcatctaatttagttttcctcttcagatttatactcttttgaaaactcttcaaaagagtactcttttgaatactcttcaaaagagtattatgtatatttattatgtatgatgaaaggtatatgaaaggaatgtattgtgaaactaatatcggtttattacacttcctgtaagaactagcatgaccactcttttactctaaatatgccaaccgccttggctattcaggtttcagtagtagttaaaattctataagaatttcatt

SEQ ID NO: 35795 - DNA, 1022 bp, Homo sapiens
ttttcacttttgagaaaaggacccaagactgaatcctgaggaaatgacgatatttaagagacaaagaagagtccacagagtgctaagatcaaccaagaaataggaggaaaactgagagtactgtcacagaactaagagaatgtgtcaaagatctgagaatagttatcaagatcaatggctgctatgaggccaagtaaagtgttgtctgaagaaatgtcttttggttttagtaacatgttcgtaccctttgtttctaagcacaacttgttcctcccacttagaatgttctttacccatttttgtactggctgaacacccagtcttccttccagatgtttctcaaatagtccctcctctatgaagccttccccagcaaaattattttcttgccctagtttgatagctatagtaacacatataaggttctcatagatggttttgtgtacatctctgtgctctgacaagatattgaattcctgagttcaccaagtttgtatgattttttttttaggactggcatcttgtgttactcatctttttattcttaatgttccacacagtggctggcaagtaggtagtgcttgaaaatgtttgtggatttgaaagcttgattttgaatatggccttaggcaaaaagcagcgtttcaaattgcatattaaaagtcacttcaaaaccgaaatttctaagtagcgctgcctattggatgaactttatcatatactcttttctctaacaacattcaaatacaaattgcaatctattccaaaagatgcattgctattgaacataggagaaggaggtagataggtaataatctataattggccaagaatagactagtcttgtactctttagtaagtgtttggatccaaaatgatctttcaggaaagtgccacaatatttaacagtcagtcaaagagtctgttgttgcctagatgttggaataaatttgataacttctggaggattattttaagtccatgtattcatttgtttaagttaagtatattaagccacttcc

SEQ ID NO: 35796 - DNA, 1024 bp, Homo sapiens
ccgattcttttccaataactagattttaaagcatatagtattaacaagtgatatttaatgaacacttactttgttccagggaccatttcaagtgctttttatatattttaattcatttaatcctcagaacaatactgtgaattaagtactaccattaactacatgttttagatgagaaaactgaagtacagcagtgaagggtttaacaactcgcccaaggccatgcatctagttagttttggagccaggaactctgactctagaatatgcactccaaaatttcactgctatatggttcaaaaataaatgaccctgttgggaatattctaaaacaagattgtggtgatggttgtacaactctgtaaattaactaaaaatcattgaattgcacacttaaaatgggtgaattttatggtcttaaattataatttgataaagatgtttaaaaagtgggtgatctgtgttcttattaaaatggattataatgtttttcaatatttcatgtgcagtggaacttttagccctagttctcttgccactggaatatgggagtgggtgaagtaggtaatctatgccttgcctaagttggctaaggacagaaaagtttatatgtcactgttacgagctctttgggggtgagaattttttcttccttacctttggatctgttggtatgtaaaccatccatagcagggacttgataagtatttgttgaattaaatctcaagggctttatttacctgcactgtagatacttaaattgtatccccagaaatcctagctttcatagtctaattttaaaatatagaccttgtgcagtatacttaaaaggtgaaacatatacactgcctagatgcatagatattaacatatagaagggaaaaatgtagctggtgaaaacactgtgtacaaaactttgtagattaatatgattgcatattgatcaaagttgcttgaggaagccagaaggaaaattgagttcacataagtatttacttataaagatttttaaaggtattctgaa

SEQ ID NO: 35797 - DNA, 1049 bp, Homo sapiens
agctgaaagctttttattgttcataagatgtcatttgtgggtttgccatatttggccattattatatttaggtatattccttctatacttaatttattaagagtttttatcatgaaacgatgttgaattttatcaaaagctatttctacatctattgagatcatcttgtggttttcatccttctttctgttgatgtgtgtgatgtttattgatttgtatatgttgagacatccttgcattcctgagataaatcccacttgattatgatgtatcctcttactgatgtgttgttagaactcagcttgttagtattttggtgaagatttttgcaacagtgttcatcagggatactggctgtagttttccgcttgttgtcgttgttgtatccttatctagttttggtatcagggttctgctggccttgtagaatgaattaggaagaattccctcctcttttattttctgggatagtttggaaagaattggtattaattcttctttaaaggtttggtagaattcagcagtaaagccgtctggttttggacttttttgttgttgaaagaccttttactactgattctctctcatgacttgtaattggtctatttgtgttttcttttccttctgggttcaatctttataggttgtatgtgtccaggaatttattcatttcctttaaattttcaaatttattggcatattgttgttcatagtactctctaatgatcctttgtatttctatggtgtccattgtgacatatcctcttccgtttatgattttttcaaatttgagtctctttttttctttttttctgagtttcactaacgttttgttgattttgtttatcttctcaaagaactaactttctgtttgatcttttgtgtattttttagtctttttctttagggtctcactctgttgcccaggctggagtgcagtggcttgatcttggcttattgcagcctcagcttcctgagctcaggtgatcatcctgcctctgccacctgagtagctgggactacaggtatgtgccaccatgcctggctaa

SEQ ID NO: 35798 - DNA, 1121 bp, Homo sapiens
tcttgaatgcttttggaattctttgtcttttacttattacaatttgactatgttgggctccagagaggacctgtttgggttgaatctgtttggggttctttgagctccctggacctaaatgctcatctctctcccaagactcaggaaattttctgctattatttcattaaatatgatttcctcacctttacccttcttttttccatctggaatgcccatagtatgaatatttgcttgcttaatgatatctcataaatcctttaggctttccttattctttttaattcatttttgccactgcttgtgttatttcaaaagatctatcttcaagttcagaaattttttcctccatttggtatagtctgttgttgaagctctcaattatattttctatttcattcatttaattctcagctctaggatttctttttggttcttttttatgataatccacctctttcttgaatttattacttatatcataagttgttttcctgattttgttgaattgtttatctgtattctcttgtatctcactcagtttccttaagattattattttgaattctttttctggcattgcatgtattatgattgtggtctgttactagagaattatgtttctctttggaagtgacatgcttcctcgctttttcattattctgtgtctctgtattaatttctgtgaatctggtggtcgcctcttccaattttattcactaggtgtcacaaggaaagacttactcatataaatggatcttgggttgttgatttgatggagtgcattggctttggatctaggtggacacagtagtgtagttgtcataaaatttcttcaaccgtaatccatactgggggcatttgagagtttctcagtggcctaggctgagagagtttgtggtgacagtagtgcagctttgccaggcttgggctaactgggctgtctcttaggttgggcatttgttcatgcacacagtgggtcaggcagcttggagtctggctcactggggttgtagccacagggatgttactctagccaggagcacaggcatgcttgtagttgcttggctagactaaggcatgtctgctggggatggctcatagggctgtttctcagccat

SEQ ID NO: 35799 - DNA, 1055 bp, Homo sapiens
caatagtcatttacttttaaattgcctatatcatattaaaataaaacaatagctgttatttgttgatcattgccagaagtggtttgagcactttaaatttattatttcatttaattttcaccacagctcactgaaattggtgttactattattctcacttcgcagatgagaaaactaaggcttaaagaggttaagtaacttgcctattttacaactagaaatattacagccaagaaacccaggtgtgtctgatttcaaagagattgctttcaaccactgtatcatagttttctttgagcccctatggacatttgcaagtgattcttttatgtctctgaagtctatattttaaattttttttatacacagcttacagagaattaccatgaaaaatgagcgtttcactgatttgtctttattaagagcaaaaaattctttaaaaattcctcaaatacctgttccacatatctaacactgaaaaacctgttgtttcaatttttaatgctatttggactgtgggagcaaacattcctgacggttgctgtcagtgctgatacattttttatttccatgataattcttctatagatatgtgttactctttctgatgtggtgttcactagtttttaataaataggctatattgtgtgtggtttttttcattgagagaatgatggagttaaaaataatcacaataataattttaaaagaacatgctgacatttagatctacagactttctcctctaggctataaagtcttaaaagtaggtcatactttgggtttaaactctgaacagatacttgctctctatgttagcttaccttttgatcttaaagcagcatttattcttaacttcagtaaattttaaattgtccttccaaatttggaaattctgtatgaaatgaaaaatcaccagtcatttaaaggagaaaattaaagaaacaagtttggcacttttctgttctgtctccttgaagaattggaacttttctttctatcagtgatctaagctagaaatatgagacagttaaaaaaatacggaagttcatctt

SEQ ID NO: 35800 - DNA, 1021 bp, Homo sapiens
cctcacatgctttcttatacttagattttctcctccagcctatcctggcctaatacttcctagttcctgtaagtataaacattaggctcatttctctgctataggtactggtgactgaaacacttacttttgcatactgattatttttctgtagtagcatattttatataccaactattttagaaaggtcaattctgtggccaaagagagttgatgggtttggggttgtaattaaatgttactttaaaagttttagatgtagtgactttaacaaataatacaggatttgatttacatacacctataggaattttgaaaggatgattgctataagtgtggtacctgtttacttagagtgggtatcctttaacagtataaacttcctacacttacgcaagtttaacaagtgtttcttctgagatcagctaactggtgatgattcatttcacattttagttctcttagccctctgataccatccctcaccctcacccataataccctgtctgctcttctgctcccttctatattaactctattttttctttccaaatgcttagtaagtttgttcttcccttcctttcttcttccatctcttcatcttcttattgactgaagatagtaatttaaattctttaagtttggaaaataagaatatttatatttgacattacatatttttaaaatgtttttaattttcatgggtacatagtaggtgtatatttatggactacatgagatactttgatacaggcatataatgcgtaataatcacatcagggtaaatgggatatccatcacctcaaacatgtatcctttcttcatgttacaaacaaatcagtttggcaaaagctccaaactgttctacatagtggttgtactgatttacattcccaccaacagtatatgagtgttctcttttctccacatcctcaccagcatttatttcctgtcttttggataaaagccattttaactggagtgagataatttcacattgcagttttgcatttctctgatg

SEQ ID NO: 35801 - DNA, 1332 bp, Homo sapiens
catattggagccctgctgtatattatttatttcttttctcttgctccttttaggatcctctctttatccgtgacctttgggagtttgattattaagtgtcttctgctctttttttaggttaaatctgcttgttgttatataacctttttatacttgaatattgatatatttctcttgggttgagaagttctctgtaattacccctttgaataaagtttttactcccatctcgattattttttaacttcctctttaaggccaataactcttagatttgcccttttgaggctgttttctagatcttataggtatgcttcattcttttttattcctttttttcctctgactgaatattttcaaatagcctgtcttcaagctcactaattctttcttctccttgatcagtgctgctgttaagagaccctgatgcattctttagcatgtcagttgcatttttcaactgcagaatttctatgtaattattttaaattatctcaatctgattgttaaatttatgtgatttaattctgaattccttctctgtgttatcttgagtttatttgagattcctcaaaacagctattttgaattctccatctgaaaggttacatatctctgtctccagcattgttccctggtgccttacttagtttgtttggtaaggcaatgttttcctgggtggttttgatgcttggggattttttttggtgactgggaattgaagagttgggtatttattgtagtcttgtagttttggcttgtttttacccaccattcttaggaaggcttttcaggcatttgaaggaacttgggtattgttatctctgtttttggtcactgtagtcatattttcattagggggcaccccaaaccctgtaatgtggtggctctcgcacactcatagaagtaccaccttggtgatcttggataagatctgaaggaattctctggattatcaggcagagacttgttctctttccttactcccaaacttactttgtttgtttctcctaaacaagcaagagtctccctgtgctgagctgcctgaagttagaggaggaatggcacaagatgcttgtggccaccaccactgggactgtgcttggtcagacctgaagccagtacagcattgagtgttttacatggcagcaggcaagagagagagtgtgggggtgcaggaaaaactaccgtttataaaaccatcagatctcatgagaaatcgctatcatgagaacagcttgggggaaactacccccataatccaatcactttcctccctcgacacttggggattacaatttgagatgagatttgggtgtggacacagagcca

SEQ ID NO: 35802 - DNA, 1064 bp, Homo sapiens
agatggtgtatgtttctttaacatttgctatttcaccatacgatgtttgcacgcattttacaattctgctaaaatttttagacattcccttgtagtctaattgcatttcctcaaattatacactgaaatgatttgtttatgtccccacccaaatctcatcttgaattgtagctcctcatatgttgtgggaaggacctggtgggatgtatttgaatcatgggggcgggtcttttccgtgctgttcttgtgatagtgaatacgtctcatgagatctgatggttttataaatgggagttcccctgcacctgctctcttgcctgccaccatgtaagacgtgcctttgcccctccttcaccttccaccatgattgtaaggcctccccagccatgtggaactgcgagtcaattaaacctctttcctttataaatatctcagtctagggtatatgtttattagcagtgtgagaacagagtaatacacacacacacacacacacacgcacacagactcacactcacactctctctctctctcccctcatttgttatctaattctttgtgatttgaatagtatgcttggcctcttttctaagatgaattccagaatataacttgaatcttgagtttacaaattcacttttgtttttttttgtaagacagcagtttatgctttttatgtattatgtaaagggcttccattactctgttttatacaataaaagcacaggaaagaaagaatggataaaatacaacttggtgatgacatgtcaatttttaaagttaattttatttagatgaaattattaaattttaagcttttcttaagagccagtatttagggaaatgttctgaaataacaatattattagcttggtagtttttcaacaaatgataatttattgtgaaatgactaatagaattttctttttaactagtatgaaccaagggacatggtttatgcaattgtaccagtatattaccatttatattttttaacttaagcatggttaatcaggttgttttaacctgatattgtttcatggtctctgtacctcattcacttt

SEQ ID NO: 35803 - DNA, 1028 bp, Homo sapiens
cctcacctatttttctacctatttttctcttcttgctccttctctccctccctgggaatctgtgtgaatagatgagataataaaccagattttctgagttcataagttactccctgggaataatttatattgcacaaatactttccggtcactggtgtattatttggtaaattactgccctcctgcaatgctgtaagtggaaccctagtgacctgaaagagttaatgcctccctgcaagcaattaacttactcctggggcataatttacactctaagaggatctggcggaccatatgtgaagcgcttggaattctttgagagaaaggcagctctagaaatgtaaagaattaatattacaccaggtgaatttgcagacctttcttcgagcagtctatcatgtaacttcccagaaaagtcctgtaaggtaggtcattgttatcctttccagaggcattctctagccaatggtaagtcagcagataatatacccagcatgaggttaggcaatacctatttgtagaatgacttcactatttgaaaaataatgggtgaaagattgggaggtacattttagaaatctgagtaaaaaacaaaagctaaagttaagataattgtaataagtatctactttacaatcttgaatagtaggaatgtgacctaaatataatgggtcaattttctatactaactcagggacaccaacatattagaatgtggcatctgtttcaaagtggtcatctgagaagactatctatatatcctaatatgcacctgtcacttgaaacacttttataacctgcaaacacaattgtcatccatccaacaaatatcatttagccatctcccttcataaggccctgtgttggcagttgctgagggacaaagaaaaagtcatgagacagcatctctgtattcagggatggcagttctctgggttttgagggtggggtgaattttgagcaaagatcaaaccgtctgaaatcaatcctagtgaaagaggagggttaaaaccaagagaagataattt

SEQ ID NO: 35804 - DNA, 1024 bp, Homo sapiens
tcttttaaagtcagttaaagtcttgtctagagaatgcttgaggacttccctgaaggatgcctcaggatggcactaactcaccagatgtaggcacgctgggatgaacatctttctccttccggaaggctttccttctagtccagtggctctagtagtttatcatctgcatcagaatcaccagggtggttgttattgtgcagattcttgggttatatcctagacccactgagtgtgagccttttagggctgggacccaggaatcagcattgtaacaggcaacccaggttttggagccctgcctcctggcagatctctcactgtctgcagagcatctcctaaataagcatctcacttcacctacaacaaagccactgactccactgtctccacaaggcctggagggaaggaagatggctccctgtctcttcttccaaaactttcctttggagctgggcctggtgtcctcgaatgagagggacttgcaggaaagccagtgaacaagacttaggaaatgcacaaggaatgaaacatggagatatcagagcctcttctggccagggatggtggaacaccatgtagttttttctacaagcaccacgtagttttttcacgcattagtcctcaaatatttattatgtgcttaccatgtgccaggcaccactctaggcgcattctgtccaaccttgcatttcccatcgttttgtcagataggagaaatgaagctgaaatttaagtcccaaattatcaccaaataggcaggaccagcaaaataattaggagacaaatttctgcctttttctgtgtgtgtgtgtgtgtgtgtgtgtgtgtgtgtgtgttgtatgtgtgcctctgtgtgcttttgtgtcacacatactcatgtgggttagattttactaaatagcttgtgttttccaagcatatgtatatactttattcattttattacttcatatgagcatttgtttattcatttagtaaatagccattcattcattcattcatctaatatctatagtaggtcttc

SEQ ID NO: 35805 - DNA, 1049 bp, Homo sapiens
cgagttgtatcagcaggcacttttctgtaacatctgggcacttggaaacataatacttaaatacaacctgagtttaaagccttccacagacagatggctaatttgattgatctaatctttcagttaggaatagatcccatgatcctttgcttgtaattcttgagtgagcagataaataaaaaaatgggtgatggctgtgaattaggcacctgttatattgtctgtaatttattttttaagtacttcaatataaacagtgactctacgaattactttaatctctaccctgggggagcttagttaacacttgaagtaatccaggctagaaggcaccgctctggcataagaatttacagctattttcatctcttggtgattgtgccatgccagtggttagatatttggaacttcacctctgtcttaggcaggaatccagactgattagtgattatttgaagaactttactatgacgttccaagtggcagcaaatatacttagaatgatgttatcagatattcacgctagagggttcattaattagcataaatgatgttagatgcaatgtttttattggtgaaaatatgtgattaactagaaagattattcatgtccctctatttttacgtggacaaagagtaagaatccagcaactccagaaatcaagctactttcgagtggctgaatacagctagagctccattcatttctgtgtttccctcacacaacagtagactcatttgcctggccccacccggcaagatggtttgttgatttttccattagaatattgatgtatctctctcagcagatacaagcagttgcttgtattaattagggtaattagcattacctattgtaataaatccaaatctgggtggcttgacacaaaatttattttttggacttagtctaagtccaaagtggatgttcctttctaggaagcccacctcagctgtcttcctccaaagggtgacttgaagactcaagtcattctgtctttaatcccaccatcttataataccaccatctttaaaatggacctccaggg

SEQ ID NO: 35806 - DNA, 1119 bp, Homo sapiens
tctgattctttttaaaagttcccggggttgagggtgctatacatcttgactcaagaactcaccatctgggaaacaagttatgcattgagaatccccaaagaacaggctatatgtatgaacttcctagcacttaaatactaacatgctttttacaattgagttggtctgcagtttcttctggttaaatccaggcccattcatgtttcaatctggctaagtctaggctatacatatgactaaggacttaatttctccatttaagaacatctatttaagatcactttatactttaaaattactggttttgctaaatctgtgactgtatttcctaatagggtgaaataaaattttgatacattctcagaatcttcaggaattttaagctattttcagaggacataaactaaaaaccattactttaaagaccagtatttattatttatttgctaatgttggattcccactatttgattattttgatgctaacttctcaggtaaacaataatgacttaatggacagatggatgttacaccaatggcacagcaatgtactcaaatgttaaaaatacatccatagcgctatgtgattgctttacaaccactgtatttcttacgggatagaacaaaaaaatacaacaacaaagcagagccacttctcctaagtgtgtaacatggggaaaaacccaataatgcccaagtctgtcagtgtaagatgtaagaaaatatatttattttttccatgacaatactatgataaaattgttaaatacatgcatgttttaaaaacagacataagtaacatctttagagttaacagccaagcatactagttttacatttatggtgttttagtaatagattattttctatgtttttgctataatcatgttttccaaaagatacagaaactaaattctgaaattatacaatgatataaagtgtccaaatttcccattctaacagcaatttaaaatccaaattttcacaaggcaggaaatgcttcagttatcatctaagtggagttgttttattccatattactctcagaattctgtgaatcagactgaatcacacacatgtacttcatctatagttttcttcctgtataagtgtattgaa

SEQ ID NO: 35807 - DNA, 1048 bp, Homo sapiens
aaaaaaaagcactagcctccttctcctcctctcctttgctcctactgattgagctgtacaaaagccagaagaaaaaagatgacatgacattaccaattttgtagcacaatgtcttgttatcataatgcaatattaatgcaggcattatgtttctatgagatgttaagcataaagtgaaaaaatatcccatggtcaatgaatttggaaacttctggttaaacaaccttaaaaatgtgtcttttagtgtgcttccctttctgaacttttagcatgctaatatgcatcatgaacctctaagagaggcctaaaacatttgacctaagtcaaactaacttgcctgtggaatcttttgtttgcagggagggcattacccatgagtactttcaaaccgaaggtcaattttgtaagtttctgtggttcatcatccattaggtattgcttttttctaataaataggattgtttttactatagcttaagcccactttatctttgaatattattatggagaaaaacgattcaaaatcgtctgtataagaatcttgtctttacttgtatattagtctgttctcacattactataaagaaatacctgagactgggtaatttataaagaaaagaggcttaattggctcacaattctgcaggctatacaggaagcatagcagcttctgcttttggggtgaccttaggaagcttccaaacatgcagaaggcaaagaaggagcaggtgtcttacatggcaggagcaggaacaagatatatagagtgaggggaaggtgctacacactttttaaacaaccagatcttgcaagaactcactcactgtcatgagaacagcaccaaggggagagtgttaaatcattcatgagaaacctactcccatgattcattcatatcccaccaggccccactgcaacattagggattataattcaacatgaggtttgggtgggggcacagatccaaactattgatttgaaaatccttataaagcacccctcaacatttgtgctaccacctgtttatccagagcttatgacagacatc

SEQ ID NO: 35808 - DNA, 1136 bp, Homo sapiens
accatgttggccaggctggtctcaaactcctgacctcaggtgatcctcccacctcagcctcccaaaatgctgggattacaggcgtgagccaccatgcccagcctcttccagctatcttttagaaaattgtatatataataattgtacataatttagggggtatatgtgatattttggtacatgcataaaatgcgtagtaattaaatcagggtcttttaggatatctatcacctgaaacatttatcatttctttgtgttggagaaattttttcctccagcaattttgaaatacacaatatgttgttgttagctataatcaccctgtggtgctgtagaacactagcccttgttcctccaatctaactgcatgtttgtgcctgttgactgcccccttcctaacccttttcagcctcaggtaaccatcattctatcttctatttccatgagatccacttttttttttttttttagctcccacatatgagtgagaatatgtgatatttttctttctgtgcctggcttatttcacttaacataatgaccttgagttctatccatgttgctgcaaatgacaggatttcattcctttttatagctgaattgtattccactgtgtatatataccacattttctgtatcacttgtctggtgtacaacacagtttaattccatatctttgctattgtgaatagcgctgcaacaaacatgggggtgcagggatcccttttatatacttatttcttttcctttgaataaatacctaatagtgggattgctagattatatggtagttctatttttagttttttgagagacctccatactgttttctataatggctcttctaatttacattcccagcaacagtgtatgagttcccttttctctgcatcattgccagcatttgttatttttgcctttttgatactagccattctaactggggtaagatgacacctcactgtggttttgatttgcatttccttgatgattattgatgttgggcatttttgccatatacctgtgggccatttgtatgtcttcttttgataagtctatttggaacatatgtccactttttaatggaatttttgttgttattgttgagttgagttccttgcatattctggatatta

SEQ ID NO: 35809 - DNA, 1035 bp, Homo sapiens
atgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagag

SEQ ID NO: 35810 - DNA, 1049 bp, Homo sapiens
aatcatggtcttttgaataacatttgcaactacatttatgaaatcttaagttttcagtggaagccctttctgtatatttatgtatattatttgtatattccagtaagttttaaatttgtttaattattttgagtgcattatcataaaagaagcataatgagaatacagactgcatttaagaaatggcaagagtgactctagaaagttttcagtattttgctttgtaggaaaaattttcatgataaatttacttaattaggattaggcattatgagatatttcatgttttagataagatattattactataattctgtttctccatatgtcataatattatttcatcttgtcatttcatcttcatacataatgtgttttttgtttaaataacactctgaaactaggtgaagtaatcctcatgtttttatttcttatagatcactttttaattcgggcctctgcagcattagaaaaattgaaactcctgtgtggagaagagaaagaatgttcaaatccatcaaatcttctagaactttacacacaggtactgaaagagtggtggactctggcattttatgagggcaggttgtttatttagatgattgactccaactttaggtaaaatgaaatcagtttattctatatttcaagtgtttaattttgtccaaaaaactatgaataaaacacaaaaacttaaaactttgaggtagtatgaaaagaagtaagatttattagatgtgttaataagaaaagtcaggaagaaaatcttacagataacggaattgttttcctttagagataattgaacaggacactagtgtgtgcaatgtccaatctcttgaaagtttcagagggagcaggggagtatataagggccctgactttttttttttcccctgaaatttaccttccctaggattctcaatattattctccctgctagtgtcatgcatatctatgtgatttttctattcacccacttttttttttaactttcctttccaaatcaggctgctgtgtggacaacacctttttttcttggttttctg

SEQ ID NO: 35811 - DNA, 1027 bp, Homo sapiens
aggtgaaaactgtaggaacaaattttgatactttaaaaagcttgcaatagattcaaacagaaactaccactattttgaaagttgaatttttcatatccagtgccatcatagtcacttttgttgaatcatattaggtgaacaacagacattgtgatgctcatttatttgaagtaatcttttctaatcacagaagcacattagaatccatcatttattttttcttcaatggctttaagaagttacatttttatttcttttatgttctttaggaaaattcaggaattaagtaggggatgcaaactccttatttttcagatttaaaacctgagattcaaagagctttggtgacttgcccaaagacacaaagccagtaatttatacccagatcttttttattctaggtttatttgtctttctgccaaattaatatactttatgcaccataaatatttaattatataattgcctactggaaaaactacccataagaagaaagagttcaacttttgatgaaaattctgcagcatactctctttttttctggtaatacaaagcatcttggaaataacacctttaataatttaaaattgtatggactctcaggcatgattatgcatgataatttcttagacttttagagaatataagaggtctaggatacttgactttagctatatgaattatcctagagcataccccaaaataaagggtgtgtccatggatgtaattcagggagtttataagtactctgaaattgactgcagaatttggggtgtatattctgggagaagttctattccttaaattagattctcaaagaagttatagagtggaccccaaaaaggtcaaaaacacctaaatggttctctaaaaaaattctctggtactctgtttttctttttgtaatgggcctcctttatcagtaaaatcgatattaaaaaatgctaattaaatgaagattgtgttagtcatatttggcttttgtgttactgttaaagtgagaatagaaaatgcttaatgacaaaag

SEQ ID NO: 35812 - DNA, 1072 bp, Homo sapiens
aaaaaaaaaaaaaagtcaagggccaaagtaacaatgtaggaaaaatttgatgactttaatttcatttacttctaggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgtatgtataccaaatgtctatttgaaaattttgtttctctgaatatagctttcttttctctttaacacactggtccagtggttctagattttatgctcccataaattaagtaagacagcattctatatcatgactgaggtgttaatgacattatgcagttgtcacattttgaaatataaacttaaatgcgagcttttcactgtgtgtaaagtttctctgtatttttttaaaaaatttttaaagaccagagattttcagcaacaagaaacataaagaagtaaaaagagcgtagaaaccctgccctagaggacctgctccaccacttaaaagccatgtacctcttgaagcctgtttcctttatttccaacacaggaatttttatatttacaccctaaccatcacatgggtcacatgtgataacaatgtgcaagtttcttacaagtgttctaggaatctgtaagtcttagagttctgaggtttattcccaaaggacaggaaattgtgggttacaccaaacagttaaacagggtggcagggaatccctgtcacgtacccaggcctttgggttattttctagggtgaggggacatggccagtagtacaaagagcatgtgaacgcatggatgtgggtgtgtgaggtcatgagtgggtgtgtatgtttatgtacaacacatgtattggaggataaaagggaaaataatttgtcttcctgacttcttctctattcctggcttttcttagattgttattcctctctaaacaaagcttcaaaacagaaacccctccccttctttattatatcggaaatctgggaattcagttatccttgtcttatcctactccctgttctgt

SEQ ID NO: 35813 - DNA, 1023 bp, Homo sapiens
ccaggttcaagtgattcttgtgcctcagcctctctgagtagctgggattacaggtatgccccaccagacctggctaatttttgtatttttagtagagacggagtttcactatgttggacaggctggcctcgaactcctggcctcaggtaatccacccgcctcagcctcccaaagtgctggaattacaggtgtgagccactgctcccagccccaaacatgattttttgattgaatgcttaatgtctttctattattattatttttttttattatactttgttctggcatgcatgtgcacaacgtgcagatttgttacataggcatacatgtgccatgttggtttgctgcacccattaaaaattaattcaagatggattaaagacttaaatgttaggcctaaaaccataaaaaccctagaagaaaacctaggcaataccattcaggaaataggcatgggcaaagacttcatgactaaaacaccaaaaacaatggcaacaaaagccaaaattggcaaatgggatctaattaaactaaagagcttctgcacagcaaaagaaactaccagcagagtgaacaggcaacctacagaatgggagaaaatttttgcaatccgcccatctgacaaagggctaatatccagaatctacaaagaacttcaataaatttacaagaaaaaaaaaaaaccatcaaaaagtgggcaaaggatataaacagacacttctcaaaagaagacatttatgcagccaacagacacatgaaaaaatgctcatcatcactggtcatcagagaaatgcaaatcaaaaccacaatgagataccatttcacaccagttagaatggcgatcgttaaaaagtcaggaaacaacagatgctggagaggatgtggagaaataggaacgcttttacactgttggtgggagtgtaaattagttcaaccattgtggaagacagtgtggcaattcctcaaggatctagaactagaaataccatatgacccagtgatcccattactgggtatataccc

SEQ ID NO: 35814 - DNA, 1017 bp, Homo sapiens
tctctattatttatttattattattattattattttctgtcttttttttaagacggagtcttgctctgtcaccatgctggagtgcagtggtgagatctaggctcactgcaacctccacctcccaggttcaagcgattctcctgcctcagcctcccaagtagctgggactacaggtgcacaccaccacgcccagctaatttttgtatttttagtaaagatggcgtttcaccatgttggtcagggtggtctccatctcttaacttcgtgatctgcccgcctcagcctcccaaagtgccgggattacaggcttgagccactgcgccaggcctctctcctttttaaggcctgagataataactttcccttcaacttttttgtcagctcctgtaacttttttccttaggttttaactgttgttgtggtctgatgctaaaaaacacttcatctttaggatcaaaacgaaatgtattcttccaatataacattctgtgctcttgactttttaaaatatatctaaattgttctatgaaaccaaaaaacttcacttatgtcctgggacacactcttcctatgtctaattaattcaagtgcccttttcattagttttgacttgaaggttgtctaaatggaatcccatatggaaaagcacatccttttttgccttttggtagccagcctgagaataacatattttacattttatcaaaataattcctatgtcattactaggtttttatttgctcagaaaaactgagatttaaggaggctgaggcaggcatatcacgaggtcaggagttcaagaccagcctggccaacacagtgaaacccagctctactaaaaatacaaaaaattagccagaagtggtggcgggtgcctgtaatcctagctactagggaggctgaggcaagagaatcacttgaacctgggaggcgaaggttgcagtaagccaagatcgagccactgcataccagcctgggtgacagtgtgcgactctgtctcaaaaaaaaagaaaagaa

SEQ ID NO: 35815 - DNA, 1050 bp, Homo sapiens
tttgtattttttgtagagaagagatctcactactttgcccatgctggtcttgaactaccagccttaagcaatgctcctgccttggcctcccatagtgctaggattacaggcatgagccaccacacccagcccttggtaccagtactttatttagtctataggtgattctcatcagtcaggacagggagctaggtccacaattccttattcaaatcttctcggaggccagacatacttctcaacattccagattttagaatttttctaagggtaatgaaaaacataatactcacaaatactaatagtttagcagcatagcatgttagtattcactcttaagtgggataaagatgacatagccccatgttagctgagatcaaattttgctgccagatttatggagaaacttctgtgttttttgtttgtttgtttgagatggagtcttgctctgtcacccaggctggaatgcagtggcacaatctcggctcactacagcctctgcctcctgggttcaagcagttctcctgcctcagcctccccagtggctgggattacaggtgcgtgccaccacgcccggctactttttgtatttttagtagagacggcggggtttcaccatgttggtcaagctggcctcaaactcctgacctcgtgatctgcctgcctcggcctcccaaagtgctgggattagaggcatgagccaccacacccagccgaaacttctggttttaagagaaatgggaggccaggcgcggtggctcatgcctgtaatcccagcactttgggaggccgaggtgggcagattgcctgagctcaggagttcgagaccagcctgggcaacacggtgaaaccgtctctactgaaaatacaaaaattagccggacatggcagcgcgtgcctgtagtcccagctactggggaggctgaggcaggaggattgcttgaacctgagaggtggagattgcagtgagctgagatcaggccactgcactccagcctgagcgatagagtaagactctgtctccaaaaaaaaaaaaaaaaaagaggaaag

SEQ ID NO: 35816 - DNA, 1033 bp, Homo sapiens
gggcttttctttctttactaaacattgtaagatttgagtcaatatgattacatgctctaatgtacatcttctttacaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggtacttaatttctttaatggggttcagatagtcatattcagtcatgttcattctgttagtgaagaacttacagtatgtgtcatgccatgaagaacagagttcttcagaagaattaagaatatttaaggatctattaaaaaattttctggatactgattgttctttcacttgactttgattttctgatcatgtgttaaaactgctaatattaaagtagcatctttggtatgtaataaaataaatctagacagctttttaaggatctggatccttataaactgttttgttggattcaagttattgtttataccaagccttatcctacaaagggtttggcttacaaagattaacataatactgtttaaaaataaggaaatagatggaaataaataaattggtttaataaggagataatcatttcaagttagaagtatgatagccaaaaatgcataccataagtctatagtagatgtgctaaatctagctctaagtgcacctagttcaaagaaaaagactattcagttacattattccttgttagaagatgagaacaaatcaattgctgaggagccattcctattcctagtattaaaatttctcctgagaagtattaagaaaacattaggccaggcccagtggattacgcctgtaatcccagcactttggaaggctgaggtggatggatagcttatgcccaggagttcacaaacagcctgggcaacatggtgaaaccctgtctctacaaaaaatacaaaaattagctgggcatggtagtgcatgcctgtggtcccagctactcaggagctgagg

SEQ ID NO: 35817 - DNA, 1077 bp, Homo sapiens
ctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatgtgttcatgact

SEQ ID NO: 35818 - DNA, 1041 bp, Homo sapiens
tgacatttgactctaggaagcacaggcccaaaagaagaggcccaaggagggacattcttctttccctttcctacctacagtttctcaaaccaagtgtcagatggaaagcaaggggtggtatcatcgtaattatacagttgaccatagaaaataaatttcaatctcaaagtaaactcctaggccacccccagaatcttagagtttctcaatcatagaactcatttcttgtcacagtcttggttcttagccaatgtaaaacacccaactgacagggaaaattaaacaccttttaactcccacacaccttaaatgagaatttaaagtatctttcagcaaatgtatttataattttgagtgcttttagccatgttaaggacaaattttctccttctgaatgcagtaataatttggcattacccttttggcagtgtggtacaaagtcttataatctaggctttatggagctattgaggaacaacatagatggcttcatgcaaacccaaacaatgtaatagtagttcttttctctgtagtcggtctactgcctgtagatgtttattccttttttttttttttttttttttgagacagggtctccctctgtcacccaggctggagtgcagtggtgcaatcatagctcactgcagccttgacctcctgggctcaagggattctccggcctcagcctctggagtagctgggaccacaggcacatgccatcgtgcaggtaattaagttttttgtagagatgggcatctcgctatgttgcccaggctggtgttaaagtcctgggctcaagtgttcccccctccttggcttctcaaagtgttgggattacaggcgtgagccactgtgcccagcttactgattcatttatacaaacagagtgctctcagtgtgctacagaatgactatggagctcaagttctagtggagggtgtgagccacaaggaaacaagctagacagattgtaataagtactataaaggaagtaaatagggtgatgtaatagacttgggagatgctaactttagtcaggta

SEQ ID NO: 35819 - DNA, 1035 bp, Homo sapiens
ctaattatttttatctctgaaagataagaagtctattttttccttaatataaccataagttcattaccatattgaaaagtgtagtaagtaattccagctacagtcagtattcatattttttcaattgctttcttgcttctttccttccttctttccttcctccctccctccctccctgcctccctccctccctccctctttttctttacagttggcttgttcaaagagtgatccaaacagggtccacacattgtatttgctatgtctcttttgtctctttttatctataagttcccctctctttattccttttaatatactgaagaatttcattgttgctctgtagaattaacaacattctaggtttggctgattgaatcctcttggtattgtttagccagtttctctgtcccttgtatgtgcttaaattatctcttatttggtcagtggaagccctttcaaattggcttctaaatccttttgacatggcttcagtcatctttggtagcttccttgcttttgccatgtagagcctgacaatttgaggttgtcagctaagtgaacttgagatgagtgtatgtgattgagctttgtatgtcaatccaaatatttgccagctttctattattttcctccttctccttccagtaaggagtaagattcagcattatttgcctttcgtgtactgtaaattattactatataggtagtgtggaatctaagacagtgttcaaattcaggtctaggttgacttaatttctctaaggtcttacttaataagttactttgtagggataatttcattcattttgaaattatacatattcagatcttaggttgcaagaatgggtttcctaagctttaataaaccttatatagaaacagatactcttcattaaaaaatgtttatgctgcatattaagtaaaacatcaggagaaactgatgtcctgtagctaaagatggtctgaaccatatctaaatataagattgtactatataggcttttttgggttgcaaggaacagaatcacatca

SEQ ID NO: 35820 - DNA, 1022 bp, Homo sapiens
atttgtaattattgttggagattacagccttttgagagtgcatttaaattatttttgactcattttattgttttacagtaattagataggaaatgaactctatttatattcctttttaatcttaatgagtagaagagtagtaatgtttccattcaccaaagcaaatagctgtcagattatttgtatgaggaacacactgtatttcataaatgtgtgtgtacatgtatatgtaaggttgaagttactgtttttataggtcaaaaatggtagaatagtgacaatttcatgtggttaaattaatatgcatatattagtggatttgctgtcttaattaggttttgcttaggtaaatttataaaatatttaaagaataggaaaaaggtctggactagaggaagtttcatctgatgtcaaaacccatattgataactgagggctatgtcttcgacctttaaggtcaagatggtaataagcttcatttgcccaatagcactaatacattctatgttgattgcctggagtactatgttgagaaggattctaaggcccattctgcttggaggaatgtggctatgattgagtaatcatgcctgccatgggtgagggacaggaatagctacatgaaagcagtgtactgctgactttgccttaaagggtgggaacaatctggaaatgggataaggcttatgaatcaacttctctaagaaactaattaaattagattttaatcatgaaaactattagtagttgagaatttgctaatattaatgaggcacaaagaaaataacctttttaaaaaaacagtgcataaaaagacactaacatgactaacatgaataaagccttctatagcctgacacctaagcagaaagttttcttaggttttatattttagcataggaaatatgtcatagattctactttgtgttttagctgcacacttttaaatttatttagcctgtaagggagttatattatgcaatgtgtgacttaaaattttatctagaaaatgtataatgtaa

SEQ ID NO: 35821 - DNA, 1065 bp, Homo sapiens
atgagatctgatggttttataaggagcttcccccttcactgggcactcatttctttctgcttctgccatgtgaagaacatgtttgcttccctttctgccatgattgtaagtttcctcaagtctccccagccttgcagaactgtgagtcaattaaacccctttcatttataaatcacccagtctcggccagcaatttatagcagcgtgagatcagactaatacaagtggtttctgaagtcatgtctcctgaagcttgtggactgggtggaaaaatgaaaatcagcatagtgataaaaggaggaaatggatactgagtagatactaacaatactcagtgcaacattatgttgttataatgaaggttcttactgtgtaaatgataaagttcagcctatctttctttacctgctctattttacatttagtcaatatagagactacattacattaaaaactgtccttgtctgcctagtacttgttcatgagaaatctattttggtttggattaatagattctataattcatattatttatttgctactgtggagctaaatatctcatgtttttgttaaagcagaaagttttgtttttttttttttttagaccctctaatttgatgccttacaggtcaggaagttaggaatttccccatctgattacatgctgttgagtaattccagtaaatgatgctgaatgctccttggaatcattataaaattttgtggtaaacccatttcatcttcatgtcttgttattttaaatatttttagtggtttcttcttaattaattaattaattttttctttttggtatgattagagtgtgagggcttggttcttttcccattaagatagaatctgggaatttattgatttcagatgatcatgttaggcctgattcattcaaaaagatacaatatattacagaattttctggtaaatctttagtctttggtatttaatttaagctgtgtgactctttttgaatttagtgctgtaaagaagccaatgatatattcttttgctacatagcaatgagttgttaaagccatttttagaaattag

SEQ ID NO: 35822 - DNA, 1223 bp, Homo sapiens
tgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgt

SEQ ID NO: 35823 - DNA, 1095 bp, Homo sapiens
tagacaataaatgtttgaatgttatatttaagtcataatagttaaattaccacataacccagactcttacctcaatcattcctaagttatcatttgctaagttagtactctttagtgttctaatagtaaccaaatttatttagatgatcagatgaaaaaaattttgaatatctttttgatagattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagaggtaaggatttattgcgattatgtatctattgatatctcgtgtaggatttgtcataggcaggttgagtaatagtcttagtagaataaaatgtttcaggtggatctcttgcctttcaagtttcctttttgaagacatcacctctcaaaaatctttttagctttttaaatctgctttggtatactccataaaggtcagataaccattttaacaataacgggttaaagtgtcattttgcctgaccatacagatctatatgtttctcttaatataaaaattctgaaatagtttacgattgtaatttgtgattgtaatttactagactagtcataaatcaaggaagtttaacagttatcaactgggccattttacatatttgcagttcttttggagaaaaacaaggatattttgagtattgtctatgctttcatgtcaggggttgacacactttttctgtaaagatctggatagttaatattttgggctgtacaggccgtaagtctctgttgcaagtgttcagctctgctcttaacagtgcaaagcgccatacacaatttataaatgaatatgtgtcggctgtgttccagtaaaactttacttgtaaaaacaggtggcttgctcgatttggcccatcattcgatgatagtattatcaaatcattttgtgaaatcacctcattttaagatttttaaatctaatgagtgtgagtaaaatacatactaatgttgctgtgaatttagtatgtcttttctttttctttaagtttgtgc

SEQ ID NO: 35824 - DNA, 1056 bp, Homo sapiens
ttgaaaaagattaatcatgagattgaggatactagaagggaggaaaatattatttgtgcagaaataaaatatagggttagaatagagatgataaggaaactttgaggtcttcagggattttgttacataaagtatctaagttgtaggaggtatttgataccctctaatgtctaatgtgattgttttgtttgggtaagatatattctatgtgtaaatttcagcataactttcttctacaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataaatgcagaaatcccaaataaaatgctaacatactgaattcagtaattaaaagaacccactgcagctgggtgcaatggctcatgcctgtaatcgcaacactttgggaggccaaggtgggtggatcgcttgagtccagcagtttgagaccagcctgggcaacatggcaaaaccccatctctagtaaaaatacaaaaattagcctgtcctggtggtgcatgcctgtaatcccagctagtctggaggctgaggcac

SEQ ID NO: 35825 - DNA, 1329 bp, Homo sapiens
ctgacctcaggtgatccacccacctcggcctcccaaagtgctgggattacaggtgtgagccactgcacctggcctatttacatcttatttcttagcaacgtttagagtttcttttatctccatgcatttcctgtgtatgcctacatttttgtgtaattggaaatggactttttctttccaattatatacttctttatagtttttaaaagtggctttatataggtgatactgatagctatatatttatcttgtaaaagaccaatttaagttgttcattagagccaataatttgtcagctgattctcatgaggtgtatataaccaatctgatttgcgttcttctgaaactgcttatcaaatagatggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatatatttgtaagcacattcaaaattagtttgatttcaaccttgtgttttgtatctgaatgataagcatcagcattataactaaacagactgtgtggttaagattatggacagtttttccctctagttatctaattttcataattacccccagaacgtgagaacattatttttatgatcagaaagtattttaagaaactagttgagtggactctaatatggaaccatcaacatgtatcaaattccacttaattataagcaaattcattatgaaattatatttaaaaaggcatttcatgattacatttgttatttaagaaaatgttatttaaagaaatttacataagtttcattatacatgtattttagcttactcattctggaaatggaaaacttagatactaggcaagaaggctttagattttttttatgagatattttaatagaccagtacttaggtcttaatatttgtgtttttcaaaaatttatgttaaaatcctaacccccatgactatagtattaggagatagggccttttggaaggtgactggagaggggcagcaccttcaggaatagaattagtgcccttataaaatagacccaagggaactttttcatcccttacaccctgtgagaacatgatgagaaggcaccatgtatgagccaga

SEQ ID NO: 35826 - DNA, 1069 bp, Homo sapiens
tttataatggtaagatgtctgcaatggagagatattggacatgggggaaagtaacaaaacatttaagcaggaactggctttagtgggtaattgggatcagtattgaacctatacagtggaagagtgacatagcttgaatgatatgatttggaggatacaaaggcctcttgaaggaatagtttgtttctgttccataatgtctggggtctcaactggtaaaactcaaatgctgggagtgactccatacctaggggctgggatcatctggagccatcttcattcacaggtctcctattgatactggctcttggctggaatctcagctagggctagttgaccagagaacatacatgtgtcctctccatatggcctgggctttcttataggatggtggtattagggtagttggactttttacatggtggcttaagactccaaaagccaatgcgtaaaaagatctaatgggggttgcaaggccttttctgacttagcctcagaagtttcgtagcatctctattgtaatcaattcgtcaaagcaattacaagcccaccaagatccaagagaaggggtatagaccccacttcttgatggcaggaatatcagagaattttggatgcatgtttaaaccaacataagctacgtgggttgaaagtcaccaaaatcagaaaggcactgtctgtgaaaatcactgcctgtgaaaggaacttagctctaactaaaccgcggctgctgctggcaatccaagtgttgctctagagatttatctgaggttctggctcttgtttcaggaagccctcctgaaacattgataccattacattagcagggacaataaggaccctcacctcaggctcattacaggctttccattaccacctaaaagagagcagcaaaaattaggggcttcctgcaagcttacttgcttgtcatcacatcaatctactaaaatattcaatgtcaaactactcaattatcaatgtatgaaaaaatttttcaggtgtaaacactacttttagtacaattttaaggaatctccttccttaatgtaagtcttgttatataatatgg

SEQ ID NO: 35827 - DNA, 1022 bp, Homo sapiens
actgagaaattatggcagcccatcatatcttctttccaaaactgggattcaatgagtaaatataacactttccaattgacacaaagtaaacaggaaccataattattaagctctcaactgggtgtggtggctcatgcctgtaatcccagaacttttgaaggctgaggcgggaggatcacctgaggtcaggagttcgagaccagcctggccaacatggcgaaaccctgtctctactaaaaatacaaaaattagccagtgtggtggtgcacgcctgtaatcgcagctactcaggaggctgaggcaggagaatcgcttgaacccaggaggcagaggttgcagtgagccgagattgtgacactgcactccagcctgggcaacagagcaaaactccgtttcaaaaaaaacaaacaaacaaactgttaagctctctagacctaaatatgcttatgaaaaacacattttgctgctaaaaaggaatgggacaataacaaaaaaagagaattctagataaaacttgttagaacaatttgtcttgggaaattctgaaatgaaaacctttagtccttgactaaagaggtttccatctttggaaaatataccaaattcaagataggctggaatcgagttgtactgtgcatttgggtcagtatgagagtcttgtgctgataatttgttcctctcctaaacacggaaacgttttattaagtctatccaaaggacttttgcaattttctagtcaaatctcttccacgaagtgtttgataaacagccattgaccctcttcagggtcaatctggaggagtagggaaaggtgggaagtgtgggggagggtttcccatgaagaaagcatctgacctatgtcttagacatagagtagggtgccagtggatggagaaaggaatgaaggacatccctggttagttgaatagcacaacatattgagagagatgattgaaacatattgtgtttgcagaaaatccagtaattttatattgtggggacaaaacttaggaaaagatgta

SEQ ID NO: 35828 - DNA, 1028 bp, Homo sapiens
tgcttgccttttaccttccaccatgattgtaagtttcctgaggcctccccagccttttttctttataaattacccagtctcaagtagctctttatagcagtgtgaaaatggacaaatacaaaattcattaaaatacctccaaatttaatatggaattatgtttacatttaagttatcaatatcaaaagctctatcagttgtcaataaatataactgggaatgtcctagaagtaaatggttaccctttttccttcattgctgcaacaagaaacattgttctggtggaacatttcacaaaattatgaatgttttgaaagaaagaaatatgaaatcccttggattttactaatatacacagttctcataatatacaacttatttaccatgctggagaaatagcaaccataaaaacagctgcaattaaaatgttactaaagcttttgtacaaatggtagattattaaaaacaaaatgttataccgataatttaagggacaatattgagtttctgtatttttccctttaaaggctgtaggtttatgcttgactaatccttttgacagtatccctggcaataatattttttgaagtagttggtgttcaatatttgtaatttcatgtttcccaacagtctgtttttccttgtttatttaaataaaaaactgtaaaacagccacgggaaaatcgaagaaatataaaatctatcacagtttaagtaatgtgtctgtgtcaaagtaaagagttatgtctgaggacacaactgtctcattcagaggactactgtaatttaaagagaatattttattctactgaaagtcatatggattatataaatcctgcatcctgcacctagcaccgaatcccagctgttaacataatatttagctgctagtctaacgctattaacacctaggaggatctcaaaaaatatttattgaatgtataaattctggctacttaacagaaacactgtagatgtgtgtgtgtgtgtgagagagagaaagtgtgtgtgtgtgtgtgtgtaagtgt

SEQ ID NO: 35829 - DNA, 1054 bp, Homo sapiens
agcaattaaattacgtactagttagttgtctctccaaacaaggttatgattaataatatttagctttccatttttatataggatataaaaaagatgaattgttctaggccatgcagtatgtattttatagcatactcttgatcttagatctgtcactaaaaaaacaaatgaatatatgtataaattaatatgagtgttaggtccttgaataagaatgagatatatattttctccccttttggcaatctctatcacagaaatgggccaagttgtcaccacatttagttcatgggaaatttgttttcttttgaaagtgctactctagttttgtcgtatgaaataacaacaatttgtatttaattagtctagtacttcagaataggccttcaactgtttcaactatttggaaaagtcactctaatttttgttatcccagaaaatctttgtattctattaagaactaaaatataatttgccagtccttttattattactattgtttttttaaaactgcaagatatggtcatgagtatctggaaatggctcagaaaattaaaaattatagctaataatattgcattatttctcacatggttacattaagaactcacatgatactaggtgccacaagttttacagaaaaaaaaggcccctaaaacaaatttgaaagagcagtttctcagtgattattaaaagaataatacacttaaaaataattgtgtaatgataatttttaaatataaaagtgatatttaacaaattcagctaaatcacagttctatgaataatttatttcctatgtgaattcattaaacatataactcaatactcatttagtccttgcttagctaagttgaccaaattctcatgtagcaatattagaaatggctttttgttatttggtagtttggcatttagaaaaaaaatttcaaagtaacacttttcatgctatctactggccactccatgctggatttcaagaaaaaaagacaagatttccatacttgacctcttttttttaaatatatgtcagctttggattatttactctatc

SEQ ID NO: 35830 - DNA, 1032 bp, Homo sapiens
ctttcacttgcagtcagacatggagttagtggtagaaggaacagaaggggtaacctgcatggtgacagctactgaggggatggataggaaagcaggctgagtccctggggccagtggttaccaaagccaaggagagagcaagtggagcccagtgggcctggccatggactgctctggaattccgagtgtgaactttcagccaggaatgtattgtgaaagtataactctgaggttttaaaagtacacaaataagaattgtgttttgtaaaaaaaaaaaataaaaaaaaagttagaagaagaaatacgccaaaaagaagaaagtaaaaaatacatgacttctgtcttctgttaacatattaaaatttattcttttagatttttatgtgtctatatacatataaaatatatatgcatccccaaattgtattaatactcttttgagacctcacatttttttcacccaagaatataacattaatttctttcctttagaaaagacatgagactaaagaatgtttattaagttgagagtttcccaattaaggagtatgactctgtataataataaagctaatgttttattagaaattataataaaattagaaatttaatatttggcaggatgtgtgttgcctgcatatgtacaccctttattatatgactggacactcttttgtgtggtcatggatatattggcatcttttgaagtgtatcctttttgtttcaggagcttccgtctagataaatagcacgcgtgacactaataatagtaatggaatattccttaaagcacaggctccttcctctttctcctgagcctttgcacatgctgcctggaaaactcacccacaacctgctttccatcctctcctttggctcatccctgctcagccctctttgttaagatatttgctaagccagattctctgagaagcctttcctggcatcttcgtctgtatgattctgctaggtgtttctaaaaccatgtcgttacagtatattgtaatcgcccatttatgtctgtttgactgt

SEQ ID NO: 35831 - DNA, 1083 bp, Homo sapiens
tggccttatatagatagctttgagtaagtgtgtgttaaatgactgcccaagtgaatggaaaattgagaagggcctccagcactggagtatggaaaggagcactgggttcattgactctttggatttctcccttgctacgtaagtccgttccctaaaggacatggatcttgacagtgttggaatcttcagaaataattgcaataccagaagttatttaagattttaccattttcaaagtatttgtacgtaacactttcatatgtttttgtttcctagctacctcagtttccctgttggcttgagcagattagtgtaaagaggtggtgacatcaggggaaacaggtttactcagccatcttcattaccatattatcactgacttgaggctcctcccacatgcattccttaagaggttattgtgggtcacccaaattatttacagccatctatattatcaatatattgaaacacaagtgtgctctatggaataaatcttaggcttgaatgtgattatatgggcctctgttgaaatgcagattcagatctattgaaagatctgagatgggccaagatgggatggacatatttttaataagctcctaaaagtgagctgatgctgcgggactatggaccatattttgagtatcagtatcaagttgctaggacataagaggtctcggttcagctgaggcctgttggtttctactctgcctgacacattgttgacaggataacatcatcacccactggatgagtaaaagttccattaacttgcaaaaaggatagatagcatgactcatggaacctgtcttcatttaaaattagtgaagtaaactagactaaatagtcatccatttttaaaagtccaaatattaggcattctggtgagaaacattagtctttgatggttcacttgttcaagaaaatagtgggatttaagtcttaaatcattacttgtcctctttcctttataccaaggcccagaagtgccagaatcagcttctggaaaaagtaattgcactggtttaggggtgaaaaggtagtattttttatctgttgctactatgctgaaaagtgaactta

SEQ ID NO: 35832 - DNA, 1060 bp, Homo sapiens
tttttttctggggctaattattgtgctttcattttattacatctttgtgctcctgatgtattttctcagttatttaaaggtgttgaaacaagcaccttccattagttcattacttagtgcacatttttgctgctgttatcatagggagatccagttgcatgtctggtttaatctgaaatataaattgattgtttttgtactttcatggatcttttcttagaatccatctcccactgacttttatctatattttgaggtgagttttgaggcagtggttgcttttgccttagaactttatcagcaatagtagtaaagaagtagtcacatgcttcatgcttcttatttatatctttttttatttagaaggaaaccttttttaaaaaagttttttttctaaattaaataaaccttttttatttagaagaatcagagattagaatgggttcaacacctgatggtctgatggtacttagatcttactgggtcctgctaattctcatttctggtctggtaggaaccttttagagagaaataaggatcagcttgtttttgtgtggatgctcttttgttgtgtgaattgtcttggacttcattctcccttttcaaagtatcaatatttaaatataacagatttagcagtgtaactctggtgtagacttttgaaaaagaacacaatttttgtttctgtgtctgcaacctacatatgtgattgaaaatttttatatctaacaggttctacttttgatgacttattacctagccacagtgtatctgtttctatctgtagctttataactatctgtcaatcatttatccatatctatgtctctatctgtacataaacacatatacatatgtgcctgtgcatacaatcaaatgtgtatatttgaatgctttcctagcctcagcatatattagtgtgtttaactaccttgtggtgaattgtttgttgctactggtcgtctgtaaaatagcatcttgattcctcctctgataaacacaattatgttattatgaaactttcctctctcgttttacctccttagagcttgggaattag

SEQ ID NO: 35833 - DNA, 1032 bp, Homo sapiens
tttataacttacgtgtttgttcttcctttccaacatttatacctgttcttgttggcactggaataatttttaataatagatatgaaagttggcagctttgtcccttttttcaaaattagtgagcatgcttccagttgttttcagaaaggaaattactctttttctcatttaccaagcttttttttaaaaaaaatgaatattaaatctttatcaaactattgtttggcatctgttgaggtgtcatatctactttttcctttaaacaataaagtaacaaattgtattagcaaataactcaatgttgagctatgagaattatgtgttttgtcatatactttagcattaaagaccttaagttgctgaatgaattaaacaactctttgagcatttgctagaacttgcaaacaaatctgtctgagctttttagggatggttctgggtcagttgtcttatttttctgccatgattattatctcttctgtttttctgtttcttagtcattttaaaatatgtcttcttactgaaagtttctatgttggtgaaatgtccaaactttttagcaaaagtatagtatttggtccgtaattgtaaaattcttccatgtctctggttatttctcctggcccatttttattgttcatatttgttcttgttcttccgtccgttggtttgtcttccaaatagtttagccatttaaaagattctttcaaacaaatagctctctttaatgttgcattcaatttctaaatgcagtaatcttgatactacatttatgaattctttctaataatataccttaggcttcccctctgcctacttttcctggattatttggatcagttattaagtaatcatctaagtttgaacatatgaaattttctttgctctatgaaaatatatcagtattatcctccaaagtcaagattacatcattctagcttatgtccctaggaacagatttgtccttttataattgtgatctattaattaacttgtaccatctattgaaatttatttcatacttttagtgaa

SEQ ID NO: 35834 - DNA, 1053 bp, Homo sapiens
ctgctgaaattagattaaaaaatgtttggaaattcagtcaaatgaagtatctaaagtcatatcagtgttttgaattttttccccttaacccttttcacttgtaatagttttgatccagtttaaatcttaatgaatgtaagccatgttcctgcctgctctagattttctctagctgtagaggatatttccaaaataaatatcttcctagagtcttcatggtacaaaggtgaatcacagcaggactagtttgatttacttaaatgggaatgaatttactgtctagtttcaaatacttaggcttggattcaagggaaaagaggtgggtagttaggcagaaggtcttgaaatcatcttccttgcaaagttctaagtctgttgaaaacagactgttctaattagctgttcttttacctaattggggcttacaagaacttaatgaagtttgaagagcaaaagtaactcaatatgcacaacaggctattaggagtaatttttttttttaaagcaacgtctaatgagaaaggcagctaaccacatctaagttctctgtaagagatggaagtaactgagattgcctaggcaaaatcctgagattattgaggcaaaatcctcttaaagaaggctgaaagaaggtgtagaaaaagtgagtgatgatagatatattacttaagtaggtaatgacaattctacctcaccattctatccaaaagcctactactggctgttgaatcatacatgtaaacattgatgataattctgatttatagtcttttgtataggaagtgagttaggtcttggggcaacatgaactttgcgatcagtctgaataagtctcatcttgaatcattcaacaaaacgcattttatgtttttcattgtaaatgtacctccctatatatttatgaaaataaaattgatcagtgtcattggaaaataaattgaaattagtatttttagaaagggaattacagatcagaaaattcatatttgtttaggaaagaaatgattctgatagtttctttgtgaaatttaaaacttccatttaatataaaat

SEQ ID NO: 35835 - DNA, 1085 bp, Homo sapiens
ccctctggttgctcagaccataatctttggattcatccttaactcttcttttttttcatacctcaaatccagtccacccgcaaaatctgtccactctcctagaagtgtgaatccaaaatgttcatcacctccacggacgaagttctatatatcttgcttcacttgttgcaataagttcctgactgattttcctgtttttccctttgctctttgaccagttgatcctgcagagctcaccaggttccttccctgctctcatctcctgacatgagaccttgttcagtcctctccctacactgttctccaagctgttcctaggatatttcagcatattttctcttcaggggctttgcctttgttctttgctctggctgggacatttttttcctgcttgttcttatctaacatttaaacctcagcccacatagcctgcagcccatatatttttccccatctttatttttctccagagcctttattgccatctagcattgtatctatttttctatctgtttttcatcttcctcctcttactggacttcagacttcatgggtgcagggatattcgtgggtgtgtttttactcttccatctgaaatgactggagcgatgagtgcaagagatactctttaaaccagtgaataatgaaaaatgagcgacttttttgagagaagttattaatttaattaatatagttactgatttaaagaaatatatgtatatatgtatttttatatatttagttaccgatttaaacatatatttttatatatttagttacatatttagtttagtatttttatacatttagttaccgatttaaacatatatatgttagtatatatgtatatatgttatatgtacatacatacatatatatacacacacatatatacacatatatatatacctggtaaaagtacgaaccacgtgaaaaggaaatctcctgtgccttctcatctcccattgttttattctaaaaatgatgtatgtagatgcaaacatgttgtctttcttccacttaaaaaataatgcactaactgtcctacatgtggccagttcagctgttgcttactttggagatca

SEQ ID NO: 35836 - DNA, 1066 bp, Homo sapiens
tgaactgctgaactctgctagagaaaaccatgtggttatgtgaataacagttcctgcaaagctgggcttctgtctttgatacttggcaatcgttctatgtgtccttgactaatagactttctcatttcccacatcaacatgtgatatgagaattatgatctcattctcttctcctgtcatgtgaaatgtcctgggttacttgctctgagtggtttgacaaggcatgagattccagtctgctgattcccaaatatgtttgcacatgtctgtcacccacttagagtaatgctcattcttactgaagcaaagccaactgagaaacctgagaatctatatttttgtgtatccggcattaagcagatgtttgtaactaaggttcttattttccaagtgaaattaagaacacccagttataatttggtccagttttaggtgttaaccaaaaaatgactgaggcaggtctcagtcgataaagatttatttagccacggttgaggatgggagatccagggagatcaaaaatgcgtctgtgacccttttccaaaagggattttgggaacttcagtatttaaaggggaaagagcaagcaggagggaagaagaggaagggcaggcagtgaggcaaatggttacattcttatgaggttctgattagcctcagtaaatctacattttatatgtgaaaagagggagtagaggaaaaagttacgtattaatcacagggtaggcacaaggatgtctctggtcttggtccttgctctcgccctgtgaagataagctaataattgacattgtcaggatgagattcagcagaacttggttttagggctagtttacagtgggtatgtctcctgaaagatttaggggcttcaaggaatttccttgtgagggaggccatctggggagatgtgtgaccttctattgttgtggaaacctgtctcatgggtgaggctatgacacggagctgtgaaattacagctatccgtttgggaacaaaaggaaagcagtatggcctgactcagttcccaaacttaactttccctttggcatagtgagtttgggagtcc

SEQ ID NO: 35837 - DNA, 1066 bp, Homo sapiens
ataattaagaatgggcagagggattggtataaactactcctaaagttttagaactgggaaaaataagaagagaaagtctttacttagctgggattttcatgagataatgaaataaaaagagaatgttaaatgtctagcaaatttatggagtaaacttcgctgaaacatatgaagccttactagcgcttttggctttaagcctttgtgagctgattaatgggtgttctaggagattattttgcctaacttttgtaattgtgattctaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaa

SEQ ID NO: 35838 - DNA, 1027 bp, Homo sapiens
gaatttctgcttccaaatcactgggatgcttgaactataccccagattttcaaaatcagaatctctgagggtggggctataagcctgcattatatataagcaacccatatgattcttttctgtttgtttgtttttttgacaaggagtttcactcttgctacccaggctggagtgcaatggtacgatcttggctcactgcagcctccaccttctgggttcaagcaattctcgtgcctcagccttctgagtagctgggattacaggcatgtgctaccatgcccaactaatttttgtatttttagtagagatagggtttcgccatgttggccaggctggtcttgaactcccgaccacagatgatccgcctgcctcggcctcccaaggtgctgggattacaggcttgagccactgtgcctggccccatatgattcttaaacagattaaagtttgagaaacactggactaaggcataattattatattagtgtgcgtgagtgtgtgtctgtctatctgtgtttgctgcatactgtagataataggcacctcaagagcaaagtctgcatcatcttcttatcttcgtcagtggccagcccagtggtttactgtggcacagtaagtcctcaatgagcacttgttgagtaaatgtttgtatcatattgagtccagttttgtatttttctctgattattggacatttaatgagtcttttttctataactggtattttaaaaattattttaagtatattactttatactttattctctagtattcagtcttttctaatctttttttttctattttggcttatgttttatcagtgactaaattcataaataattctctaaaatgaagagattggaaaggacatatttaccaagccattgcttttgctaaataacatttaatagggttttaagtataatgcatgtgaactctttttaaagtttgatcatctttcagtggattcagaaaagaaatcctgtcatagaaaatttggaaagacatttccttttcaaagaaaata

SEQ ID NO: 35839 - DNA, 1026 bp, Homo sapiens
acagtgaactcagagaccagttctatagagttcctcaaggttatcttcatgactgctaatatcattgttataacagtgtggatatgctgaacaatagaatcttttttgattgattgccaaagagatttttctataatgctaatttaataatctgtacaatatgagaatcacttcaaataaacatttccatcaattattttttaaaatttttgtagatttgcagtaccgtgtcaccctagattcactaagacaaatatcacgaagttttttctctggaactcaagagagaaaggttcaaaggaacatcacagttcgaaaatcagaatgcactaagcactccttctacatgttggcaagtaaatcatatatcgttgctgccttattccaaatcaagaatacagtagagatgtcttatttcaagtcaatcaaattcttactgttttatttcaaaatgcacttatgatgtcataaaggaaatcttgtttgttcatttttatcataaaatcgcaggtctaattttctcatttccaaatatttgtaaaactatctctagtcttccctgtctgcattatcagacatccatatattatggaacggcaggaaaagacacagtgttctagttgacaagaaaccttattcatgtcttcatttctttcactcattcatttattccttcaacttgaaaacatttaatttctgtgggccttgtctgtcagttgtggttggtaagtgattaactgctctgggggcagactgctgggctgtatgctttctgggatccatgtaactacatatctcgccgtttgattttagagcgaaggggaaaattatctggtattttctatcatctgtaggctttgtgctacttcagttttttttttttttaattttagtggatgagggagttttggaaatcaaactattaatgtttagagatggctggtaagccagtgtgaatcatttaaaatgtattttgttgggacactgtgtatatggggaatgttcccaacagagggcaggagtttc

SEQ ID NO: 35840 - DNA, 1038 bp, Homo sapiens
atgaaactacattactatatcattatcaaccaaaatccatagtttacattagggttcactcttggtgttgttaaaatccacgctgtggaatttgacaaatgtaaaatgacatgtatccaccactatagtatcatacagtgtatattcactgccctacacatcatatgtgctctgcttattcatcctgcccgccccactagcccttggaaccactgatcctttttctgtcaacttgtttaaaaacctagggagtctataattaggtttaatgacaaattgtagtacattttgtgcatgtttactaatttatttaactagtacattgttgctaaacaagttacagttttggggggggttggtttttaggtttttttactcttagaaatagtagtgcaataaacaggcttggggtactttgttccacatattgctgattatctcctgaggctatctatacagacaggaaatggatggggtaaagagtgtgcacttggtacattttgagatatagtcccacaatcccttgaaggagggcgggagagttagaactactaatagctcatgagattgcctgtttccctaggtgtgtcccagcactgagttttatctagctttaaaattttagcatttattttttaactcttactaacttgctctctcttttacctttgactcaatactataagaactgcagaactgcttcctgtagtaatgttacctgctggttgaaagacgttcacatgaaaggagaatactttgttaatgtgactaccagaatttggaacgggactttcgcatcagtaagtatcagttttatttgttagatttatcaatagcaaggaaacataagtctgcactgacaagttcttcccctttgacaaaataagtattctggctaatgtctgcaatggccaaataacccagagcattttaccctgaaaggcagcacacttccatcgctttccaatgcccatccaatttagcagtgcctcagagtcatctgggatacttgtgaaagggtctgtttctcagactcca

SEQ ID NO: 35841 - DNA, 1033 bp, Homo sapiens
acccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatg

SEQ ID NO: 35842 - DNA, 1038 bp, Homo sapiens
atacttatccatttatttcagttcagggtcaagagtggccagagccagccctgatagctcagagcacaggacaggaaccagccctggacaggatgccatcacattgcagggcacactcaaacatacccacactcactcagaccgtggccatgtatacatgccagttcagctcacatgtacatccttcggatgtgggaggaaactggagtacacagagaaaacccatgtgaacatgaggagaatgtgcaaactccacacagatagtatccctggccgggaattaatttcgttttttctttttcatcaacatataacaaaatgaccttgaacaagctgatattattcaaagacctgctgtacttactatgcttcatcatgatggcctgtttacttgtctgtgtttctctttagacttaagttcttcaagatcaagaactgtttcttcacctgtttgtttttacaggctaacacagtacttagcgtgtaatagatacttcatataatagatacttggtaaacatctgtggactcatttgattatggaatcatatagaaatttaaaactaatgcacagcagcatctccataagcagtatagcatatattttttttgagtcggagtctcgctctgtcacccaggttgaagtacagtggcacgatctcggctcactgcaagctctgcctctcagcctcctgagtagctgggagtacaggcgcccgccaccacgcctggctaattttttgtatttttagtagagatgggctttcactgtgttagccaggatggtctcgatttcctgacctcatgatccgcccgcctcggcctcccaaagtgctgggattgcaggtgtgagccactgcacccggccttatatatttttttcttatgaaataactgtttgggttttcaatatagccatcatggacaatgtcagagattaccaaaaaatgatgacttttatagctttatgatgcttcttatttcatactattgaataatactattgcaaactttatcttacggcaatatttactaaaa

SEQ ID NO: 35843 - DNA, 1063 bp, Homo sapiens
cattttatttcttcatatgtatgaagaaataactagcaagcaactagcaaacaactagcaagaccagcaacaaatgagtaataatgttttgtgaatcagtaacaaacagaattttggcagccatcacttataaaatattttagagtgtggtctgttactttacatgcaactttatatttatgcttcaatagcatacattttgtaatgtttccaaaacttctgatagaaatgagtaattgtatatgtgtgcttttcattttatatctggtttaccattatcagtgtttcttaactaccccctttattattgtacagtattttatcactcaactttgagcctgtaagcccaatctaagtaataggtcacacttaaatttctatttgcaccattaaagatacagacaaataaatgtataagtaaatagagacagtttggaaaattcacatcttgtgctgactggttttattttaaaattatctcttcagtttacctactgacattgtcatcatcctgatctaggttacatcatctttcacctagatttctacagtagtctttgacctgatctccctagactctttaatcctaatctgattaattttccttaggatgccaaaatagtctttgaaatgctggtattgtcaccctcttttcgtcctttggtgcttcctgttgcccttagagtaaacactaaaatcctaacatggtctttgacgtcttgcctgatttagctcctgccttcctctctaggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggtaatcaaacaccacttgcttagtcaagtataaaagaaatgaggggcagggcatggtggctcatgcctgtaatcccagcactttgggaggctgaggcgggtggatcacgaggtcaggagttcgtgaccagcttgaccaac

SEQ ID NO: 35844 - DNA, 1062 bp, Homo sapiens
tacagaaggcacagatatggaggcctgactgtagatcagaccagaatgtcactatggttttccagctgaaatcaattggttattatctttggtacatggcagacattttcttgaaaatgaacctgtcacttcaaggaggtgttgcccatgatacacttcaagcgcagtgatagtttttcaaccgttgtgcccatctctccttcccagaacggtctttaaatactagaaagatgtcaagctcaatcacatccatggcagaattaagttctataaaaattctaacattgtgtactatgctcaatacttggttgatgggatttatctgccacaaatctcagcatcacaaaatatacccaggtaacaaacatgcacatgtacctcttgaatctaaaattaaaaattgaaattctgtaaaaaaaagaaaaaaaagactgttctagtgggattggtaatgacactaacggatgtgatttttgatactgtgtaatgcaatatattaacgtttggaatatctatatacctctatgaactagtatttttcgtatgaccagtgcatgatataaaatcatgcatgggtaaaagtttcctttaaagtacaaaatagagcaatggattttaagtaatcaagtatgaaaatattaaggctatgaatattttgctcctttttctaactacatatctgtatgataatgagttttcttcatatattgcaataaaaacaatccaccaaaacagtttgaatgcaagaacagatgttagaattcagctgtcctccattaagctagatagtagattttcaaacgagtgccaaaatgcaaatgagtgccactcttctcacttttcagttttcaaaaatagagttttttaaattaaaatctttatattattacataactggcttattttacattaaatttatattgttttcttcattttaatttattatgtgatagatatttatggatatacaggcatactttgaagatattgctggtttggttccagaccaccacagttaagcaaatgccacaataaagtgagtcatgaaattttgttttggct

SEQ ID NO: 35845 - DNA, 1034 bp, Homo sapiens
agcaataaggctgtctctttagccttcttatcattcatgtgttcactggaatagcatttttaattttcctcaataacttttcctttgcattcacaacttggctgtttggtgcaagaggcctggcttttggtctgtctaggtttttgacatgccttcttcacctagcttaatcatttctaaatttttacttaaagtgagagacatgagactcttcctttcacttgaactcttattgttgggttattaactggcctaatttcaatattgttgtctcagtgaatagagaggcccaaggaaagggtgaggtacgaggaaatggcttgtcagtggaggacacacacaacctttattaatttagtttgctatctaatatggacgcagtttgtggcaccccaaaacaattacaatagtaacatcaaagatcacggatcacagagcaccataacacatacaatgcaaaagtttgaaatattgggagaattgtcaaaatgtgacacaaagacttgaaatgagcacacaccagtagacctcaacagagggttgccagaatccttaaatttgaaaaaacaaaaacataaaaaaacaaaaaaaaagaagcaccattaatctgtgaagcacagtaaagcaaagttcataaaatgaggtatgcctgtatcttttataaacaaaaccttggagtcccagtagtttttaacagtataaaggaatctcaacatcaaaaagcttgcgaatcattctcctaagtcttctcttttctgggttaaacatcgccagggctttgatttatttcatatgagttccagttaattaatcatcttgattgccatccagtttgaatctcttttaaaatgtttttgccagaatttttcatactacagatgtggtgcaggttgtggtggggattattgcctttattccttttaatcatcgcagttctagtaaggcaactttaaatttaggttgtcatacttatgtggatttcatggagagctaaaacctcagattctctcttttgtgtgctgttatcaagtcgt

SEQ ID NO: 35846 - DNA, 1030 bp, Homo sapiens
aagataaccttaagttaaaggcttacttttgctttgactgtttactttttttttccccctctaaggggtcagttttcttttggtgagattactttcttttggtgtatggcagtgctatctctgctagattactggaaggagtagtgtctgcgattggggttatacagctttctagcatctcaagtgtctgttttgtctggactttactcacgcagcattcttgtgcaaaaatttcaaggctttagtctggagcactgggtcaaaggatatgtctctttgaagggtagacaggagttttttatgttttattcactaagtagtatttcattttacatcaaagaatagcagcctttgagaacctaccatggtggcagtttagcgtgtgggtttttttctttaagactttcactaaatatgtataatgtttcttcaagtgtttcatcctacaaaatgcctatttttattcttagatgaaacttctaatataaaaagagaagaatcatgactaaatataaatgtttgttgcaataaattttgttttaaaagcaactatagtttttttttttttacaatgtatttccctgtgtcagtttttacactacccacaagctattgaaaaaaaaaaaaatggatgaatagcctttaagattgcagcaatactgttgcttaaaattctaaggaagcagtaatgactagtgattttggaagtgtagatttcatagtgaaatggtcattccttaattgttccttttttagtactgtcatgtgtgtatgtaggagagattgattttgaaaaataccagactcaagtaatggaaaatgttaagacttcttgaagctagaaggaaagctcttctttttgtactttttgtgtaagttaatcagtaaataatcatataaaaagtgattgctttacatgtttggaagattattacattgtatttcatatttttgtctcatgacatgtatctataaacatgaactaatattaaaagttttttatgtttataaataaaacatgctcttaaat

SEQ ID NO: 35847 - DNA, 1051 bp, Homo sapiens
ttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacagatacattttgtggtgtctattttaaatgttttttgatgtctcaaattgagcatgtttcaatttcctatatagagagaagatttgaggtgatcatacctctgggaaatcttggtacttttagaatctattaattaacaggaatgcttgaaatcaactgcaacattgaagttttatatttgctttttatagccattctcaagttaatatggtttataaatcaccagccaacattattaaaatgttgtcttagaaatggttttatcataggtagagaagtacacgataacattgcagtcttataaacttaaacccctatgtcgtcattattaaattaatttaattacaactttataatttacgaaggtactttgagcctgaatgaattgcatttcatagtaatctctgcccagaaatcaacacttcatgattatgaggagttcaggtgaagatttcatgttcttaggaattaagactcagagaaaataaaaatcagttcattcacggggatttgtaatattcactgttttttttttttttttaaatataagtagatagatatatgcttttattgttaatcaatcaatcatttaggtcatacattatgagttaaacaaacacatgctttgtttttggctattcaaagaaaagaacactttgtatactaaccctcataataaccctattagcaggaactattattttacccattttgcaaagaaaagacaaaaatcaaggctgaaaatgattaaatagcctgctcaagatcacacaggtcatgtgctgtggctcatgcctgtaatcccagctatgcagaaaactgaggtgggaaaatcacttgaagccaggagttcgagaccagcatgagcaacatagcaagacgc

SEQ ID NO: 35848 - DNA, 1019 bp, Homo sapiens
ttatatggttccaaacataataaatgagcacttgagctagaaagtagtataatgttcacaggtggtaaagaggtataatgaaaaaactatacttcacaaaaattagtggtgttcagtgggttggagagaagaccaattagaaggttatctgtggaattacaacaacccagtgaattgagctgatggagagagatgctcctcccactaccaacactcaaacataaggcaaaaatatttataggtgatgagtaatgatgaaaaaacaaaagaacaaatgatagatgacatgaagaatgggagtagggaagaccatatttaagactctgaggtcattaaatgatgtaacatgtttactagcccaaaaatatatactaaaagagtagaaagaaaacaaaaaatttccaaatcagtagcaaggatcaagaaaacaatccaaatggaaggaaagaacaatgtcccttggaacataacaatagaacataatatgaacagtacctccttctatgtagtgtagatattaaacatagggtgggaagtacacatatcaatttcaaaatagtggtttaatctgaaattgttaaacagagagggagggaagcaatagaactgagagagcgttcaaaagccttttgttgtatctgtagagtcttttatttcttaaaaatacaatcgtataccacatgataacattttggccaatggactacacatatgacatggtcccataagattatagtactgtctttttactgtaccttttctatgtttagatatatttacatatacaaataccactgttaaattgcctacagtattcagcacagtaacatgctgtgcaggattgtagcctaggagcaatgggctacaccatgtggcctaggtgtgtcgtaggctctactattttggtttgtataagtacactctatgatgttcacacaatgatgaaatcacctaacgatgcatttctcagaataagtttctgttgttaagcaacccatgattgtatctgaagcaaatat

SEQ ID NO: 35849 - DNA, 1101 bp, Homo sapiens
caccttggtctcccaaagtgctgggattacaggcatgagccactgtgcccaggcaatggcttctttaaaatgctatttatctctcctatttaagtgcccctctctatatttaaatagtagtcctgctggtacccacctcatgcaacttagattactggatttgtatagttttaccctttaaaaatctattttgtaacttgctatactctcctagaatactatgcggattaagttcttaatgtgataaatattctattatatacatattcatttctcttccaagtgatttccttgtcttagggacccattagttacttgctattcaatgggtatcaatatattgtgaaaattaatctttagtaaattttcatttaggttttgtttgattgtttattcttttaggtttgattgctgatttacttctctgaattttagattcttctgtagtttctgacctccaggcaaaggtggatgaatggagttctgatatattagtgagataaagggctcaatagaattcatccaagagacacagctgctccagggagagccaccatcattagcaataaggaaagtaagagtacaaggctcctttgctagaacaactgggtgcttctttctttttttttttccctcttctcttcctgacctccatattctaactttacaagtgatttttttttcttttccaaagtaaaggatgagaacagaagattctttctacttccatatccaggaactgaaactcactatatttatccccaaacacctccttccattcttctcccagattggctaatgtccacatttatatgcttaatgtttcctatagctactacacatttgatcacttccaacatgaaacattggaacaaccctgaatatcactgccataaagatagccacagagattggttactgcttggtgtttgccttatttgaacacagtttgaacacttagcagtctgagtggttgcagtatggcttctgggattggccaaaactcagctgttgttacaggtgcatacaactaagttaggttttcaattttgtctgattattaagctaggttacagttcatccacaaggactcaaatatag

SEQ ID NO: 35850 - DNA, 1045 bp, Homo sapiens
atcagttcgccctgtattgcacaccggaagtaatggcaactgggataaatgtagatgttgtttggagtcaatcgtttgttgttgttcacattgaagagtgtatgtaaactgtctcctcctggctcccctctaacccaaatcacgtgttctggtgcagatcacttaatgtttctgagcttcagtttcctcatctgtaaaagtgaggttcattatttcctaggtactattttgttagttgacttttttaaaaaaataagagtagtcttaagtatccaggaaacttttagacattgtttcaggctgattttaatagtgttctctgtctacttatgtgactgttttacgggagcatgaaaagcccttatcagttgatgtgaaagaacatttatgcacgtttagttcagatcagcaatcacgcattgcaggcttacctcactaggaacttcgaatgtaaaagtgattaatacctggcctgctgctgcctggtgagggttcccgggtgttctgaagctgtggtatggtagacagctggagcgacttctctctgacccaaattaataggactaccaaagagataaattatgacagttttttaaagatggagtcttgctctgtcacctaggctgcagtgcagtgatgcgatctcggctcactgcaacctctgcctcgcgagttcaaatgattctcctgcctcagccgcccgagtaactgggattacaggcatgtgccaccatgcttggctaacttttttattttttttagtagagacggggtttcactatattggccaggctggtcttgaactcctgacctcaagcaatctacccaccttggccttccaaagtgctgggattacaggtgtgagccaccgtgcccagcctctgatattgatcttatagcttgattaaactttaatttgaatgagttttagttcacttgtcatttctgtaccttttcttatgacttatctgtcactgtgatttgactttcctcttctgctaaataaattgttatttagcaggtaaggggacagtgaaggaagggg

SEQ ID NO: 35851 - DNA, 1775 bp, Homo sapiens
tagtactgtgttctcagactgccaagccaggcactctagctgtttgtctctgtgttctgtcttgcctttcagtatggtttagtggaatgagtgctaggcacagtcgggaaatctgaattcttaagctggctttgttcaagtgatttgagctttattactactcattcctaagaactcaggaatagcctatttcctacccctaaacatcctcaaacttttgtgtctttgtatgactgtgctttcgggggagggcctgcgttcgtatggcacctgccggagtggtcaatccttcacccccacccctgcaacaccctctgttgatacttctaggcatgagattatggaaccgctggcatcattcctaagtcatcattagggcagagttaacactcaccgatccttatagtcccaaaaaaggggcaaattcttattaaagcccttgtactccaggtgtgggtctcccgatgcaacgtgaagtcagaatcagacatgtgttcgcaattcaccccttcaccaggcactttctgtgtgctgagcacttcagctaggtgtttactctggatgacaagataatgggctaggccagccctcatgagggtgacctccaattgtagactggcaacattgccaagcaccctccatgactgtgacatgattccaaaacacaacctgtgttggtactaacttgtttcagagactggttctagagtctgaattatttagtgagactttctgaggaagtgggtttggatcctttatgggatgtttttataaacagtataattctcttaatatatgtggaaataatgatgtcacaccttttgagcctgtgaaaactgcagtttcttgttgtgtctttttaaggacatttccttgcagtttattatcagttatgtatagcatctctacttggaagagatgggatactacagattcttggtcaatgtaacaaacactagtttttgaagagaaattttaacaaagggagtgttttcagaaactttaccagattccttctttttttaaaatgagtaattatggtcctcactttaaatttcaaaggtattgaaaatagtttgggcaactatttataatgcccaagattctgtttaatatgtagttatgttcttgggatatgtggatatataggtttttaattaattgttatttttaactacaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaa

SEQ ID NO: 35852 - DNA, 1028 bp, Homo sapiens
agtggggaaggtccagatcttagagggtcctacgggctgctctgaggactttggctttttctctgaatgagatgtggggctcccaggggcgttgagcaggaaagaacatgatctgcctcgtgtgacaagggcactttgggcaaaggcagaagcagagaccacattggaggcttcgtgataaacgagacatggtggcccacaccaagacactggcagtggaggctggggacctggtggccaccatgtccccagtatagagcttggcaagcacagcaacaggtcggggagctgatggccaccatgtccccagtcttggcaagcacagcaacaggtccctcctctgtattctgtgcgtccacagcagacagccacctgcttttgatcaataatttccagtttaattaacaatcatcttggtgtgatgcaagggacattctccttagagtgactcttattatctattaagtactattttatgagttagctctcagataataattttatttatagattcttggggccacctcactgctgtcccgagatgtaacagattgactgaggtcagacgcagaaaactgccttctaagtttctgggtgcacacatctgtatgtcagcagtagattagcagccatcctggttatggcctgagaaccttgtctctctcagtgcaattacatctgcctggttcccataggggctgcctctgattagctctagcatctccaacgtgggggttgaggcccagtggttgcctctccatgcactctggggaccttataactgcccagtcagggtgctgctacatgacatttgcaaactgaatcagcaaactttagcacactgttcacaattcttttggattccttcccatgccctaatgtgcaaacactggattcgctgttctgcatggctgggcctccgtggagctcccatgctctgcctgctcaccagggctctgctgctcttttaccaccagattgcccttggcaaggcttgtattgaacctttcttctgcttccatttgttc

SEQ ID NO: 35853 - DNA, 1124 bp, Homo sapiens
tttctctcttaataaaacttgcttttactttgcacttcagactcaccctgaattctttcttgcgcgagatccaagaactctcccttgagatctggattgggacccctttcctgtaacaagcctctggagtagctgggattacagtcgtgagccactgcacccggcctcaaattgcatgttctgggaagaggcagtttgctttttcctggggctttgagtatcccctgatgcattgcccatcctctcaggggtacaaataccatgatttgagaaatcagaatacaagaagtagcagagatgaagataaagaggtaggtagagctgggatcatgagggctgtcgggtgtcaggctaagggatttggattaaattcctttagaaatgggacaccccacagaagacacatcaggaagattctgaaaagccacacttcaggaagagtattgtggcagtaggcctgggactgagcaagactagacacaggaaaagcaggtaagagatattgtagtgcatctggtagactcagtgcagctgtaagtgacaggcaaaatagcagcttaaacaaaatagatttttattatttacttaagagttaaggagtagctcggaagtcagcagtccagtgcaggaaaggtggcccatatccacttagcattatcctgttaccaatggctacacagcagaccacccacattcagaagctgaaagcaattgcaatcattttcccatgaatctacaatgtaggcagggcacagtgggagcaactcatctctgctccctatggcatcagcttaagtggcccaaaggctgctgagaactcgaccagacaactggtgtgtggaattacctacaggcttgactacttgcacacctgatggtgaatgctggctgtcacctgggacctcacaaggctgtgattggaaatatgtctgggcagctgctccatgaggctgccctacttcctcacagcatagtggctgggcgctaagaggagaatctcaagaagtaggaagcagaagctgcccatttcttaacacttagatcccggagtgggcaaagcatcacatttggccaagtaatcacagtgcctatattcaggggttggcaaagaccccagctcccaa

SEQ ID NO: 35854 - DNA, 1031 bp, Homo sapiens
catcctcatcctgtgaagtttcagtctgacaatcaaagtgcaaactgtgatggatggtatagtttttctgaaatgatactgcatcctagaaatacaattaaggaggaacagcttttccagtgctggctccacttggtcagtgcagtttcgcctttgtggttgtggagtccatcccagctgtggaccgcaaataaccctgtacgaagaggaatggagattgcctctatccacctagattcataagctgccctgaggcgatcttggcatcaaggaagggagcattgaggcacatcgcaccatcagcttcagaggatggcagccattgatttgtcccgtgggtttttttccagggaaccaatctgcccttttgaagaaaagacaaaggtagaaaggatggtggtagactacctggcaattggttatcagaatgggaaatacaacctagaaccaaacggtcatcacttcagcagggttttttgaagaatcaaatattcaatgggatacaaatgacaagaggctacagtggatgggaactgtgtgactgtaagaattgtggacaggtcttcagtgaacagttttgccttaagacacacatgagagctcagaatggagggaacacttctgagggtaattgttatggaaaagacatcctcagtgtgcacaaggaagcttctattggacaggaactttccaaatttaacccatgtggaaatgtctacactctaactccaggctttgctgtgcatcttgaaattctcaatgcaagacaaccctacaaatgtaaggaatgtggaaaaggctttaagtattttgtaagccttgataatcacatgggaatccacactggtgagaaactctgtgaatttcaggaaggtgggagagccatcacagtttcctcacatctaaagcagtgtgtaacagttcatacaggaaagaaatctaaaaagactaagaaaggtgggaaatccttcactaatttttctcaactttatacatgtgaaaaatcataaaggagagaagtcctttgaacg

SEQ ID NO: 35855 - DNA, 1057 bp, Homo sapiens
agtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaatgtgccctgaaagttgtatttcatttttttaaatgtttaacaattacactgtatcaatagtatatatacgtgtacatatatataattcttaataactgcagtgtatctagcatatatataatggtggctggtacatgtttaatagcagactctggaggaggaatcctgacatacagcatttgccagctcaatgtaaatgctcatgctccctcatggtcaatttcaatctaccactggtttagtaactaggatgcaaaatttctaaaaatgtgataattggtgatgggcatgatggctcaggcctgtaatatcagcactttaagcagctgaggtgggaggatcacttgagcccaggagttagagaccagcctggggcaacatggcaaaaccctgtctccacaaaaaaaatcaaaaaattagctgggtgtagtggcacatgcctcaggtcccagc

SEQ ID NO: 35856 - DNA, 1043 bp, Homo sapiens
attttgtgctatttatcattgtttcaggtgggtgggtaaagccagtttctgttactccatcttggtgtaagtggatgttttctgtattatttttaatgtacattatgtattactacaatagtgcacgtattttggtaggttcctgttcttctaaaatatatttaataactaagattgtgtagtcttgctactcaaagtatagtccttgatactacctgggaacttgttaggcagaatctctagccccaccctataactgctgattgagaatctacattttaacaagatcaccaggtgatgaatactaatgtttgatggaactgggccattctaaaagtggatggatggtgctcattaatgtggatggcgttttgcaatctgttgtagattgactcttttgatttaacttttacaatttataacatatttctctatgacctttccagttgagtagctgaattaggtactcttaacaggggatacctaaagagtaaagaagactgtagagaaaagaaacagataaaaaaaatggcaccagtcatcctgttcatcagccattttaccttggcatggtggttgtcttagtctgttttctgttgctgtattctgctttaacagaataccacagactgggtaatttataaagaaaggaagtttatttggctcatggttctggaagctgagaaaaccaagaacatggcacaggcctctggcgagagtcatcccatggcaagaaagggagaggaaattgggcctaacttgtccttttaactggggcccacccccttgataattccctcccaagataatgtaattagtatattcatgaagatggagctttcatgacctcatcacctcttaaaggccctacttccaaataccattactttggcaattaaatttctacatacatttcgtaggggtcatctaaatcatagtagtgatcaaaataattcatgaatcctggaatatttttttccttaacaggttatcttatctattattagttccttccagaccttggcttatctggtcattgtgtt

SEQ ID NO: 35857 - DNA, 1050 bp, Homo sapiens
tttatctctttctcagccttaaacacattatggttctctatcaccctagttatgttcagtggaatttcttaagagtccactcctgttcagaagatgcttaattcacaaaccagtttcctcctaaggcacaggtatagaagaagagatttgactactcttagttcaattatttttttcactatttaattgtggtatgtttggtgctttatgcatttaaagccagcatatgtataataatttgatttttggccattagtgtaaccttgctttcatttttcctacaagaggagagatttttctgtagaggaagttttcatatagatatgctgaaacctgctctaaaacttgggctaggaagtcgtaaagggaatttaagaaattcaccaggattgtagatactagaaaacctgatgaggttggctgtggaaaacagtctggcaattcttcaaaaagttataatgtagaattgtcatatgacccagcaattctactcctagatttgttataatgtagaatttgttataatgtagaatgttataatgtagaatgtaatgtgtttgttataatgttagaattatcatatgacccagcatttctactcctagatttgtacccccaaagaattgataacaggtacctaaacaaatcttcacagcagcgctattcacaatagccaaaaggtagaaacaatccagatgtccatcagtggatgatgaatggataaataagttgtagtatatccagacagtggaatattactctgccataaaaaggaataaagtgctgatacatgcttgaaaacattatgcgtactaaaagaagttggagtcaaaagattgctttatgattccatttatgtgaaatatccagaataggtaaatccatagagaaagacagcatattggtgagggacagggactagtgagaggaggggagtaaagaataactgcttagtgagtacagagttttttgggaggtgatgaaaatactagaattagatggaggtactggttgcctaacgttatgaatgtactaaatgccactgaaata

SEQ ID NO: 35858 - DNA, 1029 bp, Homo sapiens
cttctgctgccttcctttcacctgctgctttttctccccaaggcaggaatcatctccagcttttctgttttagagactgacctaaaaaaattctctgacctaccttgtctgattttaggtcacaaggcactcatttgaaaagagatcctgagtcataccttggaggaagaaatgctatacggaaaggtgcaaaaaaaaaaaaaatcataatgggcagatcttgctgggttttcccactcagtctattagtaatagattgtaaccaaccacatttctttgcagttgtcagtcatgtctatccaataaagcctccataaaaggcacaagaggacagggtttggggagcttttggatagatgaacacatagagacttacaggaaggtggaaggtaaacaaaaaccgcaactacacttgcaccaacctaatagaaaaaatcctatgtcttgggtataatttaaataagatgtataaccttttaattttgtacatgtgttctatttacagaggtaaagaattcagaagaacagtataataaaatagtaattcccaatgaagaaagtgtggttatctattataagattagacagcagcttgccaaattgggtaaagaaattgaagaatatattcacaaaccaaaatactgcttaccttttctacaaccaggtcgtttggtaaaggtatgtcattgtttcttcataaaatacttgaataattcaatatttaaacatatttttgttaaagattctaatttattttttattctgataaaatgcttcctgctacaatagttgatctatattaatcatattattttacctgtttcacatggcactaacttaggggcttatgcaaaggccttttaatcaccactggtttttgttttggggactataaattgaagtagatagttttggaattaacatataaaatatttctagttatgaaatgctaactataactgttcatataactattcatataactatatgaaaaataaggcaattttaagttctggatgaattcattag

SEQ ID NO: 35859 - DNA, 1934 bp, Homo sapiens
ttgaagagaaaaagacatttatttctatcttttataattatataattacctttaccagtgttctttattttattatgtagtttaaaataaatgtctagtattacttgattttagcctgcagaacttctttttgtgtttcttgtaaggtggatctgccagaaacagattttctcagtttttagtctatctgaaaatgtctttattttgccttcatttttgaaaggtaactttgctggatataggattcttggttaacagttgtttgtttttttctttgaatatgtcaactcattgctttctggcctccattgtttctgctgagaagtttttgctgttagtcttgttgaagttcccttgtaagagattaatctttttttctcttgctgctttaagattttctctttttgatttggctttccacatttttattatgataaatgtatctgcatagaaagtgaccaaacttctttgcctttatcctacttgtactttattgaattttatggctatgtagatgaatttttttttccagtaaattttgagaagttttcagccactatttctgtttttgttttgtcatttttagagacagggtctcactctgttacctaggttagagtgcagtggtgcaatcatggcttactgcagcctcaaactcctgagctcaagcaatccttccacctcagcctcctgagtagctgggactacaggtgtgcaccaccatgcctggctaactttaaacaatttttgtagagaccaggtctcattacattgcccaggctggtttcaaacttctaggctcaagcaatcctcccgccttggtctctcaaagtcctgggattacatttgtgaaccactgtgcccaggccattatttctttgaatatttttctacttctttttctaaacctctcccctggaacttccattatgggtatgttgcacttaatggtgtcctatatttctctgaggcttggttcatttttatttgtttgttcttgctctgttcttgggattgcataatctccatcaatagtctatcttcagattcactgttgatattatctgctagttcagatctactgttgggctcctctagtaattttcctcacttcggtaaatagactttgaaactctaaaatttgcttttggtttctttttgtactttctgtttcttcatcgatatgttctgtttgatacaacattgttattgtaccttttacttcattaattgtgatttcccttgattctttgaatatatttatagtggcaacttttaagtctctttagcctaacatctggtcactattacaggcaaattctgttgcctacatttttccctgttctatgggtcataactttcctgtttctttgcatgtctcttttttgataatatattgtagtaactctaggtattcccctccctgcctccacctcttgcaggccactgttgttatttccttgtttatttgtttagtgtcgggctggattatttgattgtaagtctctgtcctgtctacctcttaccccctatagtatgtagccttttagtttgtttctggggtagagttgggggtcacagccttggttatgcccacagtcaccctgagatgacaatggtttggacaggggtctctgtgactttacctttctctgggcatacccaggagctctgttagcaggagggctcctcccactatcatttttaaaaccaggttctcttctgcaaactatctgctgtacaatttagcctatatctccaatgaatacagatctaccagttgcatttcaccacaacctctgctgtttctgaaagttatcttagtcttgaatttcctcaggctctgttacaaataaaatctggtcctttgggaagatattaagagttgtctgttttaaggcatatttcttcacccaggcaaagtctctgagtca

SEQ ID NO: 35860 - DNA, 1051 bp, Homo sapiens
tttttaaaaagtctatactttacaagtcagtagtgccctccctaggcatcaacaccaaggaaataatctgaaaacagtttaaacatagatgctcaatacaagattacttttgatggcaagaagttacaacaatgtaaatatacaataatgaatttagcaataagttgtgccacgttcaggactatgatcaaattgtgacttgtagatttattaacaaatcataatacatctgtaaatcatagtatagcgttgaaaaagagttttcaaaaataaatgcaatggaaaaatgccctataatttaaattggcaaaagacaaaattatatatgtagtatactttttatgtccatgtgcatagaaaaaaagggaaacactgatttggtttggtcttactaattttgactataagatgaaaatgaattttacatatttttttcaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacaggtatggcagaaatttggtttttatagtagaattctatatgtttcactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacagatacttgcaaccatcaccactatgtaacttcagaacattcttctcaccctctgaaggaactttatacccattagcagccactctctgtttctcccatcctccagcccttggc

SEQ ID NO: 35861 - DNA, 1022 bp, Homo sapiens
caaagtgctgggattacaggcatgagccaccacacccagctcgctccaacacttctaagtgaagtctttccccctataaatagctgtttttctccttacacatctacccaagaatagaggtttcccccatcagtgaaactctgaccatggacccagaaattatttcaccgtgagaattctgggatgccccagttgtggttctgtacctaaccttgtgctctaggctttggcttctctagtgacaaacaggcatggcctgagtgtgcttcctatgtgcccatactgcgtttccctgggtcagggtactcggtgtagctctgtgaagacttccatttctgtagagctcaagaaagtggacaccctgaatttctcagaccttgggtaaacttgaattccacagctgacatgcccagaaatccggactggcttttcccctcccaccttgccagcaaaagtttcctatatgcgtaagttcaacaaagctaaaaagtagtgtctttctggtggctctactttgattctgggcaaagcaaacacttgacatgacttcctttaaaagaaagtctattactttagctttccctaaatgccactgaaaagttgaatgtctgaagcttctcaatactgttctattagaactagatacaggggacacagctcatgcttcagcgccaaggctaatagtaaaaaggctgtataggttccttcctttgcagattccactcttctctcctccccatacatgccatttgccaaccttatctattaaacccattctaggtaaggcattcagttagttacttctcttttaagagtaggaacttaacagagctgtatgtccaatacagtgtgtggtaccagacaggctcggcagcaacattattacttttaattccccttctaggtggaattgcccattcacagtcagtcctatttggaccacatagccctgccttctccttgcatacccacatctccctgcactgactagatgacttacaccaggcatcacccagagacct

SEQ ID NO: 35862 - DNA, 1035 bp, Homo sapiens
accctaaatggaagcactctgtatagaaggaagctcaagattgcaattaaaatgttggcagcatcattggaaggcagagaaactatcaccttggaacaaagattgggctaaaataatccagaatgaggaaaattgtttaaaagaattatctacaccatgaagaaattcatcagcattttgtgtaaaagatggaaggtcagaagtaacgtacctttcatttatactgtgttcagatgtagcatttctcaatgggtatgttattgataattaggcagtactgtgttatatacaatttttccacattggcagccacctcgcatccccagcacctcctccaaagtgccagcagcactctcagtcatggtaaaactaaaaaagtcctgagaaacgctgctctaatgtttcagagtgcatgtgaataagttatttcctttaatcagcataatgattcaaaatatttgtaacattttcactcttcagatgatgaactgagaccgaaaatgaattgctggctttttcacctgtctagtgaagggtgctgctgggcctcaaattcgaatagactgattcctaattcagttccttctctaaaacattgtgctatctttcaatggaggcagagatttatacttgatttcatcaactaatatatatatgcacctgaacttttgttgttatttatattctagctatgttctaaggaacatagattttgttaaacagaacacactttgtttcgctgagggccttgatggacacttagcggtaggagctaaggggaactgggctaatttgtctgatagagggagaaggtcatggagctcccagggaaaataaggaaggaagagaggacaggacagagagcctagaggtagaggaccttgggaagcctggaactatgtaacatgacccacccacatactctcactctgcatcccaaggtattacttgtacaaagtattactcaagaaatgcttaaagtgtgaattgttttgtataaaatgacaaagggctgagtattacacctgggttgag

SEQ ID NO: 35863 - DNA, 1060 bp, Homo sapiens
gactactaggcatcagccatctccagctttttccacttgtcgattggattatgcaagtcatgagtggtatttaaaagaggtggactgtatgctaaattgatttatccttgcttatgtgtacagattaatggtataatccatgaggggtgatagattaagatcctgaagtgaaaaaatacatatatagtgtcaggtatattaaccaatggttagttgccttttatttttccagtgtaaagtatagcagatccttcaataatgtcatttagttgaacattttggacaattttgctaaaaagttgatgaggataaaaatctcttctggcagaggctactgtctgtatggagtttgcatactccccccatctctgggtggattttctctcagtactctggtttccccctgacaccccaaagatgtgcacgttaggttcattgtcatgtctgcaaggacccagactgagagaatgtgggtgtttgttaatgcaccctgcaacgggatgacatcctacccagggctagttcaagtctggcaccctgaattgttgggacaggctctggccacctgtgaccctgaactggaataagtgggtaaataatcatcttattaatgtttcttaaatgtatgttacagctcacattttttcagtgtttagtgttagaagtgtttggggtctctagaagtttggtgatgtttttgtgaccagaaatatgccatagaaactttcccacttgtttacatcaattggcctatggtaaagttggttttaaagtcaaagtttctcttattgtgtaacttgccattgacatctactcatgttacttaaataagcgttttgtttgtttgtttgttttttgtttttttgagatggagccttgctctgtcacccaggccggagtacagtgccctgatctcggctcactgcaacctccgcctcccaagttcaaacgattctcctgcctcagcctcccagttagccgggattacaggcacatgccaccacacctggctaatttttgtatttttagtagaggcagggtttcaccatgttggccaggc

SEQ ID NO: 35864 - DNA, 1042 bp, Homo sapiens
cacgtggtcccctcactcatggagcttacagttcataagagaggaacagtttgcaaactgcattaaccatgttaaaggaaaaatacaagtgctgtgaaagaatggaactgggagttcttaattgaaattgggaaagtctctgaggagttgaggaaaatctagagagtgggtagaaattaggtaaaaagtagacagagaaggaagcagcctgtccagaagccctgagtaggaaagatcttggggttattgaggcagtgaagaaggggggttgcaggtctgatgacaggaattgaggtgagaccacgaggtgcagggccacttaggttgggctaaacattttggattttagtctaagcccggggggaaccactagagcattttaatggaggaagtaaccctggctgcactgtgaaatctgggtaagattcaaagttaaagaagcctcgttaggagcctgttgctagttcagagcaggtttaagagcagcttgacctggatgggcgtgtgaatggaagacatattttttagaagattatttgacaatattatcaaaagtcttcatttgtgtacatttttaacccagcatttccatttctaggtgtttattctaaagaaataatttaggccaaatgtggtgtaatcccagcactttgggaggccgaggtgggtggatcacctgaggtcaggagttcgagaccagcctgaccaacatggtgaaacctcatctctactaaaaacacaaaattagccaggcgtggtggcacatgcctgtaatactagctacttggaaggctgaggcaggagaatcacttgaacctgggaggcggaggttgccagtgagcctattgcaccattgcactccagtctgggcaacaagagctaaactccatctcaaaaaaaaaaaaaaaaaagaaagaaaaaagaaaaaaataatctcatagtccttaaacataaataaggtaaaacgaaatttaaaaaagaatctcagatgtgtgtaaaagttcagctactagaatgctcatccctattatttatgataaaa

SEQ ID NO: 35865 - DNA, 1028 bp, Homo sapiens
aaacatcaaagaaatttgcaaaaagataggtggtaaattcatgtgagagagagacttctagtagtggaaatgcatgttaagactcactttctaactttgaagaacaaatgattgaatggaaaaatggttgagatagtgaccacaagaggagtttgggtttttttttaagatctggagttattaaggtacataaattcgttaaaaagtacatttaaagcaaaaacattttacagtaaaacctgatgcccaacagtagttgttggctctatgttaaaatacctttaaattaactattaatttttgttaacttaaaacaataatcagttactagctcacgaatctgcagattgggcagggctcagcaggggtggcttatctctgttccttgtgacattctctgaagatgaaaggtccaagactgcttcttcactcacatgcctattgcttcagctgggatactggaacacttggggggctgttggcatctcttcctcctagcacgaagactgggttgcaaagagtattgtttcgagaggcaagtctcaacatgcaggctcttctcaagcctccacttcattgtgtttgctaatgccttattgtccaaagctagttgcatgcccaaacccagaattgatgtgatagggaactacacaagaatgtaaatactgggaggtatggttcatgggggccatcaaaatgaaagtttacaacaagtataaacagaactgtcttccttccccacaccccacccccaaaacccactttgggcatatatgctagacaaagttacccctcattctttttaacagttacatagcctttcattagctggataaatcatggtttatttaatgaatgatatactaatgaacatttataatctttttaaccttttgttactgaaaacagtgcttcaaaagtatttttatacgtatgtcatcttgtacatctgtgagcatgtatctgtgaacatatccataggctggatacctagcaggtcaaaatgacgtgtgcatgcataattggct

SEQ ID NO: 35866 - DNA, 1032 bp, Homo sapiens
acgtggaacattctgtattcatctgctatttgtgatgctccgggtgtttcaactagaaccttcagacccaatgttatggagaaaaactttaaagaattttgaggtagtttttaataaatgcttagagtaaaattgttagcatattcttaggatatattcttaaaatttatccttcactaaatttaggcagtgaccattttaaaggtgtgaaggtatgtaagaattagttgatgcttataaatagttctcatgagatatttactaaactttttcttctagcttgaaaaaaacaaacactgacctgctgtaagaatgttgtccttagtaaaaactataatgtgttcttatttttgaagctcttaaatcaactttatgaaaaacatgcaaattaaagataaataattcagcctctagaactcttcatatgtataattatggcacaaatatcattgttactgtctttttccaatgttaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacaggttagtactttttaaggatttcaaacattaatccagtgttacttttaattttaggggtaattttttatatctacttgttaagttgctctaaaatgatttaattattgaatcttggctttcaagttaaaatcaagggtgaagatactaaaagttcgctgggcatggtggctcgtgcctgtaatcccagcaccttgggagactaaggcagaaggattgcttgagcccaggagttcaagaccagcctgggcaacatagggataccccaactctacagaagtaaaataattagctgggagtggtgatacctgtagtcccagttactcgagaggccaaggcaggaggatcgcttgaacccaggagttcaagtctccagtgacctatgatcgcaccactgcctaggtgacagaa

SEQ ID NO: 35867 - DNA, 1063 bp, Homo sapiens
tttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaatgttgttacttttatttattttgaaataatttcatacttatataaaagttgcaagaataccacagagaacttctgtatacccttcacccaaagaccccagtcaggtttcaccagctgcccatttatgtcctttatagcaagaggatccaaaccaggatcacatgttgctctcagttgtcatgtttcttcagtctcattgaatccagggccattccttagttcttccttgaccttaatggccttaattttttaaagatttcagattattgttttatagaagctcttcaaattgagtttgtctggtg

SEQ ID NO: 35868 - DNA, 1081 bp, Homo sapiens
taactttttttggccttagtttcttcattatactgatggaaatatatatggagggtttttgtaaattgtgaagtgtaatacagatgtaaagatttttttggggttttttgttttgagacagagtctcgctctgtcactcatgctggagtgcaatggcacaatctcagttcattgcaacctccgcctcccaggtccaagcgattttcctgcctcagcctctcaagtagctgggattacaggtgcccaccaccacgcccagctaatttttgaatttttagtagagatggggtttccccatgttggtcaggctggtctccaactcctgatctcaggtgatccacccacctcaacaaatttaaatatggctttaaaatatagtttgaaaactgaattaagaattaaagggggccaggtgcagtggctcatgcctgtaatcccaacagtttgggaggccaaggcaggaggaacacttgagattaggagttcgagactagcctgagaaacataacaagactgtctctctacaaaacataaaaaaaattagctgagcatggtgacatgcgcctgtagtcctagctacttggaaggctgaggcaggaggactgcttgagcctaggaagtcgagatggcagtgagcggtgattgcaccactgcactccagcctgggttgcagagtgacaccctgcctcaaaaatgaataagaattaaagagatgaggccggatgcctcggtatttttggcgctgcgatcgcgacactgcactccagcttggggtgacaagactgtgtcaaaaaaaaaaaaaagaacctctgacatacaaaatactatttaaaaaaggggtgagggggcagggcatggtggcttatgcctattatcctaatactttgggagcctgaggcacgaggctcactggagcccaggagtttgaaaccagcctagggaacatttaaaaaaaaggtgggggggcggtgcgggggcagggaatacatctcttttcaaactcctgacctcaggtgttctacccacctcggcctcccaaagtgctggaattacaggtgtgagccaccatgccaggccgaga

SEQ ID NO: 35869 - DNA, 1155 bp, Homo sapiens
tggatgtggggagggtagctggttgtagctcaagtgctgcagactcttgcaattgagttttagtctgaacaagtataactggggaaaacgattaaaaaacaaaacaccgtggtcgggcgtggtggctcacacctgtaatcccagcactttgggaggcacaggtgggcagatcacttgaggtcaagaattcgagaccagcctagctaacatggcccaaaccccgtctctactaaaaatacaaaaattagctaggtgcggtggcatgagaatcacttgaacccgggaggtagaggttgcagggagccgagatcgtgccactgcagtccagcctgggtgaaggagtgagactctgtctcaaaaacaaaacaaaacaaaaaacactaaaagtctgaaaattattctaagggcacatagcaaatgaagaaacatttatttaagaaaatctgaaaacttcgtgtttctgtactattcttctgataacctgctttactttctccttatgaacattttttcaaagccttttcatatatctggaacgctttttttttttcatataaataagactcgaatggctcatgactacaatttcaggaatgtgaattttgcaatatcgttatatattaggactcactaaggaatgttgatttaacttatataaataaaaatagaatagttttttacaggtacatttacagacattcaaggagagtgcaaattattaaaattgtctatttttaagatgtgctaagaataaatttttgaagcagatgctagaaatggacttttttgatagattatatgccactagtgatttctttaatagtctgcaaagtggaaaatagcggcgtattctgataaaaagttgtaatacaatttttttggtcaagttattttgttaggggagctttttgatgggccttccctccagcatgatctagtgtgtaaacataaaacaactactgcctgggtgcggtggctcacgcctataatcccagcactttgggaggccgaggcgggcggatcacctgaggtcaggagtttgagaccagcctgaccaacatggagaaaccccgtctctactaaaaatacaaaattatcccggtgtggtggtgcataccttaatcccagctacttgggaggctgaggctggagaat

SEQ ID NO: 35870 - DNA, 1085 bp, Homo sapiens
attttccccagtcctgcctggatgcatatgggtttcctgctttcctcttttgtcattttctctgaaataaatgtaagacttcttgtaatttttaagtgatttcatagctaacataaagcacagtaataaaaattagcatctgggccgggtgcggtggctcatgcctgtaatcccagcactttgggaggccgaagcagggggatcacctgaggttgggagttcgagaccagctggaccaacgtggaaaaaccctgtctctactaaaagtacaaaactagctgggcttggtggcgcgtgcctgtaatcctagctactcgggaggctgagcaggagaatcgcttgaacctgggaggcagaggttgtagtgagctgagatcgtgtcattgcacttcagcctgggcaacaagagtgagaccctgtctcaaaaaaaaaaaaaaaatctggaaagatacacaaaacattaaaaaaagcttgtaaatacttgtcttcatttaaatgttaacttgaagttaagattggtaatttaaaaaattaaaaaaaaaatagagacagggtctcactatcttgcccaggctggtcttgaactactgagctcaggagatgcttctgccttggcctcccaaagtgtgattacagatgtgagccattgagcctggctgataattgttaacgtgcgttgaaattctcaatgctttttggacctgactcttgattaatttatataggccctcataatgatgatgattttactcttagaatttggaacaccagttctaaattctgaattcttctaattaaaaattagctttagaaaatagttgacaatttaaactttttttttttttttttgagatggagtctcgctctgtcgcccaagctggaatgcagtggtgtgatctctgctcactgtaacctctgccccccaggttcaaacgattctcctgcctcagcctcctgagtagttgggattacaggttcctgctatcacacccagctgatttttgtatttttagtagagatggggtttcatcatattgtccaggctggtcttgaactcctgacctcaggtgatcaacctgactcgg

SEQ ID NO: 35871 - DNA, 1033 bp, Homo sapiens
aaattaaccggttgtggtggtgggtgcctgtaatcccagctgctcacgaggctgaggcaggagaatcgctggaacccaggaggtgaaggttgcagtgagccaagatcgtgccactgcaccccagcctgggcgacagaacaagactccatctcaaaaaaaaaaaaaaaaaaaaaaaaaaaaaaaaaaaaaggagttgtctgtcttctcaacccttactgtcattatatattggccaatgggcaagaggtgccagctttgttctaatcttgcattttgattacaagagaacctggctatgttttcatgtgatttgtggctctttaatttttgagaactggctttttgctcatgttttccccattaggttgtccttatttgtattgatttatagagctctattttcctttcctttccttttcctttttcctttttctttctctttccctttccctttccttttctttttttgatggagtcttactctgtctcgtccaggctctggagtacagttgtgtcatctcggctcactgcaactgcaacctgcctcccaggttcaggcaattctcctgtctcagcctcccgagtagctggaactacaggcgtgtgccaccacacatggctaattttgtattttttgtagagatggggtttcactgtgttggccggactggtctggtctcgaactcctgacctcaggtgatctgcccacctcagtaccccaaagtgctgggattacaggcgtgagccaccatgcctggcctttttcaaacatttattgatcattttcatgcattttctttttagattactgagacgacttgttaaaattttcccttcccttcccatcccgttgcatcgcatcgcgtcccgtcccgtcccgtcccgtcccgtcccttctcacatgcaatggcgtgatctcggttcactgcaacctccccgcctcccaggttcaagcgattctcttgcctcagcctcccgagtagctgggattacaggcatgtgccaccacacctggctcatttttttgtgtttt

SEQ ID NO: 35872 - DNA, 1031 bp, Homo sapiens
tacaaaaattagctgggcatggtgctgctcacctgtaatcccagctacttgggaggctgagacaggagaatcacctgaaccctggaggcggaggttccagtgagctgagatcgtaccacttcactccacctgggtgatagagcaagactgcatttcaaaaaaaaaaaatctgattttcctcttctctgatcttgaccttatgctaaggagggattatttcttagactgatgcaaagacctccattctcttgagtttttcttttcttttttttttttgttttaaatgaaagcaagtttattaagaaagtaaaggaataagagaatggctactccataggcagagtagcctgttttttaaccctgacttttttcttagttatggataaggaaacttaaacacactcttgttttctctgaccagcaattagtatagatagtaactagtttaatggttagcaaagtaagctgagagtaaggtttatgagtaattcatgtttaatacaggctgaatgtcctttatctgaaatgcttgggaccagaagtgttttggattttggatttttttcagattttacgtttattatttcagcatcctgtttctgaaaatccaaaatccaagtgcttcaatgagtaggcagagcgtgacactggcactcaaaaagtttcagattttgtagcttttcagattagggttattcaacctgtagctaagagttggtcatatttgattcatcagttacaacatgtatgattctgagattggttttaaatgatttatttttaaaatgtgaaatgtttattccaactttcttccagccgtctttaaatcctgagtatgagagagaaccaaatcacaataagtctttagctgcaggtgtgtggggtaagtaattttttatctatatttgaggggcacaaaatgttgatatttataggtttcactttttgtgttttttaaaatagagagcaggctagaataaaactttctttttaaagtatttgtatttgatgtgcttagctacaaaaaaggt

SEQ ID NO: 35873 - DNA, 1030 bp, Homo sapiens
atcacagctcactacagcctcaacctgggctcaagggattctcctatgtcagccccccaagtagctaagactacaggtgcacatcactgtgtctggctaattgaaaaaatttttttttgtagagacaaagtttcactatattgcccaggctggtcttggactcctggactcaagcggtcctcccaccctggtctcccaaagtgctgggattacaggcatgagccaccacacccagcctacttcctggatctgataccttcatatttataaaaatttttatttcttcttatatcttcagctttccacattggatcattttccttctgcctaaagtacattctttagaattagtaaggatcttttgaattattctatttttatcaaagttgcatttctgccttctaccatatctggcattttcaagtcctgatccctttgaggctctatgtggtagattaggtcctcctcagctgttaggttcctttgtgtacactctaaattgaaactttttatttacttctctagaactgtgtgttgaaatcattttcttgctgatgactctactcctattttatatagttgtgtttggtttcctcccttacagtaattttaatataagaatctagaagaagataaacttgtgtgcttagccacattgaactagaagtctctgttagccatgtttaaacttacttagttgtagtatagtgatagaactgccccctgctttaacacctggattcctctcagatgagattacctttcacattttgtagcactgatcattcctcagattcctgggctttactcaatttagattttgagttacatgctaagattttctctcacattttattaatgtcaagaattttttttatacttcatccatgccattatcatctgtttaccaaaaataattggaaatcttacattgttgagtacaatcctaatattatttactattctttgtttgagattttttttttttttttttttttttgagatggagtcttgctctgtcgcccaggct

SEQ ID NO: 35874 - DNA, 1049 bp, Homo sapiens
ttttggggggtggtaggagggacagagtctctgttgctcaggctggagtacagtggctcgtttgtggctcactggtgccttgacctcctgggctcaagcagtcctcccatcttagtctcctgattgtctaggactacaggtgcttgccactgggccagctaattttttactttttgtagagacgaggatcttgctatgttgtccaggctggtctcaaactcctggtgtcaagtgatcctctctcctcagcttcccagttcctgggattacaggcatgatccaccacacctggaccaagagtaatttttaagaaaacaattaagaaaattgcaattttcttaatttgatacttgtgatagttaccttgtaggattgaaattaactaatgaggatttgtattgtataatgtcttcttttggggatgatggacattttattactattaacactgattggggggaaaggaggaacaagagagaaaggtatgtattgttactgtactgactgtgagtacctggtagttcaggtattttctttctcatttgatcaaggttttgaaactcccagaacagggagttctctgaccagtctagtgtcaaaggacacccatagcacttatattattatacctgaaattgctttgggtactgtattggaacccctcatatactattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggctgggcatgtagccactacgcctggctaatttttttgtatttttagtagagacggggtttcaccgttttagccgggatggtctcgatctcctgacctcgtgatccgcccgcctcggcctcccaaagtgctgggattacaggcgtgagccactattttttatttatgatctcagacagaatttttgagctttgagggaaggactagcattcctagctgcttaattc

SEQ ID NO: 35875 - DNA, 1074 bp, Homo sapiens
cctcccggaatagctgggattacaggcacccgccacaacacctggctaattttttgtatttttaatagagacgaggtttcaccatgttggccaggctggtctcgaactcctgacctcaggtgatccaccgccttggcctcccaaagtgctgggattacaggcgtgagccactgcgcctggccagtgataggttttttaaggataatgcttttcaaatattaaaatatgaaatattcaatactaaggcacatagatcattcttagttttattgtcaagttttagccactttatcagggtatcgaggtagcctcaacatcaaagggatacagttgtcaacttgtttaagcagacaccaaattagtggaagtaaatgctaaagaaattcagagggtttggggatagagatcattatgacttgggtaccagtcagaggtttctttctttctttccttttaaaatagttaattgtataaatatttattttttagagacatggtctcactgtatctcaggctggtcttgaactcctagcctcaagtaatcctcatgccctggcctcttgaattgctgggattacaggcatgaaccatcacacctggccctagtcagaaagatttaattgggacctaaattaaatcttgaaagggttagacgtaaataagggcaagcgtgctagaaaaagaaaggatgtaaagacatggttagaatggtgtatatacctagtttgttttaagggtgttgagtgggatattttgacacaagcaggcaatttactcactgaagttaaagatcatattgaaaaggcaggactttagagatgtcttatacttggtttgtgatagagtaggaactgtgacccaggtcttctaacttctaatcctagattttctctactgaggaatttgaatttgtgaccatggcacaaacacagttaaggagtttgttctttagaaagtgagaagccaccgaaaatatttatcagaggatggtagttgtgaaactggtatcaggatgatttggcaatagtttgaaggagagtgggaaggaataattgaaatgaaaaagcaaagtac

SEQ ID NO: 35876 - DNA, 1035 bp, Homo sapiens
gttgctaaatattttactttattgatgttattgtaagtaggttgttttcttaatttccttttcagataatttgttgatagtacctagacatgcaatagatttttgtatgttgactttgtttttttttttttgagatagagtctcgctctgtcactcaggctggagggcactggcgcgatctcagctcactgcaacctctgcccctggggcctaagtgatcctcctaagtactgggactacagatatgtgccaccatgcccagctaatttttgtattttttgtagagatgagatttcaccatgttgcccaggctggttttaaactcctgggctcaagtgatccacctgcctcggcctcccaaagtgttgggattataggcatgagccaccatgcctggcctctatgttgactttgtatcctgcaactttgctgaattcattcattagtctgaacagctttttttgtgtgtggaatctttggggatttctatatgtaaggtcatcatctgtggcttcttccgctctaatttggatgccatttatttgtttttcttgcctagttgctcttgctagaacttctgtttttgaataggagtggtgagagtaggcatccttgtctcattcctaaccttagaggaaaagctgtctgtttttcactcttgaatataatattaactgtggatttgtcatatatggccttcattatgttgaggtgcatcccttctatacctgacactaagaatttttatcttaaaaaggactgaattttgttaaatgcgtttcctgcatctattgagatggtcatacagtttttgtccttcattttgttgatttggtatatcacattgatttgtatatgttatctcaattttttgaagtgttacttatacgtttataaaagttgtgagccaagaaaaatttgtgctgaggtttttatgaaaacatttactgccaaactatattttctatactttctgtatttctgtgtgagtatatttagacacacgtatatttggattatcagtgtgccaaacat

SEQ ID NO: 35877 - DNA, 1049 bp, Homo sapiens
gacatgatgtaatcctattcctattccagagaaggaattcagtattctatgagataattttaacaaagaaatacaaataattaaaaagatcaagcagggcaggtgcagtagctcatgcctataatcccagcactttgggaggctaagacaggtggattgcttgaggtcagaagttcgagaccatcctgggcaacatggtaaaaccctgtctctactaaaaatacaaaaaattagctgggtgcagtggcacatgcccatagtcccagctactcagaaggctgaggtgggtggatcacttgagtctgggagacagatgttgcagtgagctgagattgcaccactgcactcaaaatattttttgaaaagcagaaattctggagttgacaaatgcagttgacacactgaacaatgcatcagagtctattaacagcaaaaatgatcaagcagaagaattagtgagcttgaagatgggctatttaaaaatatacggtcaaaggagacaaaagaaatgagaataaagaagaatgaagtatgtttacaagatctagaatgtagcctcataagggcaaatctgagactctgaactcaaaaaggagataaagagagagatggggtagaaagtttattcaaagaggtaatagagaacttcccaaagcttagagaaagttatcagtatttaagtacaataaggttatacaacaactaagcaggtttaacccaaataagactacctgaagacatttaataatcaaactcccaaaggtcaaggataaagaaaggatcctaaaagcagcaagagaaaagaaacaaataacatacaatggagctcaatacatctggcagccaacttttcagtaaaaaccttacaggtcaggagacagtggcatgacatatttaacatgctgaaagaaaaaatacatatattagaatagtatatctggcaaaaatgtccttcaaacataaaggagaaatactttcccaggcaaaatacctgagggacttcattgatctcagacctgttgtatgaaaaatgctaaagggagttttta

SEQ ID NO: 35878 - DNA, 1025 bp, Homo sapiens
cttttaaaattcatatggaaccaaaaaagagctcaagttgccaaagcaatcctaagcttaaagaacaaacctggaggcataatgttacccgacttcaaactacacccacagggctgtagtaaccaaaacagtatggtactggtacaaaaacaggcacataaaccaatggaacagaatagagagcccagaaataatgccacacacctacaaccatctgatctttgacacagctggcaaaaacaagcaatggggaaaggactccctattctacaaatgatgctgggataactggctaggtatatgtggaagactgaaactggacccctttcttacatcatatataaaagccaactcaagaatataacgctgtaaatgcaaaatctaaaactataataccctggaagatgacctaggcaataccattctggacataggaactggcaaatattttatgacaaagacaccaaaagcaatttcaaccaaagcaaaaattgagaaatgggatctaattaaactaaagagcttctgcacagcaagagaaactatcaacagagtaaacagacaatctacaaaatatgagaaaatatttgcaaactgtgcttctgacaaaggtctactatccagaatctgtaaggaaaattaaaattaaacaaattttataagcaaaacccaaacacatgaacagatgtttttcaaaagaagacatacatgcagccaacaagcatatgaaaaaatgctgtacgtcagtaataattagagaaatgcaaatcagaaccacagcgtgatatcttatattagtcagaatggctattattttaaaaatcaaaaaattacagatgctggaggggttatagagaagagggaacacctatacactgctggtaggagtgtaaattagttcacccattgtggaaatcagtgtggcaattcctcaaagaacttagaactacttttaaacccagccatcacattattgggtatatacaccaaggaatataaatcgttctaccataaaacatatgcac

SEQ ID NO: 35879 - DNA, 1030 bp, Homo sapiens
tcattatactgtagcttttatatcctgttgagagatatccttgattattattatacctctgcttaaaatattttcccactgctttctggataatgtttaaataaacattttattatttaaaaaataaatgtttaaataagtatttaatattctagcctaccttattctatcatactacatatcagccttgttctctgtttccaattgctaacagttttccaaaggccctctatttcatgcttccatgtgtttaattgtattctcccctctgcctagaatgtctctccttctgcttctctcctggctaactcctatacgtccttagaaactacagctctttttgaaagcttctataactgcttattgatatagctgtccctctcttcagcgttcccctaaatttgtcctcccataatgtgtcagcttatagcatttattttactatgttttaatatttttttttctttttgcctctcaactaaactgccttctctgaggtaaaggactgtattctgcacatctccataaccccatgacctcataaacataactggcacataggagatgttcaatatatatttattgaatgaatcgataattgtgatttcattacttgttttacagatcatccgtaagatttgtctactgcattgtcttgttgaatttttaaataggactatgaattattttgttagtaatattaataaaagatgtttataaaaacaagttagtatcttggaatacaagttacttaatgaatttcttaagatatcttttttaaacatataacatttttgcttatttagttgtgaaagaatatggtttctataatagtgtgttatttaaaagcagttctatttagctatttagttgaaaatgattctttggtgaaaaattaactctgtaaatatgtattaagaggaatgcctgctctgttttgattctatgttttaatatttttactcttggcaatatttaatgaaaatgtgtctcattaaccttgaagttactagtcattattttgtgactg

SEQ ID NO: 35880 - DNA, 1048 bp, Homo sapiens
gtcttcaccccagaatgcgacgtgcaccagtgaacagaggtcaggcaaggcgaaaagttgtttgtcatctgccaagctgtttgtaacaaccagataaaagtatattcctattttcagatttaaaatgtaaacatacatctctagtcccaaccagtctctttattttggaatgttaatgtagaaatgtccccttgccggcagctagcccaatcttcttttcacagtcacccgttccagaggttatgtttatagctagaaccagtgtattttggcttttgcctttatttattctttatgagaactgggaactatggtgacccagcaaaagcctgggtgaccatggaagtagtctgtattagcgcctggacaccagagaaaagggaaaatgtgatcctcattcagccctggttgatagagatcatgcctttaaatggtcagtctcaaagacattcagttgtcacaagtgcagatttaccagttggcagttcagattgttactgtacagtgagtgtgagggtctttagaactggttttagtaatgtagcatatatacaggaatcttaggggatgtgtcatactgttttcaatagtcagggatagcatattggttaatcccaggcacttctgacacatatggttctgattgtgtaggcagaatgggcatgacaaggagggaaccttatcagctctttaaactaagtctgggttacattatacagaccatccaattctttgccctcctattcccattttctcattccccagtttattcattcttaccattttaatgaaaatggtaagctctgctgtcaacaacagatctcagctcttggatccttttattggatcttactatttagtatggaccacttttctttttgaggtatcaactctttaatttaggtcttttatatataaaaccattgattttgttttcaggttagttttctgccttagctgttttctttcttagcattttaaaagtgtgaagtcaatctattttattaaaagttcaatacatctaaattcacaagtaagagatgttatg

SEQ ID NO: 35881 - DNA, 1047 bp, Homo sapiens
gagatgaaaattaaagggctaatactgtctgactttaagaattactttaaaactatagttatctagacagtatgatactggcattaggatactgggtaaataaatcaatggaaaaaacaaaagtccaaaaagtagatactgtacaaccagttggtttttaacaatgacatcaaaacaacacaattaggaatggaaagtctttttagcaaatggttctggaataacttaatatccatatggggaaaaattgatccctacctcacgtcatacacaaatattaatttaagatggattatagactagacataaaagccaaactattgtgcttctagaagaaaaaaacaatggaatatctttgcaattttgaggtagacaggagacagaacaatctgtaaaggaaaaatacagattaatcagatttaatcagaattaaattctaatgctcattataagagaacattaggaaatcaaaagactaggagaaaataatcatagtacatatatctgacaaaggaattgtatctaggctatataaagaacacctcaactcagtgttataaaaaagaagctaacaaatattgggcagaaatcttgaacaagcactctgtaagacacgttttaagtatatgaaaatatacttagcaacactagtaatcagtggaaccacagtgagataccactacacacccattaaaatggcttaaatttaaaagattgacaacagccatcactggagcacccacaacttttatacagtgctggttggggtgaaaatgatacaatcatgtttgaaaactgacagtttgttataaaatcaaacatacatataccctgtgatcaaacagtaattctcccggccaccttgaaaactgaagggatcaatttttagtcacactttctgggagctctggccaacagtaggtctaacaccttggcatactatgcaaggcttcctgatttgggcccagcccgactttctagctttgtctccttaggctaccctactcttctgtaccctactctaccctactcttcaaggaactccct

SEQ ID NO: 35882 - DNA, 1041 bp, Homo sapiens
cttctgtcttttttcttaatctggctaaaagtttgttgattatgtgtatcttttaaaaatgacttttcttgttgttggtcttttgtattcttcatattgttttcttcaaatttcatttgtttctgctttgatttttattatttcttttcttctactaattttgggtttggtttccttttgcttttgtaattctttaactttcattgtcaggttagttgaagtttttctacttttttggtgtaggctcttatagctataaatttttctctttgtactgctttctctgtatcccataggttttggtatgttgtgtttccattttcatttgtttcaagaaatttttcaatttcccttttaaattcttcattgacccactgatctttcaaggagcatattaatttccatgtgtttgtatagtttccaaaattcctctagctattgatttctagttttattccattgtggtcagagaagatactcgagataatttcaactgttttgaaatttttaagagctgttttgtggcctaacgtatagtctgtccttgagaatgatccatgtgcttaacgagaagcatgtgcattctgcagctgtttgatgaaatattctgtaaatatctattaggcccatttggtctgtagtgcagattaagtccagtgtttctttgttgattttctgtctggatgttctttccagtacttaaagtgggatgttgaagtctccagttatttatttattatttatttatttatttaaaatggggtctcactctgtcacccaggctgcagtgcagtggcatgatcttggctcactgcaacctccacctcctaggcttaagcgatcctcccacctcagccccccaagtagctgggaccacaggtgctcgccactacacacagctaggttttttttgtttgtttttttgtctttttttttgagacagagtctcactctgttgcccaggctggagtgcaggggcatgatctcaggtcactccaagctctgcctcctgggtttacaccattctcctgcctcagcctc

SEQ ID NO: 35883 - DNA, 1099 bp, Homo sapiens
agggcagaaatcagtgttaagcttaggaaatctttcatagagtgtctcaggcttctgtgtaatatttcacatttgtttgtttcattttttgagtagtaaatatttctactgtggggtgcttcatgtctattatagcataaaatcaggacagaactgtttatgtaacattagtatgtaatcatacagctttttcaaacttatatacatatctgtatattatttaaatgcaaagtatgtatgtatatatttatatgtatataatgtattttatttttattggctatttttataaaaactttttttaactagaaatttaataatttcttccatttatatatacatgcaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagttatttaccttgtattttctgaatgtacaatagtttcctattctattaatcttgagttcatttttagtatgcacaagaaatgtgagattatgtactgtagaaacctaacttcttttagacttaaatccttcatttgacttagtcattgttatttatgaatttgcttagatttgtttttccctctttggattactcccttgagaaggatcctgtagctgtgaatgcttagtacattttggatctttatgatcatttgggaaccactcatagatagaactgggtacaaataatgagggtaaatatttttccctctttggattactcccttgagaaggatcctgtagctgtgaatgcttagtacattttggatctctatgatcatttgggaaccactcatagatagaactgggtacaaataatgagggtaaaatag

SEQ ID NO: 35884 - DNA, 1035 bp, Homo sapiens
ctaaaatcacttttatcatatgaagattttggataaatcattattaaggaaactaaggacagctgtggcatggaatcagcgggctttcagtttgaatcccagttactcacaaatgtaaagtggtattttcattcctcttttgttaaaatgctttttttaaatgtaggaagtttacattttgtcctagatcacattggcttctgttcccacaggaaatgttatatgctatatgtcagttttcatttcattaaaagtgaaagtaaacatggtatgcatcagccaaacagtaactaatcccgacataatttcagtattaaatgaggcttggaatatgtatttgaatgggcatgatagtttgggaaactctaattcagagatgtcccacttataacagtgatgttggagaatagggttaccagttatggcctatatttgctctgtcatatcacgttcttacagtatgtaattatatttggagaaatatcctttgagccatagtattttggagtcaagtattaggctataatttagacattgttttagtagaataaagtaactttataagattgttccagatctttgttctatatctctgtcttttatccttcccccttgcagaagtcattcctatttaccttatttaaaaaacgagagaaagtataactcaggctgaaataaagcaccagactaaaaagagatgcccattttcattcaatatttatatttgccagaataaagggagacaaataattattttgcctttaaggccttgattctggatgatagattaagtagacagactgttgaccacatgtgacttaaggaatattgttaattattttaccaatctttggatcaaggtttgcttgaagtaagtaagctgtgctgtggataaacctttggatgataaagagtgagctgtattgccttcaatattgtttgcatcagaacattactaagtggtatcgattttgaaaaataaaattcaactttctgagaacatagaccagattcaagtatttttatctttttttc

SEQ ID NO: 35885 - DNA, 1071 bp, Homo sapiens
aaagcagttaagtgaatggtcaaggtttttgggggggactttaactttttactttatacctattttatggttgggtttttcttaaaactagaggcatatatttttgtaataaagaaacttacaaaaattatccttgagtttttaatttatattgttttggtgtgttcgcatatgtgtgtgtgtgtgtgcttgagtgtgtgtgagggtcctttctgaaggaaggagatacattttaaaaggaatggccttttaaatggcctatttttctatttacttttgggagaaaagaatatcgcccagcattccacataacattctggtaaacacattcttacactcttttcatattcataacttaaagttttgtgtgttttttttttttgtgggggtggcaaagcagtaaaagaacattattagaattaagatgggtacaaatttcagtcagataatttattggtttttgaatattttgatttttctttacagactagagatcactaaataaagacgattctgaatgcacattgaaaattggatgcttgtttattgatagtacatttcattgaatgctttttcaaggttaatatagaataattttatgtcagatcctaccctttttctgccttttgattaatgaaatacacaatacattttgaaaccagttgcataggtattttttattgttcttttgtgtgagttgagatgtttgatttatgtaagtgatttttgaaagtatttcagtatttgataggtccttagtgttgttctgaaggaagttaaattttcagttttaggaatacttggaatttgttatcatacttagttctctgaaggataatattgctccattgagaaaatctaaaatgttcaagagacagtgacaataatggaaggtgaaaatggcggatttgggttaagcaaacattttcattctttttaaagtctttaatttcttgcaactcagttgtgttacaagtacaccctgggattgaaaaggctatcctcattattttttttccactttgcattgagtttcatctattttgcggttgtgagactgatgcctgcctt

SEQ ID NO: 35886 - DNA, 1025 bp, Homo sapiens
tagataaaaacctggttgtcttttcagtttttgctttcagtgccctgtgttcctctaagaatatgctttgtacttgcttttcagttctttaaaaataggacatttccttattttttttcatctagaaaagatccctaaagcaagcttcagagacaatacggtgcaaaattccttgtcattttgaactttcagctgactgaaagattgactttcagctgatagtaaactgttgcttgagtatgctaaatgttttatgtctgcggaattcgcttaactaattttgtgtcagctaatgtatgtgtgtatatatgtctacaaatatatatatgtgatgatgtccacaggtgaacagaaaaggagacaaattaacccaggtgtaatttgaatgttgtaaccacatgcatatttcagtgacccctctgtacagatccacagttcatttcttcttaaaatatgctgaaagaggaaaggtatttttgtaaataaaatactcttgcattatagttgttatctactagtggagctatggagatttcagagataaaaagataacttcaatttcagtttttcccattttcctggtaagaaaactgaggcccaaactcgttgagtaaattgtttagagtggcataggaaatggcaaagccgtgttgcttatttttcctactgtttgggccgtgtcttagtttggtagtctctgaaatcaagcatattcttgaatgtaacttgaactctttggaggggttatttggctaacatttattgaatgttaataaatgtattcctagatagcattttagtttcaggctaaattctaatggctgcagtgcagtagtggttctagcatgctcagttcatgctagtgtaaaacatttgtggatatttggaaatcgtagtaatgtttgagattaaagttcagaaaaaggattgttaactacaaaactgtattacagctgtgtgattatacagcaagtccttgaataacattgtgtcactatgtcattgatgagaaaataaaaaagtca

SEQ ID NO: 35887 - DNA, 1051 bp, Homo sapiens
aggcacgtgccaccacgcctggctaattttttgtatttttagtagagacggggtttcaccatgttggccaggctggtctggaactcttgccctcaggtgatccatccaccttggcctcccagagtgttgggattacaggtgtgagccactgtgcctggccaggattttgtattcttgatgccatttttacagttctttttcccttcttcccccaaataccacttgtgtaatttttgtctgatatacgttcagcccagtgaactagccagtcttttcacgattgtggtttatacttttctctagacagtggtgaagctgatgagtgaaatgaccaatggctgctttgtgatgatggcagggtagaatcaagtgagacttgagggcagcaggtgcggaagactgtgaactcaacttgcctcacagctccagtttgttctttctttctttcctttcttccctcattttctttcttcttttcctctgtcctttcctttcttggggatggggtgagggaagggaggagaaaggagtgtgtggtagaaaagaagacaaatcagaagagataagtaatacctactgagagtatattccatttccctcattccctccagttgtccccctcttcctccaatcaccctttagggaaataaagttgaggtcagaaggacctatgtgttacagctgctgcttagctgctatttttagcatggccctacatcaggctggcaccaggccacgacggcacagggtcagcacgttgtgggactgctggtaaatgtcaaaaacttaactttcagatatcaaacaaaactaaatttcagacatattctgtgctgtggtactctatttgcttttattttttctgaaataggatgtacatgtttttagaagtgattgatctttaatagtagccatacataaatcttggaatatgtaatgtatagtttattttaggtaggagaaagatttaagaattgtcttgtcaggtcagacgtgtaatccagctcaatacttttcattttgcggtgccaccaagaggtgtgaaatttgc

SEQ ID NO: 35888 - DNA, 1064 bp, Homo sapiens
cttgcagtgagctgagatcatgccactgccctccagcctgggcaacagagtgagactgtctcaaaaaaacaaaaaacaaaagcaagatttaaaaaagaatgtagtttgtatttttaaaatagcatacgtaggatgagtcttggtggtagtgggttaagccatggtggattaagctctgaaaaaccaaaaaattcatgtagccgtatttagatatagagagttctcacccctacctccattcaggtatttgtacttcattgggctgcttatttaatattcttgtataaaaacttttcacatctagattttcccccttcatacttcctgttaaagataggaaacattatagttcagaatgtaatctgtaaaaagttcagtatatgacagtctattttagggtcgtttcagggatttattggctttaccacatttaaactgctagtttaaaaatttatgagttgctgttttcctcttcgatcctttacaattgtgcaacaattaattttctcttcctcttttgtttcccttgtcttagaattgagctttgaacccaactctttcaggaagccttatttaataatcctaaaacattctatgtcttagattcatactgtttcttcttaaaaatctgtaatagtaaaccagatccatttagataatctggcttcctttctagattgaggggcattctgtctctccagtgaatgtgggtagaacaatcccttctgtaagggattgttgtggagactgaccctcgcctgattcacggtcttttccaaatttgagaacacagctgtggaactcatcgttaatgtaaaaatcggagaaaatgagggacagttttttttaatgagaaatcagaatatcctttgtaggattgtagatttctaagcatctttgatgaaggaagcatcagttgtctaatcaaattgaatcaaaatatggagtgctaacagatgtaaaaatactctaccatacactgttatggagtagtcattttgaatttatcattgtttagcaggtatttctagtcttgtttttttggggtgagaattacagagcat

SEQ ID NO: 35889 - DNA, 1028 bp, Homo sapiens
ctaatttccttcatttattcttctagttttctgtatttttcaaaaactctgtaatcatatattgatttcataattagagaaaggaaacattgttttaaaaaaatctgtctcattaccattaaaacacaaatttctctatccacagatatatttttgttaatagtttattataattgttgcctgatctagtgcagctaaacagagcatgttttttattcatcgaggtgtatcatgccttaatgtcctaatttctcccttgtttttgaccctagtgactaatgaatttttgtcttcacttggaactctagaatttgcctgaaaatggaaaagggacagctaaaatcaattctatgttattcatgtgtagaatggacagttgtgggctgacctcatcacttagggtttagtttccaggcttccctgaatatgtaccatggcaagtggaagatggaagaagatagaacaactcttagatttatgtttgtgaattccttatgtcatatgactgcactaagatctacattcccttcttttggaaactttcattaataaatgaagagagttggttagcatttcccccaatttaaagatttacaaataaattattcagaaaaataatttcaaataaaattttaagggcttattatgaactcaaatcttacttgtggttttttcaattgtatttttgggtattctcataaatccttgccttggaaagttgtggtgatatgacccagactacctattccacattctatttttgctatcacagtttaatattttcagtgaagtttagactggattagccatcacatcaagcatttcccccctttctgacctgttagtgtcctttctgcacttctaatttgtaccatagagcgccattaaaaaaattttatatgctatgtttgtacacacatgcatgtgtaagagtggactttgtgtatgtataagagtgttaatcagcttgcaaactttagacaggcagggctcagctcttagaatctatattgcagccaggatggtgt

SEQ ID NO: 35890 - DNA, 1053 bp, Homo sapiens
tggattgtgttggcagccctgtagatagattcagcagatgctgtagacattctcttactaccgaattatagcttaaagacctaactcttagagcaagccttaaaatgtgctttccccgctttgttttaggaaactcttctgtttgctgatgaggaaaggttatctttccaggcagcatccaggaatggtcttttgaatgtcttcatgccttcttgtgacctcattcctgctgccatcgtacttatccctgctcagattaactgcctgcgtgttcaactttattccatagttggatctacctgtagcatttgcagctttctgtgtagactgggcacaagttaaaagcttaggaagtctatataactcaccataattttagcactttaacttattaaggtacatgttttggttatctgatttatagaagtaccatgtaaaaatccacctatgctgtacaattgctgaaatactgagtaagctctgcattttatgaccaagttataggatgaataattactctctggagtgaatggttcaaaatgaaataactgtatgccttaggtgtgacgtgacacgagatgtatttaagccccaaaagtatgtaattatcacactactcttgcatagacacacaagtacatttttgcttatggcaagagttttatgtgcaaaagaaaactcactttctggtaagcgaaggaacagtccattatttttgaggggttcataagttgtttggtattagaggctccatttcaatccccctgcatttctttagggtctaatttaaattcatacatcacttgattctagagtaaaccattatcataccctggattttgaatattaaggacagttgagggagtttctcaaagcaccattttatgacttatagtctgcctctgtattcagtgacttattatatattccattcttagactgcattttgatcatcaactgtattaaggcaatatatgttgtactttattttactttctactgaaagtaagagctattttgtagtctatttagatttttaattttataatctgg

SEQ ID NO: 35891 - DNA, 1049 bp, Homo sapiens
ctggccaacacggtgaaaccccgtctctactaaaaatacaaaaattagccagatgtggtggcaggtgcttgtagtcccagctgtttgggaggctgaggcaggagaatcagttgaacccaggaggcagaggttgcagtgagctgagattgcaccactgcactccagcctgggcgacagagcgggactctgtctcaaaaaaaaaaaattatatatatatattttatcaatcagcttcttggatagggaatggctgacaccttgaattttgaaaaatgtttgggaatggcagtttctatggtgtgacacagaaatatagcagtccttgatatagttgctgtaataagaatggaacattctaaactttgtttccgatttgacagctcttttatttttgaggtatctcagatatattttgtatgatccttccatttcaccctcccttgtgtgcttttattttaatccattgaagactttgtctcacagtaaacagtgtgattatgttctcttctaccacttagcggttttcagtacttaggtttgtctaatgggctcatcactgaaagatggagtcaattccctttgctgacttactagagagtgtgtgcaaatagcattaggttggcatagtgtactgaaaagttctgtcagaccaccatatttggcagtaagtttggtaaatgtgtctaaaatgggcacatctgcccaataccttagttcctcttctgtaaagcaccttaaacctccaaatgtatcgtctatcaggtgtctttttttttaagatggtctcattctgtcacccaggctggcagtgattttggctcactgcaacctccacctcccaggctcaagtgatcctcccaccagtagctgggactacaggcgccgggcaccatgcctagctaatttttgtatttttaatggagagtgggtttcaccatgttgcccagtctggttttgaactcctgggctctcagcgatctgcccgccttggcctctcaaagtgctgggattacaagcgtgaaccaccacacccagcctaagtgtcattt

SEQ ID NO: 35892 - DNA, 1114 bp, Homo sapiens
cctctgtttccacatttatgaagtacatttaaaagttgtttgtggctgggcatagtggctcacacctgtaatcccaacattttgggaggccaagatgagacgtataacttgagaacaggagtttgagaccagcctctgtaacatagggaggcctccatctctacaaaaaattaaaaaaataattagccaggtgtggtggcacatacctgtagtcccagctacttgggaggctgaggcagggggatcacttgatgccaaaaggtcgagactgtagtaagcagtgataatgccactgtactccagcctgggtgacagagaaagcacctgtctcaaaaaccaaaagtttctacctacacggtaggattgttgtgaggattcagtgagatttcatgtttaaatagcccagtgcccagcacatgataaagaactcaaaacatgttagctgctgtattttatataaaacataattattagtaattcatagtagataaaccaataattctccacacttaagatagatattttaaaatttagaaacattttactcagttgaaataatttaaaagtattcatattaattggtgtaataagttaggacttattttaggactactgccaaatgactatgcaaaataattggcatagttattctagataattgaaatgtcttgcttgatgtaaacagtagaaaacaagagagaaaaacctctgagcagtctgcctttggttttcccttatgttagcccttgaatttttaaataaattcttttaaaataacgtttgggctttggctcagtaggaggcttaccttttaaattatcagtttgccttttgggtaaaaatctatggattttctattatggggtgttagtagatgaaacaactcttactgctggccagctatcaagaaaggacatatatctgggatgtcatcagataattttattttgatcacattgcttgcacaagaagcaagtcagtcagctctctgatggagatctggtaaggggaggagaagcaaatgagaatgtccttcaccttggaagtgtagtttctgctttgacatctagcagctgtatgaacttctgtagctcacttaagcttaccacttacc

SEQ ID NO: 35893 - DNA, 1030 bp, Homo sapiens
tggtggtttatgatgatcctgactgacggggcattagtttttccccttgtatacctcctcaagcacagctctgtatacttacgtgagaaccacccaccatgcgaaaataaaatgcatccctgccatacctcagaaactgtcagtctagtaggggagatgttaagatttgcaatattactaaaaatgatttttttatctaatgatgttagttttttagatcaagagttaagtggtgtaaatggttcttcctcttcccacagatatttcactggacatctgagatgtcagattttaccaaaaaacaaactacaaaacagaggctatagcataaatcagattatggaacattccaacttaaaactcaaatggctttccaattgtatttagaattaaataacttctgagataacttctaagaccctaagtgagatcataaccattttttcttttgcatcctctgtacaaaagaacttgaactacatcgaacaaattatgaaacatccttatcattgcactgttatttttgatttttgaaaaagtttcaaagaacactcagatttgtattctattttaaatttgcaaataccctatgaaatcctcccctcccattatttaaaagctgtataaaaataatagaagcaatgaaaccacattttgaaacatgtgcaagatactgggaaatgggaaaagtcattctataccattgtgttaaccaaccatagtcactattttagtgtttttcctccttgtatttcctatgcattaaatgcaggttttcattatttgtacatttttatatctagctctttttggtttgacattgtatgataagcatttttctgttatatacaagttatgtgtaaacataaataattcagtggatttatattttatttgaccattgtcttattttggacatttaaatttgtttccaagttttcattttatgcatgaggctcagatggagtgtctttgtgcatgtggagtaagcactgcccttcactctgcccgtattttctttcgcctttaa

SEQ ID NO: 35894 - DNA, 1039 bp, Homo sapiens
tagtaaaactagatgttcaaaagtttattgggtaatgatgtttaaataattggctaatttctttacctaaattgcttttattttaaagagaagcacgtcagaattttattaggcatattagctagtgcatggcgtggtgatttgttaggttttgggtattgtaagagagttttatttgtttagaagtagttggcaagatatttatcttttgattttttttcctaaaggtgagttttatataggaatctgtacctcgggatcacgtggctttgtgtaccaggcgtccagggagcaattaggagggcaatctgttaagtcttttgcctcagggcagaaccattaggtgtgctgtgtatgtgcctcaaggggtgtaaataactaagctattcatgtactcatcagtttcctttcaaggcatctgtgaaacctttaatctgtggaagaatcagagaaagttgacctattgtattattatcctccctcacctgaatattttgataaagtatattttagaatttacagattggacattaagcacatgaactttaaattccactttccattttgatgtgaatgttctaaaagttccctatgatttaaatgtaagcagatctttaatgtctacagaagagattttttttttttgttgatttattatctttcggagtgaataaattccatttactgatggctgagatttctcactgtcatactacagaaatgagcagcattccagtttgtttcctatattaattttggggcattattgaaaagaaataatcattcgtttccctttctaccattgcgcataaatgccatttaaatgtggagaaatctcttccaccttaaaaaaaaagccctcctttgacactgagcctttctaccccattcttaccctctgccctattttttttttttcatatccaaatttcttcaaagagtgatcacattcactttatttcttcaccttgtacttcattcttttaactttggtctgccccagcactccactgaacctgctaaagatgccagtgttgct

SEQ ID NO: 35895 - DNA, 1055 bp, Homo sapiens
atgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaaggcttcatattgaagctgagacttacaataacaagttgagtggcaagcctggtatgctgtgtcttattgccagaatcttagtaaatgtaatgtttaaaaaaaaaagatattaaaggatagtaagctacaataattaaaactgtgtgatgaaggcacatgtatagatctagatcagtgaaataaaatatgaagacaggaacctggagactgcagaacacacagaacatgataaaagtagcattttaaatcagtgagggaatttattcaaagggtgttgggataactgggtagccatctggaaaaaaataaagttggatctataatttatacctccaccagaatgaaatttaaatggatcaaactttaaaaggcaaagtcacaaaagaaatagaactaagcaggggagaaaacttgtatagtttagaatgaaagttttttttttcttgacataaaaccctgaaacaataaaaaaaacaagattcataagttagattgtataaaaaataaaagattttgcatacttaaaactaccgcaagccactttgggaggctgaggctggcggatcacgaggtcaggagatcggagaccagcctggccatcatggtgaaaccccgtctctactaaaaacaaaaaattagccgggcgtggcggcatgtacctgtaatcccagctactcaggagactgaggcaggagaatctcttgaacctgtgaagca

SEQ ID NO: 35896 - DNA, 1057 bp, Homo sapiens
gtctttggacgactagttttgagttgaaaactatatgaagacaaataatttaataccacaaagaagtgaggatccttttttctagtgtgtactgaaaacagctcttttaggaatttttcatttccattggtttttgtcttgtgatatatgtcttttcatgagggataaattttatttgcactcactgtttatggagtatcgagtaaaaactagaacaaagcagaacgaaccttcctatacaatgccttcccacaaaaacaaatacctccctcaaaaaatttctgctctgaacatgaaaatgcttatctgcagcttgacattattagtatgtctgagtcctagggtaggtaggagatccaggtattatcattcaaaaggaactgaaagtgtgagcactctttgaaaaagcactattagcaatgtaaatgccaagttacatctgataggcaaactcttaagcctgtttgtgtgatatttaaggtgagaaaatagttttgcctattctttatgactttgaatagccttaggactatttcattctgtttattactctgtcttcatactagatttcttttttttcttttttgacacggagtttcgctcctgtcacccaggctggagtgcagtggcgtgatcacagcttactgtaacctccacctcccaggttcaagtgattctcttgcctcagcatcccgagtagctgggattacaggcacccgccaccacgcccagctaatttttgtatttttagtagagacggggtttcgccctgttggccaggctggtctcgaactcctgacctcaggtgatccgcctgcctcggcctcccaaagtgctggcattacaggcatgagccactgcacccagcccacagacagtcattagtaagtattctcttgtaagttttcctaacaattaacatctgtgtacattggttttcttgctaaacttaactctaatttttgccagtactaatatgtagtatccactcatagtttttaggacttcaaaatctgagtgtattgggtatatggtatcagcgtcagcattcatatga

SEQ ID NO: 35897 - DNA, 1043 bp, Homo sapiens
acacaaagctcaaagtaacattatgtgtgtcatggcttcatattaaaggatgaataaaagtacatgcttgcctcagtggtgagcagttgtccatagttttttttgttctgtgacatgtggctacttggctatggaaaactaacacacagtatattacctctttgatcatcagagtgatatatttttccctgttgttcagctgtaactccatatagtcacccttttgaatgccacaagaagggctctttttccctttagtaattgaggtattcatgcagtgtggagtgaatagatccctccaacacagtgcattatatagtagttttttgtgtggatacatgtaatacaatccgttcaaaacaaatgtaaaatttactaaggcttttcatgtggaagtagaatgcatatatctttcttgatataacaaatgaatttggttgtagctaacgtgttgtactagtaaaggtccacctgctaaactttttcttttttgttgaggtatagacagtagagtgataccgatacatgaggaaaatgagaactggaatgcaggccaaaagctggtcctttccagatgaatgcaaccaagactaagtagcatcatgttcatctgatagacaagtgtggctggtgatggctggtcctgcatgctgtgtcatgcatgccgattctctccacacatagctgtcagtcatttggtgacaaaatagccagaaaatgcatctttaatattttggattagaaagagacaatcctttctacctcaacttttctctgatattttttcaaaggaattgagtagtctgctgccccttggcatggtactctgatcaacatttataatcttaagatgcatttttatttatgatgagggactcacctagagttacatagcaattagtaataaaattgactagattttaatgatgccaacggttctttctttaataatttcttcagttttccaaaataacagcagcaaagtcgtgatgccttatgtgtagaaagaaaaaatttgggctgggcgcagtggctcatgccca

SEQ ID NO: 35898 - DNA, 1045 bp, Homo sapiens
tgtatcctgaagtacaaatatactgtacttttcttgatgctttaagaatcctgcagcttggccgggcgcggtagctcatgcctgtaatcctagcactttgggaggctgaggcaggcggatcacgaggtcaggagttcgagaccatcctggccaacatggtgaaaccctgtctctattaaaaatacaaaaaattagctgggcatggtggtgggtgcctgtaatcctggctactcgggaggctgaggcaggagaattgctttaacctgggaggtggaggttgcagccagccgagattgcaccactgcacatgagcccaggcgacagtgcaagactcagtctcaaaaaaaaaaaaaaaaaaaaaaagaatcctgcagcttgacagaaaagctgggaaagcgagaaagtcttcagtgattcaaggtctaaatgcatttggaaattatcacgtggaccaaaaaatcttgaatctcagaatacaattttgacagatttattatgtgttgtgtgtctgtttgctctgtctttgtgttggtcttcctgtgcaactgtcagtgttgtcagtagaggttatagcaggccacagatatatcttgatgaggacatgctgggcagagaataatttcttagccatgtgctgtatatgcatgagccttgatgtacaaaagagtgcatgtagtttttgatctgggaataaaaaaagcaggttctctgaccaatctagggaatttctgtaatgagaacgtgtcattaatgacatttcctgagggcatctgcagcatgagacagaatagaatttttctttcttttttccatttgctgtagagtccctttcttcatcttcattccatatcttctttccttttctctgtcagcctgcctgcctatctgcctgccagccagtcgtctgcctgtctacgtatacatcacaccttcgcaaaagtattcatgggcagctactgtgctgtaatgatattgtgacatttcagagtaatctaccatatttgttttttaaagttcatttttttctgtgctatttattttgact

SEQ ID NO: 35899 - DNA, 1054 bp, Homo sapiens
atgatccacccgcctcagcctcccaaagtgctgggaccacaggcgtgagccactgcacccggcctctcaatacctttttaataggtattcagtttttcactattatgaacaattctacaataaacattattggtgtattcatcttgcccagttacattctgagggcaaatttctagaagtagaattgcttatataattttattttacatatagttatgctttataggaatatattgagaaatgtttaatttttttatagtcagcgctcccagaaagctgataatttgtgcctttaaaaacctacttttaggccgggcgtggtggcgcatgtctgtaatcccagctgctcaggatgctgaggcaggagaatcacttgaactcggggggcggaggttgcagtgagctgagatggcgccattgcactccagcctgggtgacagagcgaaactatctcaaaaaaaaaaaaaaaatgtacttttagacggaatgtactgtgcatccagtagggcaaaaatcattcagattgctagacttgagggttcttgggtctggttttttgtaaattttttgtcttcttctttaggtcttttccagatatgcggcttttaatctacagggggcttggaaacaatataaccaaccttattatatgatgtataaaatagaagcaagcaacccctgagtcaaagtatatggaatgttctagtgctaggggtgggataggaacattgttggctggttgaattttgcataggtaaggactttgttttagtttggggaatatttatattgatgctctgtttgattaaattatttctattacagagcagccatttattgatgaatataggagacaaagccatataaatggagataaaaggcaagctcttatgattaaaagaaaattcccatcctttaggttgcaccagtactcccaggaagtgctagtgcagtgtctgcctcctcactccttccttgtctggcacatcccgcttggagtgctcctttttgggagagtgtgcccttgtctctgggcatgtgccctgggctgtca

SEQ ID NO: 35900 - DNA, 1035 bp, Homo sapiens
gtctcaaactcctgacctcaggtgatccacccgcctcagcctcccaaagggctgggattacaggtgtgagccactgcgcctggctgtgtatgttttttttttttttttttttaaagataatcagtgtctattatttgaaaaatgtgttttatttgaaaacactgagtttgtctaattatggattaaatcctaatatgtgacttcgttgagaaaattactaacattggcattccagtttgtctcacatactgaaatctcctctttatttaccagaacagattccatctctgtcttttgactgaagtgaaaacataagaccttcttttgccttttccacaatctgtcaacacctactgagttggacagaaggtttaagcacagtgaggcttcatcttcgtgttcctgagggaccagaatcctctggttacaaagccctcagagctaaattcttagtggggacacatgtacagtatcagtgtacattcagggttggtgtttctttggctatctgagtaactttgaacattacaaaaagaaatgaaaaacaatcaaaatctcttgtcctaaacactgtaattggtttctccaatttctacttcccacgtctgaatgaacttgtaagaagaaaatacttcctctgtaggtggcctggtcaggttggcctgatacctggagtgaaaagattggaacagagtaaagagcacaaatctgggaccctggaaaactgccctctggtcctggttttgctgtttaatgattgttataactaaacaaggcagtttgcagatctggctttagttttcctacctgtacactcgggggtatagatgatctccagaattacggaatcacagggttggaagtagctttgtgcaaccttcctgaggggcatggacgtgatctttgaagcagtcttgacaggtcgccattacatctccatttgtctgtgttcagcctttgcttggcgtccactctagaggtggggaaccgttggttttcaaggtagttttgagcaacttaatattaggtagcttt

SEQ ID NO: 35901 - DNA, 1287 bp, Homo sapiens
ttagggtcttctgcatctcagggttggaggcttctccctgctttggcagaatttctcttccctccagtcttggccttctccattaacacacaggtactttgaactttatgtctgcaggtctgtgtcattttgctatctctttggggaaccacctgcctaaccttatgaggtcctgttcaaaactgtggttctgctcttttcagcaactgatcattattgcatatcactgtcttttaacatctactaaagctgaaaacatttgtatacttaatatattaatagtatattacttgtttatcagtatgatggtttacataaatgtgaagcctagaaattttatagggacctggtgtagtaatccctaacagatattgaaagaaaggtaaaaattagttgaaaggactagatcatcctcattcctcactcatttttccttaaagaatatattaaaaggcaaagttgtctacagtcagtatcaaaattttgttttaacaatgttttcaacattttacatctttctggtaattttatgaagtctctgaagactaaaatctgtcataattagtcagaagtaatatttccgagtaggtatttactttcaaaaagcctaagtctttaaaggtggcatatgatactataatttatctcagaaatcttttatttatttatttatttatttatttatttatttattttgagacagagtcttgctctgtcacccaggctggagtgcagtgacatgatctcggctctctgcagcctctgcctcccgggttcaagcgattctcctgcctcagcctcctgagtagctgggattacaggtgcctgccaccatgcctgcctaatttttgtatttttagtagagacggtgttttgccatgttggccaggctggtctcgaactcctgacttcaggtgatccacccacctcagcctcccaaagtgctgggattacaggcgtgagccattgcacccggcctctcagaaatcttaaaaaggatttagtttcatttaaaaataacaaacacagttccccaaatctgaaatttagttattgaaactggaccatgttgtccatggaaaacatatcttactttataccagattttaaaattaacactggtgtaagtgcagcctaaaattcctctgagccccacttttacataagaaaaattattgaatatgataaaggtagcatttccaatcagtgagaaaagataggttattcaatttgtgttgggactagtggatatatatctaggaaaaaaagtacagactctaaatattg

SEQ ID NO: 35902 - DNA, 1049 bp, Homo sapiens
gcagtccattttcatttcagaattgctaccagaaagaaattgtaaaagttttcaagcatgattttgtaaagcaaaagatcaaaaaaggagagaaattatgtggaaaattggcaagattaattatatctctattaagaccacctttgcgcaagatagttttgggttattactgctgattttcagcctttaaagaaaaatgtgggttcttggtagcaacttacaaggatggtgtttagagctatagttcccccttctccaccataccctgttttcttgatggttaattttacttttaaaaacatttgtatttcttgactatttattaattagatcattttgcttagtcatacctaagagttttgttagtcttcggtttcttagttgtatgagtcagagtcaggaatgcaaatttattagctttttgtggagagggatatgtgggatggtgagagctgcgggtgggtaagcatggagtgcaataccagttcatagacaaggatctaaaaggagccattaagctccatggaaaacattgttacttgatcaggccagtaaaggaagactattttgagtagctactgaagttatctgatagttaatttaattgatttgagtaactctttcagggaccccagatttgtaaaagtggcactgttgtgacttttgataaagggagttttagcctttcatgagaggaagccttggacttatttgtccttcatgttgagaagcttccgtatgatcttcatggtttccttaggcacaatcactgtgatttcacctatgtatagcagcccaactaaggtgaagtcagcatatagaccaggaagatacaaaactacgaaaactcaggaccagccttggcaaaaggcaacatgtgtagccctaaattaccccggtactctagtgctcagccccacattgacaattgcacagaatttaagtgttctgagtttgtgaatagtattgtaataatggatgtatttcctttttttttttttttttttcagacggagtctcactctgttgccaggctggagtgcagtggt

SEQ ID NO: 35903 - DNA, 1677 bp, Homo sapiens
ggcgtagtggcacatgcttgtaatcccagctactcgggaggctgaggcaggagaattgcttgaacccgggaggtggaggttgcagtgagccgagattgtgtcattgcactccagcctgggcaacaagagcaaactccgtctcgaagaaaaaaaaaataaaagcgcatacctttgttagcatctgcctgtagactaatggaaattaggttggaactgtagttgcagaaatgaaaaggactttgagttcacaaaggagttcactgcctatatctgttagaagatcctgcctcaatatatattatctacattaaacaggtttaggagattattaaatgaaaatcactcaagcgtgccaactaaaattattcaagttcagtttcaaagtggatttttttagtataaatagatgcaggttcccaaagaagccttcaaatgggtagaaatgctgttttttcttttcctatgggtactgtttttaggtatggttagaggacacagtttcagaactgtagaacacagtaattagaaaggctgcctaaggggctgtgtggattgtgtgagtagagtctgaaacataaatgaaaagcaaaagctaatcaaaagaggttcatgttagcatgtgcttttcttggtgctccatcattactgtagctaatcggatccttaccactgaagtgcatacttttaaatttgtacagttaaggacttttgttttgaaatactataagcgaatgcatgtctttttctatatttaaataactgatatactcaagagttttggagaatgggtagattgtttatctgtgaatttttaaagcagattgtacatatcacagttttgcttcataagcaaactgtgtggtttttcttattaggaagcttcaagaaagaccttgaaaccaagtgaaaaccattgaggatatcacaggatggtagagttttagaattcgaaggtactttattggtgatctaatcagtccatcaatttacatatgaataactgaggcagtgagaaattaagtggtttgcagaggtctaaatatctagtagtgggagaatcaaaaccaggactacaggcttttaacttgcagtccagtccttttatcagcaccaaatatggtgatttgaatgtagattatgctaaaggaatggggaatgataactgctttgttcatagcactcataaaacctatccagggattttgaaaggctcaataattttaacacaaagaaggattcaatacagaactagtctatgatttatttatttatttatttatttttttgaggcgaaatcttgctctgtcgcccaggctggagtgcaatgttgtgatcttggctcactgcaacctccgcttcccgggttcaagtgattctcctgcctcagcgtccgaagtagttgggattacaggtgcctgccaccacacccggctacttttttgtatttttagtagaaattttcaagacctggttggtctcgaactcctgacctcagttgatccaccagcctcggcctcccaaagtgccgggattacaggtgtgagccactgtgcccggcctactctatgatttttatttaaatgaaaccttctagtgactatctagatgagtgaggggtcaagacacagaaacaaatgtttccaagggaagtggtagatggcgatagaaatatggatg

SEQ ID NO: 35904 - DNA, 1035 bp, Homo sapiens
ctgtattggttaaaagtttgactactggctgggcgcagtagctcacccctgaaatcccagcactttgggagaccgaggcaggcagatcacaaggtcaggagatagagaccatcctggctaatgcggtgaaacactgtctctactaaaaataaaaaaaattagccgggcgtggtggtgggcgcctgtagtcccagctactcgggaggctgaggcaggagaatggcctgaactcgggaggcggagcttgcagtgagccaagatggcaccactgcactccagcctgggcgacagagtgagactccgtctcaaaaaaaacaaaacaaaaaaacaaaaaaaactttgactacttcacctaccctcttaattcttcattaaagaatgaggcttaattaaggcatagcttgtgttgacatgggtataaagtcaatgcttagtttgcctgaagaaagtttcgggttttcttttttctgtttttgttttttttcttttttggtctttcttgggactgggctaaaactgtagtgggtttttctcctttctgtttttttgaactacattagccattcacagaacagaagcaaatagccatttttaaaattcatgtcttcaaatgttaatttgatgctttgaggcataaatgacctttctagccagcccagacttgtcaaacaaaggactgataggaacaagctgctgtttgttctaatacaacaggctgtttttcatagagaatttcaaaacaattttgcttccctcttctctaaaacattaaattaaacttcggcttgtgctaggtttgaatttagaaacaattgtgtatacacaaccgttaaatggaatcctgaccacctgtgcaaaacgaactgcaggattcagcttgtaagccaagccacagagtacgtaagagtgttaaaagaaagagagaaagaagaccaaaaacagtagatgagcagagtgaggcattgttacatagcttcatcttgttatccttgcatattaattgaaactggtgaaatgaactgaatccgtgttgtg

SEQ ID NO: 35905 - DNA, 1059 bp, Homo sapiens
taaatgacacagcccatcttgtagcctagggccaggtacggatgcggagtgtgcaagggttctgtgactgcccaggcttattcctgtagttaagactcaatttctatatgcccatggtttgagtatatcacaggttagccttctcacatttactgcaattatggtttagcgaacttatctgtttgactgagttagaggcaacatggtatagcagagtccgatgaactgccaccttacagtgtttggtctaggtgctgctgctgtccacacagaaagcctatcactgagacagtaagtattacgagggaagaagactttatttgggtgctgctactgaagagataggagatcagtctcaagtccacctttctgatggactaaaattaagggtttatgtagcagagaagaaatgtaaccatgtgtgggaaaataggaattagcgaggggtaaggaagaggagttggtcaacagaaagcaggtggtcagttagccaatcatggtgggtgtggggtctgatgtctcattattcagatgtggtgatctggttaagtttcagttccttgagactgtttgggaggtctgatggttggtttcttgagaaaggaactcaagataagaaaattttaactttctcaagttctaagactgggagggtcaatttctgtgtttattcaaaagaaactgtaaacgtcagttctgtgggacagttgggccagtttcggtcccaccctttttattgatcaattcatcattcatagggaatctgtcttgtcagtctttctggctgcttcatgcttaggaggggtgttttgggcagctccataccatggatgaggaatcaaagtttaatctaatacatagttttcttctgaagcacaatctttctctctctagtccttcacttctatcaaagacagatcacagcaggaccaacctacctgcaaaataagcttcagtcccatatacttggcctgattagtcatgtgaaatgcaacaagaatcattgtctacacaggctctcctaaattggctttgctggaacctatcacaaggccattt

SEQ ID NO: 35906 - DNA, 1073 bp, Homo sapiens
tcatttttcagaggtcttctagttctctcctctctgctgtaaagaaagacatttttttgagtctgagtcgctaaagtttgttgtcttgccttttccctctcagtgccaatggttgatgtcaggattttgcccgtaagacaggtcgaccaaggcctttgtaagccaccgatttaatgtttcctagctttaacagcaaacactaaaactgtaggagatggccttctctaggtccccaaaagtggctgaattaatcacctctgcagtgtagacatctgctgcctaaattctgcctgaataggttgaatttgagaaatcaattttaacaaaaagggacactgctacataaatataaatttaaaagcattatttggaaaacggtgttactgtggcagttgggtcacagttaagatgaagatgttaactttgtaaacaaaagaccttcactctttcttgttttgaatttgttttccagcaaaataaaataaaataaagcactaagtcttcaattagaagtcaaagctgtgaatagctccatgcaccagacacagcataagccaattataaacgtgtcttcatagcccagtttaaaatctgcataatgatatggtgatatctaacacctataagtaactgtatccatggtgtgagacagatacctcattcggtatggcgtatatatgctttattagatacactggagaggtgtctgtctgatgcctcaggatcatgaatacttttaattattaagatctagaatgtgccaccctgcttaacattctctccaaacagaattctaccgctcccaccatttttatccccagcaaagattctgattcagtgggtctgaagtggtatctcagcatctgttttttacaatatctctggcattttgatatgcccttacttttgagaactactggggcaagcaagtttgatgttgggataaatcacaactaaatcagaaccaaatcaagcagtagacaggggacgccaaagacttagatagtggtccttcatgtccatgaattctcctttgctttctgcctgtgacattacattaccaaggtaggcgg

SEQ ID NO: 35907 - DNA, 1061 bp, Homo sapiens
cagcagcagataatggtgaaaacttattgaattaacatagtaaagagagaaatactctgctaagtttacttgtctcatatttttctaaagtctttgaaagacattttttccagcatggcctacacagctttataaacatcatgtatttacaatgaaacacttttgtgaatttgattttttagagaacctataaactcatctccagagataatagtctctgaacctaaaaaatagaaatatctcaattctaaagtaatctgcatttgacttagcacaaatcaggaaagttctggaaataagagtgatccttgtatttagtttgtcacaaatttgtatgtataattgaaattgagattgaattaaaaagtaggcaaaaagagtcttaattaatccttttagcacagagtttttatctagcctgtgtgttattatttttctttctatttctaggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtatgattgtctatttctaaagaaatattctaaatatatacatatatagggactatctgaatatgatcatgtctacaataggataaagacttttaaaaattaaagaacagggtcttagctgaccaatagaaacttttgtattgtaatgcaagctattttttccttaggtgatcttagacaagatatgggatatttttgtctctctcagttcctatcaataaaatggtgataatttatacaattttgaaaaacctcttacaataataaaagcaaaataattaacagtgttattcaaaatgccatttttttcaagtttttccctttctagttaattttcccaagagaacttagttttataatccctaaaatgtgctttaattatttagtttaataatgtcagtatctgtaagttaatttcaaaagcttgagttttagagtcatatagatctcagtttgaatcca

SEQ ID NO: 35908 - DNA, 1023 bp, Homo sapiens
accttagtgcaaagtggttgaactaaccactgtggtttcctttcagaatttattttaaaagtctatgttgccgttctcaaagcagcattcagggagcacacaggggaagtcagctctgccaccacgcctgtcagaatttactaagaaatgaattttgacagcttaagtgtaattttgcttttaaaattggctttcaggagcccaaagaatagtaaacttccagttactttaatttttttcttttgcctatgatgcgtatgaaatgggtaactattctttttattaataatcactttctaggaattaatatctgttgccactcattagaggcaacaatgtgtatagttagagagctgtggttcagaatcctcccacacctctcacccctgatacagagcaccattttctggaaacctggcatatttgtgtccctaacccttcttaggtccaggggtagtttccatagttaagctgtggtgtcatctgtgcatttacaaatcaagatgctctgatgccacacattgagagaggatgttgctcaaatgcagcaaggttttacgctatagagggttcctttctctgaggcacttgtattgtgaatgctgtctgcccctgagttctgggtttttcatctagctgtgggacagttaggggtttgtttatgaggtgaaatctgtaacggatgctataccctgaagaatcttttttgattaaggattatattcctttctatatcatttacttgaaattcttatttgtatatgttataactttatgtgacattttaacaatatgctttacaagaagtgttagttcattttttaggaacgtaaaatgtgtatgctctcttcccacagccggaccatatagtggtttaggtgaaataatccatcgggagagcgttccaatgcacacatttgccaagtatctcttcacctctctcctacctcacgatgctgaattggcatacaaaattgcactgagagcaatgcggtatgtattcacagcccagctgggcagagg

SEQ ID NO: 35909 - DNA, 1027 bp, Homo sapiens
tgagggaagtgttccttttaaaagtcatgcttctaggctgagcatggtagttcatgcctgtaattccagcactttggaggccaaagcaggagaattgcttgagcctatgagtttgaggttatagtgcactatgatatcattacccactacaataaaacacgaagttcagatggtcattcactagggtgtgtgatattttggagtatagaccttaagtgattatgacatatcaaaataatgtggtcttatgtttcttttttttttattgcagatttcattgaatatacttctattaacagcctgctatatatcaggcattctgataggtgttggagatacaaaaaatgaataaagcaaaaatagttcctgccctcacaaacaagtaaataagtgattcatctatagtgtgattagtactgatagaaatatgccattttgtgtgtacattattactaccttccttttgaagattaggcttttttgttagactcttgaagttatggaccttttggatggaaaatacatgtcatatatgccatctctcctcctctatgaccaatatccgtgatccctcatagcattcctgatgaatttagcctcagagttttttttgagagggagtctcgctcttgttgctcaggctggagtgcagtggcgtgatctcggctcactgcaacctctgcctcttgggttcaagcgattctcctgcctcagcctcctaagtagctgggattataggcatgcgccaacatgcccggctaatttttttgtatttttagtagagatggggtttcaccatgttggccaggctggtcttgaactcctgagctcgtggtccacccacctcagcctcccaaaatgctgggattacaggcttgagccactgcgcccggccagcctcagagttcttaatacagcattatcagccctaatagccctagtctgccaattgaaattggcattgtcattattagcctatttcctatactctagtacctatttgagttataagtttataacttttaaa

SEQ ID NO: 35910 - DNA, 1029 bp, Homo sapiens
tcacatagtattctctttctgggtaaactaaatgcttctctttagcccacattggctacagacatgtactgttcgtatatgtcatggattactgcatatctccatttggatatctcataaacactcaaattcagcatgtccaaaattgaacccatcaccccttcctcaagtttacttcagtatttctcattcactctattgctccagtcagaaacttggttgtcttccttgactccttattctttcttgaccttatagccttattaccatggtctcttaatttaatgactcaagtaactcttcctgcactttttctgtacctaccgctataacttttggtcatgctagcattatgtcttgcctgtgctgttgcaacaaattcctaataggcctctctacctaggagagtaatttggttaacaacaacaacaacaacaacaacaacaaaaaacccaaaacaataatttggttaattactgtttcagagtaacctttcaggcatgtaggtttgaccctctgatcacaggcttaaaactttgaaagtgttctctacttctgttgccctttttatgaagcccaagtctaacatggcttatggtggaccctgaacaaactaacctgcctcttcagtcttattcttgctgcttatttgaggcacactatactccagacaagctgaactttcttggaacactccacttctaactaacctagctaactgctgtatctccttttgattcctagcctaagatgggtcccctgctttatgagtggcgagtcccctttgtttgctctgtcaaaaaactcattgtattgtattatatgtttgtgtctggtcagactcaagttcctttatattccccactgcctagcacaggcactctgcacactttataaattatctgtttgctgaatcagtgactaaatgaacttccagcttctctttcactgctctgtctattcaagttttgacattctaaaaaattgacttgtgttgttcatcctccaggcatcaagaatatgacatga

SEQ ID NO: 35911 - DNA, 1033 bp, Homo sapiens
aaggttgaaaaactagctgttgggtactctgctcactacctgggtgatgggatcatttgtataccaaacctcggtgacatgcaatttactcatgtaacaaacctgcatatgaaccccaaaccttaaataaaagttaaaaaaaaatgcctctgcagaccaaatatttctcttggtttctgatctactttttaggtactatcccatgtatttcctgccagtatcttaaacttaccaaaaacagaatccattgcctttatccccatatttctgtatttgtattctgtctgttggttagtggagacaccatatatctggtttctcaaatagaaatcttattgataatgccagcttccctcattccttgaggatgtttgctcctggcccacccacactctcagcaaaatgaccttgcttgtcatttcaccaccaagaaatataaacaaccagtaaagaactacaagtcagccacatctacccaactaccagcatctgtgcctatatgactgccttccttcctttgctgtggacacattttttctgttcctgttttgtgcctctttcctccacttgtactctggatcttgtctcctttcacctgcccagtcacaacttcagtggtctctctgtgctgcatcaacagttattttctttactgagtcatttccatcaatatggaaatgctgttatttctcccatccgaaaaaaaaaaaatcctcttaggctaggtgtggtggctcacacctataatcccagcactttgggaggctgaggcaggcagatcgcttgagcccaggagtttgagaccagcctgggcaacatggtgaaactccctctttacaaaaaataccaaaggttagcagggcatggtagcacatgcctgtggtcctacctactgaggaggctgaggtaggaagattgcttgagccggggaggcggagattgcagtgagccgagatccagccactgcctcaaagaaaaaacaaaaacctcttgactactctctttgaggcattgctcctgttttacttgatct

SEQ ID NO: 35912 - DNA, 2083 bp, Homo sapiens
aatagcttaaaactaagcaccaggtatatgaaaaaggaactggaaattttaattgtccagaaatcataggaatactgggaacctgtagttatgggaaatggctgtttttctgaagttgaaaccagtttcaattacaaaaccctctgaaattttgctaagcctatagttatctccctaagaaccataaaaaaagataattttattgttaatttcattccagtttagcttcctcattttacatgttgggagtcatgccctttaatatgcctggcactgcacggtggcagtagcagacttgggcttacccagaaccctaagtctctgacgctataggatagcgaaagaggtaggcaatcgtaacagacactgtataggataaatagggaagagaatgagagaaccaaaataaaaataatttaagaaacaattgttttactgtacatgtgaataacaagaaatggtacggggaatgtgaataacacgaaatggtatggggaatgtgtgactagtgaagcatattttaacttttttattactggaggaacagagctaaaggcctaaagaaggccttacagtatataacagtaaatagaagagtaacatctttatacaataaactgttagaaatgataagtgtaaagttgtgcgtctctgcggctcctgaacttgaagattattatgaatagattggaccagcattatatattaaaaactttgatacttagaactttccaactttaaaattcagaatcataaatggtgacaacagtagtagtattgaaccaaaaatagtcaagtaaataatgtctcagtaaagcaaaagcattatcttctcaaatacaaaaaatacaaaattcatttcttttcttgaccttgaaaatttctgttttccaaatacctaggaaaaatgaataccttctgcgttgaatccatgtagcaatctgaaaaaagaaatcaaaatggaatggtactgaaaagctaatttgtagcacataacggtatatagttctataccattaatactaaaacatgaatacagcatgcttacagagcccacccactcctaatactagttattaaagaaacgttactggctgggcgcagtggcttatgcctgtaatcccagcactttgggaggctgaggcgggtggattacctgaggtcagtagttcgagaacagtctggccaacatggtgaaaccccgtctctactaaaaatacaaaaattagcctggcatggtggcacatgcctgtaatcccagctactcgggtggttgaggcaggagatttgcctgaacccaggaggcggaggttgcagtgagctgagattgtgccactggagtccagcctgggtgacagagcaagactctgtctcaaaaaaaaaaaaaaaagaaatgttattgtctgactaaatttataagatatgtattggttaaaaccatgccatgttggtgcctctttcattagagcctttatgtcgtaatgaatttgactaaaattatcttagactttcattatcccaggcctaagaactcactggcatttgtttcaaggtaactgaacaagaagctgtttggaattggcagaagtcagatgaaaaaccaatcttacatgccccttcttcctctcttgagctgttgtttatattcaaattaaatacacattgtttctctctgtagatacctatgtacttaatagattctagttagtaaactgcacatgcccaataactttgaggaaatttagtgaaaatgaagaaaaagagaaaatatttctctttagacctgaggttatgtttaggctggcccatagaaacaggtccagataaatttctaaaaaagcaaagtagatatttatgaatagtattcaatgcctaggattaacatctaaaatgactcagtagtactgctagccagccaataaaatataaactccatttgtcttagttatatagaactgtgtttccagcttagaaaaagtcaaaccaatgacttttagaacaatctactctcattttttattcagcctctagaacatggaagctttaaaagtgaattggctaaataggcaagaccttctgaaag

SEQ ID NO: 35913 - DNA, 1679 bp, Homo sapiens
gttctcctgcctcagcctccctagtagctgggattataggtgcccaccaccatgctcagctaatttttgtgtttttagtagaaatggggtttcaccatgttggccaggctggtctcaaactcctgacctcaggtgatctgcctgcctcggcctccaaaagtgctgggattacaggtgtgagccactgcccagccagagaaggacctttaaaagcaataagcataactgctgttccttagtgggttttgtacagacatgtatttttgtttttcagctaaggagacaccagagggtgatggttgacagtagttggtacctcacagctgggcactgatcaggtagggggtgtcaatattgtttaggataatgtataacttttcttattagggggagattagtcacggggaactcttgtatataccaaacaggcaagagacttattgcagtttatcagtgccattttactaaaaactcccggtgagacagaaatactcaagtttttcggacaggtcttcctctcacaggtctgcctcccctgtctattgtcttcttacatactttatacttcacccatttattatttgtttcccatttatttgtctccccactataaaatatgcttcacaagtcttggatttttttttgtctttttagttaatcgatgtatctcaagtgcctagactagtgtctggcatttgcaggtgttcagtatatatttattgaattaataaatatggaaaagcctaatgataaagcaagaaaatatcagaaaggggattggagagcgcaggattagaaaaaagggtgttagatattcccagtgaaaagtattattaaattttgttggcttgatatgctccatttcagtataggaagatactgaatggactgttcatacattcattcatttttttcagccattcagcacactatttactcttgcagtgttttttgtagatatttctgtctttactctgataaaatttgtattccatattgttgttcttggacctctgtctcttaccttttctgtcttctgtctgagaaatcataatttctgttactgtttagttgatcatacatttactgaacatccttcacactgtgctaggtaatggcatttatagatgagtaaaacatcattctttcctttaaacagttcatgatttggagatgagatagaagtaaacaaggaagtaagtacagcaatagaagtgtgtactatgcagaacagtagcatggaggaaggagcgctttactgtctacagcagttaaagatttcctcaggaggtgatgtctaccatgaacagcaactttagtgatctctgtgtccgttagcggccattttaaaaagcatacataaaagtagacagaattttatgatgaacccccatctagccatcatccagctttaacaattatcaacttcatttcgtcttacctcccacatacttctctagttacattgatagaagatctagaagcttggtcagattcaggtttgtttgtttgtttttttggcaagcagcccttaagattttggtttctcaaaataataaacttcatttctttaagttttctaatatactcacttttctattttgattattgtagaactcttccccggtcttcacagaaattaatttctttcttgtctttggcatattgtatttctctag

SEQ ID NO: 35914 - DNA, 1033 bp, Homo sapiens
ttctgcagcatatagctggggtgtatgagaaatactggctggctggctacccattctggggagaaaccgtagcccttggctgggagttagggtgagagagagccctgtgttcttggctgttatgtccctggagtagagcttcctcacattgtggggtagggctgggtttgtggctcaaaagccacagattcttactgttccttccaagatttagtaatatttgtcacatagatgtttctgtatttgctgtatgcggttaagacattttccagagactttgagctttttataattttcaccagttagggttgtatccctgaggagagggtctgtggagctacttatgtcatcattccagaaatattctttctcttctaattcttttaaactggaagttaggcccagtcttgattagattaatgttgaccgtttttgatgtttcagaggcgaggctgtgggctgcgtatttcatcatatcaggaggcacttaaggtcaagttgtgttgttgttgttgataactgaatttactctgttggttaagctggcgactgacgatggatttctttattttaaagatttgtttcttcattacaattagcaagtaatctgtggagtgatacttggacacattgggaacattctgttccccaacaactgttctttcatttaatggttttagcatgggttatttacccatgcctgaataaattatttcactgtgggaacctttttattttggaacactcttcttcggtttttactctaattttggcacctttttgttttttgttttttttttaaagtcaatctacttaaagtgttggcatttagtagacttgctggggttattgtatgtgtgaaatgccctaaaactaatgacaaacacagataatacaaatattctgaagaacattgttatgtatggctgaaactgaagtcactgcaggtctgataaatctgttagtagcaggtaaagatgctgagttttcttttgtttacttgtttcttttaaggagaatttttgtttccaac

SEQ ID NO: 35915 - DNA, 1018 bp, Homo sapiens
gaatggcttcagctacatggtataggattagatgacccagcccttaagatcctttctgacttaggttttagatttttgtttaataggtcagtttggcttttttccccatagcatttcattttgtatgtttcttaaaatgatttggagatgcaccattggtggcacgtaagatgatgttggagagtactttactaacaagtcaaagcaattcttttgcagttttcttttcttccttctgattttgtcaaggataaagttaggtgttacttactgtatggtttaatacttttataacacttattaatctcctttttaaaacgaagacagaagacattatgcttagtcttgggcacgtaatggtacttactcagaatttagaaactttgaagtttgtgtgtgtatctcccctccctcaatttattatcttctatttatggaacaatgaaagagagtttcctttaggaataaattgatttaagcaaaaataatttgattatgaattttaaggatgagtatggggtatacttagaaaagatagaaaggcagaacatgaaggattagatgaatgggagtaattcagaacatgaaagctttttgtctccatttattttactgttaattttttattacttgtaatacatattcaagtatgttaacttatcattgccaggtttccatggatctcaatagtgccagcactgttgttcttcaggtgttaacacaggccaccagtcaggatactgctgtgttaaaaccagctgaggagcagttgaagcagtgggagacacagccaggtttctattcagtgttgctggtaagttgttctaaaattgtttgcttttctttttaataaaatgagacaacattaatttgttttaaaaccctagttttattggtagtttagtgaaatagattcagatgtttggctgctgatgcctttgccattatcttattactttatgacttcttaagggtgttaaataaatatttattgataaatataaaaataagctaggta

SEQ ID NO: 35916 - DNA, 1057 bp, Homo sapiens
agatgtccacaacagtcatatgtttaacaaatattgtctatagactatatgccaaatcctgtttagacttcttgtagactcttttcgcttttagtatttgttgcatatcactgtgatataactttctgtaactggcagtttgattttgtaaatcccttgttcattaacctccactggcttatctttagcatcctttgttattcactaccccatgtgagagactatagcatttatatttgtgttgtattttactggtggtctgtttgttatcttcttcttccatgtgattgtaagcacctttatttggacatacacatgtgtgcacacacaagtgtgtgtttgtgtgtttggggatttgctctcctgagaagatatcttagtctactcacttttaaggagctactgattgttttatgttagtcagtttcaatttagtaaaacattgttgagcctgtgggcagacactgtcctgggtactatgcatggaaagatgaataagaatgttcatattgtgtagttactatgttttctaaaaatagtcatttttctctggccatccttgtgggcgtagcagaaggaagaataaaagcccttccaggagagaataagacaaattaacaaacagaatatgaagagtattattagagagcagattagctgatgagctggtggacattgttctgaatgtacaaaaaaaaatcgccagggaaattatcagaataaatttgtcagaagatataggaaaaatgataatgagtgtgttactccttgactactttattttacacatgtatgttgcttgaaaaatacttcaactgtgacatttagtttttaaatgttatccatgattcattgctaaaacgactattcttttactataaaagtgagttcagttcatatattagggttaattttatataatatggcacagagggctactgtgtctgttactcagtgtaaatcttggtattgctttttaaataatgaattcataatgcaaaatatgcaaaaataaaaccagcaatattatttttgtaaaaattttgatgttgtcttg

SEQ ID NO: 35917 - DNA, 1045 bp, Homo sapiens
tatttaacattttaatttcatgattttttcctgtttaggtataagccattgcgacgcagggtgatttggctcatcggtcagtggatttctgtgaaattcaagtctgacttaagacccatgctttatgaagcaatctgtaacttgcttcaagatcaagatttagtggtatgtttcttaagtgccttaaaagagttagtttttaaagtttcatctgtgcaaatcatcaagttcacaacagtttatgtcttttctttatgatgtttatggcctttcactgcactagttattccttggtgagcagtttgatttgagggtagaaaatcttttgattcttgtttgcccttcccattactagtcattgaaaaaaaaattaagctctactattataaagtaatttataatttcttagaaaaaaaggcagttttaaaaaatccctttatagcttacatattctttttaaaaatcaggatagactttggcattgaaatagcatcataatttatttcatctttactgttgattctttgtccctcattttgagaattttttttaagcctttggaattattgggctcttttaaggaatttttctttctttatggtattcatatattattgttgattttgttactgagaacttgatagtaagctcttcattgctttttcccccttcaaagcagtaggtttgctgctttattataaaattactgaaatagtagtagtaattttacaggcgtatgattttaagaagtttaaattgtaaagaatagttttctttcttttttcctactggtgctttactgtatgcctgggtgaatatattagtgacttaatatacatgttcgctgtcttttcctgattttcaatttgttttaggtaaaattaagtgattttttttttctcccctgagttgtgctaagatcttttttaatcatttctcagtctccctccctttacccccccaaattttatttttagtttgaacccacctggtttttgcctgtcagcagaggtttggactgtacttcccttttttacatatgctg

SEQ ID NO: 35918 - DNA, 1057 bp, Homo sapiens
tttcaattaagttttctttgggaaatagagaaattgcttggagtttttcttttttctgttttgttttgggagactgagtctctcttttttgcctcggttgcagtgcagtgatactatcacggctcattgtagcctcaatgtcctgggcttagctgatcctcccacctcagcctcccaggtatctgggactatatgcaccacaacgcctggctgatttttctgttttttgtagagatggtatgttgccacattgcccaggctggtcttgaacacctggactcaaacgattcacccacctcagcctcccaaagtgttgggattataggcgtgagccactgcactgggccccgaaattgcttgggtcttagacttgttttataatgagtctattaaaaaaggaaagagaaaaatgaattatttcagccagcaccttaaaaacagaacattaattctaccagatatcaacaagtgtaactggagagaaagggattcatggccagataagtttggaagactctgaaataaatattcaaatgggcctcttagttaggcaactggtcagagtctttaaaaatgtgcatttgtggcatgcgtggtgactcacgcctataatcccagcactttgggaggccaaggtgggctgatcacgaggtcaggagtttgagaccagcctggccagcacgatgaaaccccatctctactaaaaatacaaaaattagctgggcatggtggcatgcgcctgtagtcccagttacttgggaggccgaggcaggagaatcgcttgaacctgggaggcaaaggttgcagtgagccgagattgccccactgcactccagcctgagcgacagagagactgtgtctcaaaaaaaaaaagaaaaaaaaaaagaagtacgtttgcattatgactagcccacatgactaatacattaatattcatagaatatactttgaggaaatgttgctttaggttcagcctttgccctttatatcttctggtggctacatctcacgtttacttgttttgcatatgttttatactgtaactattattttgcaa

SEQ ID NO: 35919 - DNA, 1019 bp, Homo sapiens
agtagaatgatttgtattccttttggtatatacccagtaatgagattgctgggtcaagtggtatttctggttctagatccttgaggaattgccacactgtcttccacaatcattgaactaatttacattctcaccaacagtgtaaaagcattcctatttatcctcagcctcgccagcatctactgtttcttgactttttaataatcgccattctgtctggcatgagatggtatctcattgtggttctgatttgcatttctctaatgatcaatgatgttgagttttttttcatatgtttgttgggtgcataaatgttatttttcttattaatagttttgttttggctaggcacagtggctcatgcctgtaatctcagcactttgggaggccgaggcaggcagatcacttaaagccaggagtttgagaccaacccgggcaacacggcaaaaccccatctctactaaaaaacaatacagaaaactaactgggtatggtggtgcatgcctataatcctagctactccggaggctgaggcttaagaatcacttgaatccaggagacagaggttgcagtgagccaaaatcgtaccactgcactccagcctgggtgacacagtaagactctgtctcaaaaaaaaaaaaaaaaggtttgtctttataattcataaagatatgagtgatatagtcacaattagagtataattttgaatttttgtctgtgtagtttaaaaagaatatatatatatgtgtgtgtatatatattttttagtggcagagtttagcttctattgtccaggcaggccttgatctcctgggctcaagtgatcctcccacctcagcctcctgagtagctgggactacaggcatggaccaccatacccagctgtgtagttaacctttaccagggaattttatccatccagatgttttcttgttacattttaccattattttctttaagattgatgaattcctttcagcagtttttgtaagacaggcctgtggtgatgaattccctca

SEQ ID NO: 35920 - DNA, 1057 bp, Homo sapiens
tttctattattattattattattattattttttttactatttctacccttttttctctccctcttgaaggtcaatgactcttacatttcctttttttttttttttttttttaagatggagtttcactcttgttgcccaggctgcagtgcattggaacgatctcggcccactgcaacctccgccgcctgggttcaagcaattcttctgcctcagcctcccgagtagctgggattacagggatgcaccaccacacccagctaattttgtatttttagtagagacacggtttagccatgttggtcaggctggtctcaaactcctgacctaaggtgatccgcccacctcagcctcccaaagtgctgggattacaggcgtgagccaccgcaccccgctacatttgctcttttgatgctgtcccatagatctcgtaagccttattcatttgttttcaatttttctcctcctttgattgtgttttgtttatttttctcttttgattgattgattgattgattgagacagggtcttgctgtgttgcccaggctgaagtgcagtggcacaatcatggctcactgcagcctcaacctcctggggtcaagcaatcctcctacctcagtctcccagttagctgggactacaggtgcataccaccacacctggctaatttttgtattttttgtagagatggggttttgccatgttgcccagtctggtcagacccctgagctcaagctatccacccacctcagcctcccaaagtgctaggattacagatgtgagccaccacacccaggctgactgtattttcaaatattctgtcttctacgttactcatttttttcttctgcttgatcagttttgctgttgagaccctctaatgcatttttcagtttgtccattgtagttttcaactctagtatttccgtttgattttttgaaaataaaaatacaaaaaattagcagggtgtggtggtgcacacctgtaatcccagctactcgggaggctgaggctggagactcacttgaacccaggagacagaggttgcagtgggtcgag

SEQ ID NO: 35921 - DNA, 1042 bp, Homo sapiens
tcttcaactcctgacctcaggtgatccacccacctcggcctcccagagtgctgggattacaggtatgagccactgcacccggccttattaaaccttttaaatgtgtaatcaagactaataaaggctaattacccacccaaagtcaagtaccaaactgaaattcaagtccagtctatcttactcttaatgtcttctctgccaggctattgagtacctcaagtaatgctcttttgcctaatttttctattccacaatctggttttactatttctgagtcatttttgttagtctgattagaaaatgagatcatattcctagatatttcattattaaagtaaggtacttcttccaaccacttaaaaccacatatctcgtttttatttaagttgttcataaaagggacaacatatcattcttctgtcctttctctagaaatcaagtgcatttattaagaaagtatttattgagactctccactgcattatagatacttatccggaagagatgacatagaaaatacattggaagtattatttggtgtttacaactctaaaatgctagcttattcacaggacacaatacctttaaactataatatcttgattttatagtacacaatcattgtgtatatgtatatttgtttgtttatttatttatttatttatttatttatttatttatttatttttgaggctttgaggcagggtcttactctggttgcccaggctggagtgcaatggcatgatcttggctcactgcagccttgacctcccaagcttaggtgattctcacacctcagcctcccaagtagctgggactacaggattgcgctaccacacccggctagttttttgtgtttttagtagagatgggatttcgccatgttgctcaggctggtcttgaactcctgcactcaagcagtccgcctgcctgggcctcccaatatgctgggattgcaggtgggagccactgtgccaggcctttcacattctttcatagttagttatgaagtttggtcactgcacattgttcattttttgtt

SEQ ID NO: 35922 - DNA, 1050 bp, Homo sapiens
atatatggaaatgtggtagtatcttcttggggtgtaaagctttactgttttttttgagatggagtttcacactgtcgcccaggctggagtgcagtagcatgatctcggctcactgcaagctctgcctcccggcttgtagctgggactacaggtacctgccaccacgcccggctactttaaagctttactcttaatttctctgtctcatttttttatccattgtatgagggtaatcatagtaccctactttatagggctcctgtgaggattaaaaagagataatacttgaagaatgttgagaacactctctgagtcatagaagcactctatcaataaatagatctgatccagcagtagcaaaaggagttaatcctatattctgtttatcctaatttctctgcttcactaacctttctgactgtatactcctttttaaagttgtgagttagattttatatagggaatttttctgaattactgagtagctatattatactacatagtagaaatatgtgtgatctgtgagctgatggatgaattatgagcagtggttattgtagtgagaaagaactgctgatgcttctttggcgggtcaaaataatggagattaaatggtagaagttctgtcaaatccaagctataagatgtttcaaaggccagctgtgaaaaggttagcaatttgggtgccaagaagcagttaaccatattccaattacaaaaataggcatgattctggagttatttttcacacagtggtcaatttgactagtctcatgcctgacatagatagtattgtgtggagccttgatgcccctgcagtattgtacatatacctctcagccgtattgggtggtcttcagcactggtggcttaacattgagagttcccttaggggttatttaggttaatccttatttggtaataaactttccttctgtaacatctctgatggggatgttcattcaacttctgtttggatacttggctaataaaaagtccctggtccttaaggcatcccattttattgtaggacttctttctaactatagc

SEQ ID NO: 35923 - DNA, 1066 bp, Homo sapiens
gctgagtttcttacaggatcaagttaatggggctctattctgtgctgactcagacaccagctttctctcttgtctccctggattcttcatcattctgcaaacatgccatacacttatggcttgactaataatatttctgctccttggtgtgtcaagcccttatcctccttcgcaaatatctacctctaaaattgcattccaggcttataggaagaattcattccatctttccctgtttcttcatggcactttgtctttactgctaatatacaatatttagttgcttatattcagtctagtgacggtaagaggatttgagacagtgcaaaagaaagcacatgctcattataacagaaaactattaacataggattgaagggatttaaataagaaaccttgatttgggaaacctgtggcatcaggatataaaacttagctatatgctttctaattaccaggataaaaaaaagaaacattaggaattacatgggtcttattttcaagtagaagaaagtaggtttatcaggtgttaaacttaagacaaattcaatttaacagagtttgattaagcaaagaattgttcacaaattgggcagcccccagaaccagaattggttcacagtgtcttcagggctgtacctggtcagataatatttatgagcagaaacgggaaagtgaggtacagaaaagggaaatagggtactgaaacagctggattggttacagctcagcatttgccttatttggacacatgttcaacagttggccacctatgattggctaaaactctgattagtacaagaaaagattacaatctctacacttccagttaggttacactttactgtgtacgaagagaccttcaggctgaacttaaaatgtgtgaggaagaaactttaggctaaatgtaatttaacacaggagagggagactcataatatttcttctcactgagttgtcatgccctgagcccagaagtgcattttttattaatatttatataagtgactatacaaggactgtccgttttaacaataaagaattagttgtttctgatacactaatg

SEQ ID NO: 35924 - DNA, 1061 bp, Homo sapiens
tacccagaaggtacaagtgctatcaggacaagttcctcatagcacagtcatgtcatttggaacacaaggtagattgttacataattaatatgtttgtgatatttaaattattgcatgtataaaattctgtagatgtgaaaattatggggaaaaataagtattttaagagtttatgtcatttttaaataacatataaagtgtatacatgcattactttgtcagctgatggttcattgtttcagaagtggcgtataaataaattactaactgaaatgcccaagtaaaatgctctaaaatgttttagtgtggccctttttatagtgagatatcttttcataattcaaaaattttgttaaattttaaattatctagtctttttctcacattttggtgtgaaaaactaagaacatagaattattcatgttcttagtgattttaaggacttatttttaagtgtattatagacatttttatttaaaacatgttttttaaaaaattattatagctgtatgttgatgtctcatcttgaggaaccaaaagtaacagaagatgaagaaccacccacagaacaagataagaggaaaaagatggtaagttataaaagtagcttgtaaaaattaagaaccatatattatcattttctgtaggttcagaaatatctatggtctatttgtccatccagctatatgtctatccatctatcccatgttacagaattaatgtaaggtgtaccctaaaacagatacattttattcctagtacagaaagttgaggttaacttttcatctgaaataactgttgcttatcttagtgcagagcagatgatttagtgttttacttatggaaggtatgtgtgacctgcaaaccttatttaagttgaaatgtttattcttctgttttgaggagatgtactgaaatttccttgcattccctattattttatagatcttcacatgaacttttgctgatctgcatcacaggcttttataaaaatgcccttaagttaaccactaacttgttgtaaaaaccactaattctcaccagaggaatctgataagggg

SEQ ID NO: 35925 - DNA, 1075 bp, Homo sapiens
ttttcttttatactctagctttgattctgtgctagtaggtatcagtattgcaggtggcaaatcctagttacccttttaatttatcttcatttaaagacaaaaagctcctttcaagtgatatttctttatcagtattactcagtcctgaagactgatccaagaagaatttctttttgttgacttaattattttcatttgaaacactaactcattagtgttatcagaaattctcaaacatgctcatttttcagttatagtaaagtactcatccttctaattcctgacagatttcattatagtgccataccaaatattactgaaatagctaccttgcaaaagaagtaaaaagcttatctcagggaaagagtttgcttcatttttaaaactcacaagtttaaataggcttggtaaatagctcagaaaaataattcatgtatcttgaatttctaagtgctcaattaagacataaagtgtaattattggtttacagaattctattcattaacagaactatatagcaaatatattaagtttaggacaaacaactcagccaggcctctggcctctgggtgaactgtggctcctgaaacaaggtaatgatcatttatactccaaaaacatattccttttctatttattttctattccagagacttctcccaaccctctcacaaaggcccatgtgactaacaataacatttgaaagcttccttataagttggtccctcctctctctcctactagtcattttagagaatccacattattgcatacaatttttaaaaagatacaatttttcttgaaaaatcctcgctttaatctttattttacccatttctttattcagttagtgtttattgagttctgtttcatgccataatgctgtaccacattctgagattagaacagagtacccaccttcatgaaatttcacagttgattaggaacacagacttgccgacatgctgtaagaaaataggggttccaatggaagtgcacattctaaagcagttggcctgcaggggaaggagattgtgtatgaaataaaatgatgctgtcactgtataatttgata

SEQ ID NO: 35926 - DNA, 1250 bp, Homo sapiens
aattccctgtctggtaaatccagcagccatatcatattggagtctggttttgatgctttgatgcttgcttgatctgtgttttttttttttttttttttgagacggagtctcaccctgttgcccaggctggagtgcagtctcaccctgttgcccaggctggagtgcagtggcctgatctcggctcactgaaacctctgtctcccgggttcaagagattctcctgcctcagcctccccagcagctgggattacaggcgcctgccaccacgcctggctaatttttgtatttttaatagagatggggtttcaccatgttggccaggctggtctcgaactcctgacctcgtgatcctcccacctcagcctcccaaagtgctgggattacaggcacgagccaccgtgcccagcccttgatctgtcttcttacttgctttttagcataccttgtaatttttattgaaagttggacatgtattgggtaatagggactgagataaataggcatttagtgtgaggatttatgttcatttgtctaggagctgggctttgtttagccctgttggtgtggtggtaaggcacaagggagaggagtgttctcaatcttaacgattaaatctcaagtctcttagtgggcttgagtctctggcctgggaccttcacttgtgcttcgttttggaaagctttcctatccccctcaggtgagacaggaagaggagaaatggctggagcgagaggagtgcctttccccatggctctagaacaagcctaaagcctggttaagtctttcccccgaagagtttattttcttttatcatttttattatgaagaaagctctggacgtatttcataagaatcactcttcccctcctgcaagaactatgatggcatctttctctgatcttcacaatgagaaactggtgggattcctagaggtaatgttcacaaaaccaagaggctttccccaagactgttcccagaagtgagcctaccagtttagagatccaacacttctgctccaggtaagttgatctcagctttgtctctggatttgctggagacagtttgcaaactctggagacagtttgccctgtaatgagtccaagtcattggttttcagtttgtccagctttttcttataaaagcaaagagtgacaacttccaagctttttatatgatgaaactcatacaggaagtccaacgtctccatgtggccttccattatataaataacctaacccgagcatcggcag

SEQ ID NO: 35927 - DNA, 1010 bp, Homo sapiens
ttccaaagaggtagtagaagaaaagaaggtaaaatatttcattcataattttcttgtcttgattacatattgatgtttgggtatattgagttagagaagacgttattaaagttactcccacccatttctttttactttttaaatgtggctactagaaaatttaaacttacagatggggcttacgtcgtatttctattgggcagtgctattgagaccaaggaagacagtgatgggcactgtactggaactggccgccttgaggtctgaagtggaacttcgtgtcatcatgaggaagagagagcccatgcacgctgcagcagtgtctatgatggcagtgtttcaggtgtcatgaagtctagacatagcggcagatgcgtgatggagtagctggaatcaggagaagttatggacattttgtttacgggagtcattcatatatgctaattgcccatcttctaagtagagaagtatttgagaaaactactggaaacaaaactaaaggagtgacttagataattggggagaggaaggatccaactcatgaaggaagaggaaggagagagtagcagagtgagtgagggttttaggtgtgctcaggtgtgtcaaagtcccttgtaccaatcttggaagatgccaaagtttgaaaagacagacaatactgtcaaagattagagaaagtcattagtaggctagacagtcacacaaagggtaagaacataggttattaaagatgagagctacaggcatcctttcagctctggaaaaagtattactcttaaaaatgagaatagaaattcttggcttccgctaagtgaaacaattcttatcatggatagcctctagaggtagcatagacctcaccttttctaacagtatttccctctggatagatagcagtgttagtaagaactttgaaggtcagcttgtgtatatgaatctcaagataaattgctctgatgaatacttgggtatatatgtatgcatctcactctcacctatcttccatcgcc

SEQ ID NO: 35928 - DNA, 1023 bp, Homo sapiens
cttaacttgagctatttcttataaatctctatattaaaaatagaactcaagctcaaacaatcacaaacactcaacaaacttatcattatataactggcgactttccagtaggatacaccaagtaaggcaactttgtaactgtaaccaaccaaataatttcttctttattatgtttgcattcactctaaaagtctgttcataatgcttcctcaatggagccctcagaacatttctggtttggagctgctgaattcatgaattgctgtttatttacataaattctttaaaatttgattgcaccttagtttacctttttaacataattagccacctctctgaaatcagctgtggccatgtgattttctttggccagtgaaatgcaagtgaagtgacatgtgttacttctggacaaaagctttaagagtcagtacatgctcactattttctcttttacttccacaacaacaacatgcaataatgtcccagagactggctgctctgtcagctaaggtcccaaagtgaggatggtctagaatgtacctctcagaaacccacaataaacatgtactgtgagtgaaaaattagccttgttaggttaagcctctgagatttagtttccttgcttttatcgcttcattgcaatcattgtacactgtctaatttcttcacatattttctctaaatcctgaggaaaaaaatgttgtgtgcccagattttcacatagcttctcctattaaggcctatgtatatttccattgacttcattaactgtattcactgtaaaataaaaggatattttacagatgttttcttaaaattaggtcttcccttccctctcatgcaaggtgtccttactttcattgaaatacctcttaggatttcttataataatacatattctctctataaaaacagagagagagagaacttttatcaaacttcatcattacaaatacacagcatcctttattttaataatctgtataattaaatttatacatttcattatctgttcagagtgaa

SEQ ID NO: 35929 - DNA, 1024 bp, Homo sapiens
ccaatgtgtattgagtaatatacgccaaaatctatgaaggaaactgataggattgggagctggaagaagacaaaaatttggccactgtgcccatggagtagccattgttttattcctttacggccctaacaaacttgctttcacttactctggggacttgccccagattctttcttgtgcgaggtccatttaaaagaaaaagaaaaattcaataacctttctgaagattgcagagtcacagagtgttagaactggaaaggaacactatgcctggttcttcttcactgccactagaattgagacccactgccctaaataatttcctagtattccagatgaatgccctggtctggttcagaaaacttatcatactacatggcttgtaagttggagagaggcagtataatatattggaaagaaagttagaaatgtcagtagtttgatattggagtcctaactcccctggtgatttagctgtatgctcttgtgcaacatgcttaattcagctgtcttggtttcttctgtgtgtttactaccttgtccacagaaactaagaaataaatctcattttttttcctgttaaaaacgaattaaagtttactaaccaagcacagtggctcacgcctataatcacagcactttggatgccgaggtgggtgcatcacttgagatcaggagttcaagatctgcctggccaacatggcgaaaccccgtctctactaaaaaatacaaaaattagctgggtgtggtggcatgtgcctgtagtcccagctactcaggacgttgaggcaggagaatcgcgtgaacccgggaggcagaggctgcagtgagccaagatcgcgccagtgcactccagcatgggcaaaagaatgagactctgtctcaaaaataaaaataaataaagtttacgaacatgatcagtgacaataccatgaccttaggctttctaattcatagtcttatgtggctgagctttccaaatggcagttacccgttcttttttttttttttttttttttttttt

SEQ ID NO: 35930 - DNA, 1056 bp, Homo sapiens
gtacttttttcaaattcacttattcttttttattatgtcctgttcttgccttatcgactatatttctttttttaaatctcttaacacgctcatttttaaaagttccttatatatttctcggttatatagtcttcaaaagtgaattcttctggttatatgtctgcttatacttgttcgttggcagttgattttctggcatgtttcgtaatttataattgtgagtttatctttagtgggcattgtttctgtatgtcttggctgttctgaattatggaagcaattctgtggggccagttttgtgtttgattttctgtgatcttatggcttttaccagtaaaagacttgttttaatgttattttctctgttcagggtttccaagctccttgagaagtgctaattcagcctcacagccacaaatcgtgcagatttggagtgctagttctcctggtgactctctttctatcctttgtccagagtgactggcttctactgtactgtattcctcagaccaaacagccttcctagcttgctgctatacatagagtgtagaattttgactcctatatctctctaccataaacatcagggttttaaaccttttatctagcattttaatctaattagcactggagaaatacttcctgcatcagcatggtcctccatattgactaaagaatttgtgggctatataaaaacttttctagttgtttcttaaaatatatggtttgatgactgatatggaagttagcatatgttagaaatccaaaactgtcaaatttggaatgtgtataaatgcacatttgaagccatattctgagactagaattacaaattcttttgacacaacaatgacatttataaaaatttatgtttctttaagaattagaaattaaaagaattctgtaacatacatgtctgtatatttaaagtaacttccatatgctcttaatcactggtgttttctgataaccttaatatctaaacttttcccatgacataatgtggactttgtgtcaggcatatgaaaaataagaataagatttagagaataagat

SEQ ID NO: 35931 - DNA, 1065 bp, Homo sapiens
aaatatatactaacccagaagaagccaaagccctcgtattcttcagtcactgagaatatcttgaagtgcccccacccctatcccataaggtaccaagtcctgtagtgctttatctttttcagtgtctattgtgtcccttcttttttccccatttctgtggccacctgttagttcacagatgtatcccctcaggccatcagctgttgtagtacgtcctaatcggtctccttgagttcagtctctcacctcttctcttcaatttattctctagatccaggctaatcctcctcctaaaacgctcctctgatcttgtcacttctttgctttaaaacttctaaagatttcctattgcctaaagcagtgtttcttcaaatttgaaactagatttcctgtatcagaatcatgtgggtgggatgtcctcggacctgaagaaccaaaacctctggggaggtaaggataggaaatccaaatttttaacaagcaccactgcatctcccaggagattgttgaacatgcaacatatgaggcctacctgcctagaatagcgattctcaacctgggctgcacatggaaatcacctgggaagctttaaaaatttgctgatgcttgagttccatccctagagtttctgatttaattggtctgggatgctgcctgggcattggggtatttttaaaagcttcccaagtgtgcatctgtatcagaaaagattatacttggctatatttaacagaaaattcaaagtagcaattgctaaagacaccagggtttattctcgcccagaaaaaaaaaaaaaaaaaaagtcctaggttgggcaattcggaactggtacagtggctccatgaaaccagatggttctgcacccattctttgtttatggcttctatcctcaacctcgctttatgaggcaagatgagcacagaatctcagccatcagtccatgttccagcatagaaggaggaagaaaagaggaaggtcaaaaggccaccatgtccagatggatcagctctccttaatcagtttcaaacaaaacttccagaactgtatcatatggtcacacctaat

SEQ ID NO: 35932 - DNA, 1031 bp, Homo sapiens
tctggagatggggataaactgcaacatgatctatggtcaagatcataatgagctcattaagggaaattggacttggaactcattatcccatataaacaatgttatacatagtacttaggtcataaacagtatttaacccataatttccaaaattataaaccttttcatcatatataacagtatttcctatgggaaaatagattcatgcccaactccagaagtcatctttctttctgggaacgtattcatagtgctcttctaggtgcggtagatacaacagctttgaacaaaataaagtccttgtattcatggtgtgtgtggtggtggtggcgggggtggggctggtgactgagaagaaacaaacaaaagagagtatttcagatagtgataaatgcagtgaggaaaataaaacaagatgatattattaaggaatgacatatgcagcgtgggtagttatcttctgatagggtggtcaaaaaggcacctctgagaaggtaacatttgaactgaatatctgactctgagaagggaccagtcctatgataatttcagagaaaagcatttgaggcagcaacaacagcaaggtaaagatccttgaagactgcattatcggtttggaattatcttcagctggcagtaacataagccagacatcagtgacttaaacatataaaggtggctttttctcacataattaaacacccaaagtggtagggatggcaaacattggttcatgattgaagaacatcatgactgagatttctgtagttctctggggcttttcctcaaggtctcaatattgatgttgcagctccagaaattgtatctatgttccaggcaagtagaaagggcagagagcacagacataagcccattaaatgtggcccttcttaaaagagtttctcagaagcctcacacagcaacttcctgaatgtctcagcagccagggcggtgtcatgcaacttccctgactgcaagtttcatgatctgatttgcatacatctctctccataccagctgtctgctgagaa

SEQ ID NO: 35933 - DNA, 1044 bp, Homo sapiens
aagagcagctgattcaggtacccaggaaagtcctttttgggaagatgacatttggggtgagatctgaatggtaaaggagccagccatgcgaagatctggggcagagcatgccaggcagaaggaggagtgaatgcaaagaccctgaggcaggaacgaacttggctagttccagagcctgacagactggagtgtggtgagaggcaggaaagcaggacaagacaaggtcaggaaggagttagcaaccagcctgtcagggcctcgctaggtcacaagaaagagtggatttgatttaaaatgcagtgaaaagccactggaggatgagatttatgtttttaagatgtgtaagaaaagactgtacagggcaatagaggaattcgtcccttgggtaatagttgcttgttttagaggtaagcaactgtttagaggtaagaccagcagaatttgcagaagggttgcagcttggaggggcagtgatgaggatgagggaaaggggagaatcagaaacaagtcggtctgagtaactgatttgatggtggtgctgtgccatgaaacagggaggtctaggtgaggtaccctttggcagatgagagagcaaaaaatcaaaagctgtgtttgaacataataacttggtgattcctttcagcatccattaatacccattaaaagataatgtccattaggacaaatctggagctcaaaagaaaggtcagggctataaatttaaatatggaaggcactggcatagaggtggtatttaaaactttcggactggatgagttcatgtagggagatgatgtagatagaaaacaaaggagagctaggggctgggcactgaggtgctctcttaaaacctaggaagaaaaggaagatccagcaaaggcgactgagtaggggccagggatttagggtgatagggccctgggtgtcaagagaaaaactgtctcagatggaaggtgagacagttttgccaatgctgctgaaatgtccagtaagataaggacagagggaccagtgaattttgtgagagaggttcttggtgacctt

SEQ ID NO: 35934 - DNA, 1044 bp, Homo sapiens
atgtgttttctgattttaaaaaattatgaatttttttaaaggttaggtttataatgtaacaaaaatatatttaaaaattttaatagatgagccaaccaaatatttatttatgttagatttaagtgttccttaaactcccaactcagtcttgtaggctttaatcaatttcaaatacttatataccctataatataaactataatttagcaatgctaaattttgtataagaactaaagttcatttttaatgtacctttcataagtgtctttaaaaaattgtttacctaatattaagaaaagtcaaagtttgcattttccaaaattgtgttcactcttacaattaagggttattcttaaaagatttccttggctgtagtatgggcctgatgaccaaacatggcattgatagctagatttaggaatctgatctatcatgagaatactggagagccactgaagtttttacaggcaaatgatatattgagattgtatttagtatggagaatggattgatagaggagtgttttgggctattatacaaaataccatagactggatgacttaacagacatttaaagcttagtttttatggtaatttcttacataggaacatatatatccacttacttatgtaaacaatttttctctttttataaatcagtataatttgcaaaattaaaatcacataatttgtatattcactgtagaggaaaaagttatattcaagtgcattgcaagtctactaagaaaattaaataaatttaaaaagtacgttaaatacttttctacttagaaaagtaaattaaataagaagtctccaaaggtggcttgaatattttaggtaaacatgagtattgtggacattgttggattcttttaggtaaaataattggcaaagtgtgcctttgtaaatggtgcagacagcacacatttatttataactgttctgttcccccacattttcattattcacattctctactctccctccttcatcctatctgtcctacctacaaagagaaacaaaagaaaaataaggtcagga

SEQ ID NO: 35935 - DNA, 1033 bp, Homo sapiens
cagattgtattataacaggatagttagattgctaatgtcatttcttataaaatgatttttcatgatttgaattttctaaaaacaagcctaacttctaccttttatgactcatgtgttttattctttttcttgtgagattatttgttaggtccaggaaattcagtcaatttccaattttagaattaatggcttaatgtcagtactgactcaacttatgaatggatcatgtttgtaattttatttgtatgttatttagaataggtaaaatttccctccagaaacaggctataattgatgttaatttttccccaatttgaaaaatttaatttgggatctgttagaactctactagtaaaaaaacaggtatcgagaaagaaatatgtaacttacatttgtatacatatacaaatgtgtgtatatatgtaaaatacatggaataccgttagaactacacagaaggcctcatatacttaattgctgaatatatgctgacaataacttcaatgctgagaacttcctgaggaaggaaaatcactttaatacttttattcacttttttttttttttttttttactataagttctgggatacatgtacagaacatgcaggtttgttacataggtatacacgtgtcatggtggtttgctgcacccatcaacccgtcacctacattaggtatttcttctaatgctatccctcccctagcctcccacccctctacaggccccattgtgtgatgttcccctccctgtgtccatgtgttatcattgttcaactcccacttaaaagtgagaacatgctgtgtttggttttctgttcttgtgttagtttgctgagaatggtggtttccagcttcatccatgtccctgcaaagaacatgaactcatcttttttttttttttcgctatgccatttttttttcttttcttttccattctttttttttttaattatactttaagttctaggatacatgtgcacaacgtgcaggtttgttacatatgtatacatgtgccatgttggtgtgctgca

SEQ ID NO: 35936 - DNA, 1054 bp, Homo sapiens
atgaataaaatgcaaaaattattagcatttatagtaaacaaaacacaaaacatctctatctgtctaaacaaagcttttgtctaccccgactgttggggctaagtgcctgtgttaccctatgaactgcccttggtttgatttctaatcataccaccattgtgtgatagatatcaggataaagctgaaatgccaggtcagactccagattttctggttagattttcagttttacttttggctgttttgaccatgttttatgatgggtacctagtcaacataagtaactcattaggatcagctctactttttaatgctgttgatataacatcagtctttctggcttaaaatttcttataaaatttttgaatgagtattttgcatatataactgtgttttaaagttatactgtaaacacttgtatttcttcataactttaagtactttggtccaactctttatctgcagagtttgaaatattaatgaatttcatcaaaatatataattagttgataaactgtgagtgctcttggtatgttatcatcatacaaataactatacattatagtataatcccgtttcagttatctattgctgtgtaaaaatgacctcaaactcagtaactaaaacaagcagctcataatttttttaggtcagagatttggataaggtacaaattggatggttcataatgttctgcaatatctgggaccttagttggggctcctcaaatggttaggagctgcctagaatactccgtggatgtttcaacccgtagggtcatatgtctcaagccttgactctgcctgttggaccaaatgcttagttctccatgtgtggcttttccatgtgctacctttggttttttcacaacatggtggtctcggtttctaagaagacatattcctaaagtatcaactctaatgtcctagcagttatcaagcctcttcttatttttttttttcactcaccaccatactaataaggatcaagcctcttcttgcatcagaatttttttgtgtggccaaatcagatatatatatatataaaaccaatc

SEQ ID NO: 35937 - DNA, 1083 bp, Homo sapiens
attttctaagatttgaaagagatcttacaaagattaggggtcatctacattagacttctaatcttttcattaaaaatacatatgatctttcatatggaaggagtaagattgtaagtttaaaggctatatacaagtgtgtttagatttctccttttctttctaaattacaatatatttaaagatatggatatagtctttttattcgtaagtaatggtgtagcagattataaagggcacatagaacattagctctcagattaaatgttatcttttgatagatacctttcaggatcacttagactaaaataaggtaggttctctgttagcctccctcatagaatttctaagtatgtatgcatttctttgttgactcgcttattccttaccttttcagctaggttataatgaaagaaaataagcaattcactttgaagcatttagtgaccagagttaggatatgggaattttgtaatttttagtttttttaaaactgttacatttctcacttgcatagcatatatttaatctaagcagtgccccaaacacaaaaactaatcactgtgcttttgaaatctgtatctccatggaaacaatggaaaaacttgcctttttaatctcttttgttagactgagatctcattttgtcattaatagattctgtaaatagcaagaataggaatagtggtagtggtggaggtgaaagcaataataataagagaagcaaatttctgtttagtactatcttgggccaagtactatgctaagtatgctaaataatttccatagaatcttagttctttcttacaacaaccttactattcttttcatttctaggtgagtgaactgaggcttacattggttaacttagttgtccaatgcggtactgctagtaataggtagaacagagcttcgaacacagagtggagttttattgactaacttttgttagatatttgcatgatataagtatacattttcaaaatgtgtgtataaactacagtacattttggcactttttgaaatatggtgaacctacatctctgctacagctgatgatactgtaagtctaaaaattgtatgaaa

SEQ ID NO: 35938 - DNA, 1049 bp, Homo sapiens
tgtggggggtgggaggataataaattttgaataagattgatggttaattggagatagagttggtttcctgtcttggctctgtcaggttctttaataaactatataatccttttcattaaatcatgtctctaagtcttttccagatttctttaagtttcatatcaaaaccagtaccaaactgaacatagtcacatagagatgacaggtttggacatattctctaatcagctttaaagagataaggtgttaggtcctctttcaaagttctaagcagacaattcctgctctatgactggtgccagaaattagaggagaagggtcaggctgagcttgtaaatcaagaaaaaattttaaagccttttcatgaaacatatccctgaggtgcctagtacctctcaagttgcactgggttatttcacatttcttcagactatctttttaatactggatcaaatcagactagagtccctcaggcttgataggttgtgaaagtatatagtttttgagtacttttcatctgggtaatatatagtattaaactagcttggtcttagttggtataagaaacaaaaaccctctttgagtgttagctctgtgttctacttaataccatgtaaaattttcttattgagcaaactggttctcttttccaaagcagttaactttctttaggtactgttgagttattttttttttcttggaacccagaagtatcagacctatttttcttcgtagtctactcttaatctatgtgctaatttttactttatttacataaagtgaaagtatatttgcacttgactcattggatgcatctcaggccagccatcattttctagttcttcttactttgggcatagccactaataaattgattatctggttttctaagctaaaaaccaattaaagtataaaagtgagggagcgtatactctaaaagggtgaattttatggaaagtgaagtatatctcaataatttaataaataaataaacaagcaaaagagaagccagaaaaggcactgacctgtggacctttctagcccagtat

SEQ ID NO: 35939 - DNA, 1052 bp, Homo sapiens
ctatatttttagtaactgcaatttgtcctcctattactaatatctgtgtcattcctgacccagtaaaaatagattgcttaattcatacaggtaaatattagttgggggtcattactgtctctttatttaaaaaaaaaagctgtatttcttacattataaaagtaacatttattctttgcaaaaatatcagaaatgtagaaaggcataaaggttaaaaagaaagattaccccataatacttcgccaaagataaccagttaactttgtgatatttattttttctggatttgtttcttttcatgctataaacacacgtgtttttttccccataatgtcattttgttataattttgtttataatattcctttttaaaagaatgtttatattgaaattgaccaagaattcttaagggggcaacttgctttaggagtatgtcttcttaattatcttacatcacacaacgtgagatatagaggatgatggatgtaaagaccgtacaaatgcagttgagacatgaaaaattcccactatttcagctctggggtttagactatgtgggagcaatgatagccagggactacatttccattgctgatgagaattctttatctctcgttctttaaaaaaaaaaaaaatcatttaaaaagtcattaaaataaatcctgagctcatgttgtagtctgttacctctttctcagctggccactaaaaattctgcaaggaaagattacattcaggttaggtatttggagcctacattgaaataattacaaatttgtccactcttggaaagtagaagaggtgaagggtatgtgtatgtgtgtgcgcacatatgcacgtgtgcatgcgcacacacacgtgttttattgttttgttttgtttggatatttagattgtctccagagaggaactaatatcatcattaaaagtttgattataaccagtgttcccatttgggaatggagttgttaacttttccagactgctgtcaagaccttattttaagtaagatgttttccttttatgtgacattttctgaggttttgccaaaa

SEQ ID NO: 35940 - DNA, 1028 bp, Homo sapiens
tgcccagtcagtatgatattagctgtgtgtttgttgtaagtagctgttattattttgagatacgttccatcaatacctagtctactgagagtttttagcatgaagggctattgaattttatcgaaggccttttctgcatctattgagataatcatgtggtttttgtcattggttctgtttatgtgatggattacgtttattgattcgcctatgttgaaccagccatgcatcccagggatttagctgacttgatcgtggtggataagctttttgatgtgctgctggatttggtttgccagtatcttattgaggattttcacatcaatgttcatcagggatattggcctgaaattttctttttctgttgtgtctctgcaggttttggtatcaggatgatgctggcctgataaaatgagttagggaggagtccttctttttctattttgtggaatagtttcagaaggaatggtaccacctcgtctttgtagctctggtagaattcggctgtgaatccttctggtcctggcctttttttggttggtacgctattaattactgccttaaattcagaacttgttattggtctattcagggatttgacttctttctggtttagtctttggagggtgtatgtgtccaggaatttatctatttcttctagattttctagtttatttgcatagaggtatttatattattctctgatggtagtttgtatttctgtgcaaccagtaacgatatcccctttatcattttttattgtgtctatttgattcttctcttttttcttctttattagtctggctagtggtctattttgttgatattttcaaaaaaatccagctcctggattcattgattttttgaagggttttttgtgtctctatctctttcagttctactctgatcttagttatttcttgtcttctgctagcttttgaatttgtttgctcttgcttctctagttcttttattgtaatgttatggtgtcgattttagatctttccagctttctcctgtgggtattt

SEQ ID NO: 35941 - DNA, 1042 bp, Homo sapiens
tagcacttagctatcatcttctctgggaagcctgtgacttctccagtctggactggatttctgaagcactttgatcataactctgaggtagttatatatcaatactgaatttacaggtagccttcaaattttatgtatccaaattttgaagaagctgtttttttgaacgttgtatattgacacccttacagtgcattatcatttttacttcctggtcctcttattaaatgtttccatagtaaccattttatttatggcacttgccgcagtttctaattatatatttattcatgtgattgatgaatgtttctctccactgctaagactgtaaacaagtaagaaccagaatcacgccttttttgtttcattgcttggtgtacagtgctttgcctaagtatttaatgactgcatattaaagcttttatgctggtctttagctattttgttgcatatgaatatttttgcaagttcttttttaattaaacgagtaaggagaaatgtaaaaatccagaaatatcgaaatgctgatattagtgttaccggacaagtgtcttataaacttaatataacggagacagatataaattagtaggtgtgaaaatctttcctcttaatcagttatttattgttttaagacagccaatagttggccgggtgtggtggctgatgcctgtaatcctggcactttgggaggctgaggcgggcagatcatcaggtcaggagttctagaccagcctgaccaacatggtgaaaccccgccagtctctactaaaaatacaaaaaaattagccgggcgtggtggcgcacacctataatctcagctattcaggaggctgaggcaggagaatcacttgaacccaggaggcagaggttgcagtgagctgagattgtgccactgtacttcagcatgggcaacagagcaagactccgtctcaaaaaaaaaaaaaaaaaaagccaatagtttattcagtttgaagaaaaaaattgaaactaaaaaacatacatagaatgttacaaaaatatttaaaattttgtctaaatg

SEQ ID NO: 35942 - DNA, 1030 bp, Homo sapiens
accaaatttccaaactataaaggacacttatagaaatagtcatgtctactaaataacatgtacctaatggtaatctcactgccctgtgtcagaataacttgagacattttctgaaatattatgaatttgttataaattagtgagatgaattcattcagcaaaaattgagtgcttgttatgtcaggcacgtaaccttgctcaaggacctcatagtctatagctgcattatccagtataaacagtcactagccacgtgtctactgagcatttgatagatggctagtccaaactgagatatgctgaaagtgtaaaatacaagatttcaaagacttaattttttttaaaagaatgtaagttatctcaattttttatattgttgagatgatattctggatattttgagtttaatcaaacattaaaatgaaattcacctgttttctttatactttgtttaatgttactagacactttaaaattacctatgtggcttgtgttatatttcattggaaagtgctactctgtgacttttaaaaggcagcagatgtattctgtagagaaagcagtagttctattaaccaaccgggttttgttttaaattagaagaaccagttaccattttgaaatacaatttttttttttttttttttttgagacggagtctcactctgtcccccaggccagagtgcagtggcgcaatttcggctcactgcagcgtctgcctcctaggttcaagcgattctcttgccccagcctcccgagtagctgggattacaggcacacatcaccatgcccggctaagtttttatgtttttagtggagacggggtttcaccatgttggccaggctgttcttgaactgatgtcaggtgatccacctgccttggcctcccaaaatgctgggattagaggcataagccaccatgcccagcctgaaatactattttttagtgattggacttactaatgtctatttcatattgtttagaatccctcttaagaagtacaaacagttagtggctcttaatatgtat

SEQ ID NO: 35943 - DNA, 1027 bp, Homo sapiens
agtacaaaatagctacaatcagatactctcactgaatgtaaatgaacagaacttaatattttaaggagaaaaaaatgtcctgtacatttccatgtataaacatatttatattgtagttcttggcaatacaaaatctttgaagttttgcagaacagttaacagacatggaattttaataagaataggttaaaactgtataaacaaatgattgattgtttttaatagaccttacttttttgaacagttttaggttcacagcaaaattaagaggaagatacagagattttccatataccctctgccccaacacatgcatagcctccccattatcaacgtcccccaccagagtggtccatttgttccattgatgaacctacattgacacccagagtccatagtttacattagggttcacccttggtgttgtatattctataggtttggagaaatgtataatggcatgtatccaccatcatattatcatatagagtagttttactgccttcaaaatcctctgctctgactgttcaaccactgatcttttcaccatctccatagttttgcctcttccagaatgtgatatagctaaaatcatacagtatgtagtctgtccagattggctcctttcggtaatatgcatttaagtttcctccatgcctcaccacagcttgatagctcatttctttttagcactgaataatactccattgtctggatgtaccacagttgatccattcacgtactgaaagacatcttggttgcttccaagttttggcagttatgtataaaagctgctataatcatctgtgtacaggtgtttgtgtagtcatttcagctccttttggtaaataccaaggagcacaattgctggatcatatggtaacagaatgtttagttttgtaacagccaaactgcctttcgaagtggctatactctttttgcattcccaccagcaatgaatgagtgttcctgtcactccacatctgtgccaccatttggtattgtcagtgttccagatttgggccat

SEQ ID NO: 35944 - DNA, 1074 bp, Homo sapiens
caggcaaagagagagagcttgtgcggggaaactcccatttttaaaaccatcagatctcagccaggcgtagtggctcatgcctgtaatcctagcactttgggaggccaaggcgggtggatcacttgagttcaggagttcgagaccatcctgcccaacgtggtgaaataccatctctactaaaaatacagaaattagccaggagtggtggcgtgtgcttgtaatcccagctacctgggaagctgaggcaggagaatcacttgaacctgggaggctgaggttgcagtgagccaagactgtgccactgcactccaggctgcctgggtgacagagtaatactccatcccccaaaaaataaaaataaaaccatcagatctcatgagacttattcaccgtcatgagaacagcacaggaaagacccacccccatgattcaattatctcccaccaggcccctcccacaacacatgggaattacgggagctacaagatgagatttgggtggggacacagagtcaaaccatatcagtagccatacaatagagcatcttgaaagccaggctaaggttttatttaaccttttttgaaaaattattttttaaaatggacaaaaaaattaattaagaaaaaaaaaaacaggcctggcacagtggctcatacccagaatcccaacactttgggaggctgtgacagaaggattacttgaggccaggagttcaagaccagcctgggaaacataacgagactcccatctctacaaacaatttaaaaagtagttgagcatgctggcacacacctgtagtcccagctactcaggaagctgaaactggaggattgtttaagcccaggagtttgaggctgcattgagttttgcctgggcactccagcatgggctacagaacaagacctgtcactgaaaaaaattaaataaaaaacagcaggcagttggcttttgagcactctttgtgttagaaagactgatatgagcacattgtgtgggatgctttgtagaaaatggaacagttagaagacctttgaagtagtgtagaaattaaaagatagaatatgctaactccgc

SEQ ID NO: 35945 - DNA, 1052 bp, Homo sapiens
aaaagactatgctgtttcatgcatatttataattattgttagtcattgtgaattgcagcttttaatattaaaaatattcaagtagattgctcaggaagttcttgtgggtacaatattctctgagcccttgttcaaagatgtttttcaatacttcaagtttagtttggctagatttaaaatcttctgtttacatttttatttccttatgttttttgaaaatgctactcctttattgctcagctctgtatgttgtttttgagaggattgaggccagtctaattctcttgccttgtaagttatttcataatttttcctggaggtcctggtgattttttttctttatgtttcaaaattggtctttgggtgtgatttccctgattccaagtagaccctttcaatatgggtctgcaacctccacctcctggtttcaagtgattcttctgcctcagcctcccgagtagctgggattacaggaaactgccacaatgcctggccaattataccaaactcttagtgtcctctgaagacatcttgagctttcacacttgtggtattttgctagctctgttcaacttacttagaataagttcccccaacccctttcctctttgccttttcaaatcctacttatcaaaaaactgcagttatgattaaaatgacacataggacacacaggaaaacatattcaacagaaagccaatgggttcaattatttctttttttctctaatttcaaaaatgtttaagaatttatatctgggcgcagtggctaacacctgtaatcccagcactttgggagcccgaggcggcagatcacttgaggccagaagtttgagaccagcctggccaacatggtgtaaccctgtttctgctaaaaatacaaaatttagccaggcttagtgccgcttgcctgtaatcccagctactggggaggctgaggcaggacaatcacttgaatctgggaggtagaggttgcagtgagccaagatggtgctgctgcactccaacctgggtgacagagcgagactccgtctccaaaaaaaaaaaaaaaat

SEQ ID NO: 35946 - DNA, 1032 bp, Homo sapiens
tttaaaaaaaaaaaaagggacccctgcctttcggggtccaattactataaagaacctcaagattttcgatatcaactgaaaaaaatgaaggaaaaataaatcattgcagtatacgttctttttatttgtattgaaatcgttaacatgttctgttgttgatctttggagggtacatcatccagttcctatccaaaggaacaatcacagccatggtttttcttttaaaagatgctagagaattttctccgtctctgtctccacccctctcagtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggtgagtctggaaaaaacttcgctggggttttggtgtgtgaaagacaggtagttagaacaacttaattttttctacatccagcagtaaaaaattggagcactataaaaggcattactactactggagcagaaaagattaatagtgtcactgataggtaggtcgaagactggtgttgccatgaatgaaaaatggtcaaatgttaatttatccttaatacacgtgttctttatcacacagaaattaaaataactgttattaagtgtctctcctttggtaacacatgctcactcttcttctgatttccaaacacattaaggttttctattttgcaatgtcctgaaactcttggacttacttcattcacctactcagttcctaccatttttaagatgttaaaaatctgaggcatctcctcagaaggtgagttctactaaagttatcttataagcattggttgcatattttacctaatttcttctctgagagtagggatagctaccaggcttctttttcttatgcttgtaagaatatacgacaggattctcctccctttatgctgaata

SEQ ID NO: 35947 - DNA, 1045 bp, Homo sapiens
accttgttagaagctaccataaatatattaactaatttgttacataagggcatatcttacagttaatcatcatatatggtagtccttaacccagggcttccttgacttaatcacagaatctgctctgtttcaaaatcagtatcttccaaaagagttcatattagacaacatggaggaccccctgtgttctcctgtttttcctgtttcctctgacacttgggagttcattttagtgttatggagtaactaggcttttgcctaactgacttacagtttccattgggttttcttgttggcagagctgctatatccccttcccaaggccagcttccagctaggatcattgattggggtgttcagccaacttcttgggaataagtggactgagaatctggagtttggattatagttgctgttcaattcactttgtgaccttaaaaaaatcactcactcccttggacctctttcaagttatgtacctatgtatgtatgtattttagagacaaggtctcactctgtcatccaggctgaagtgcagtggggcatgatcatggctcactgcggtctcaaactctggtttcaaacaatcctccctgcctcagccttctgagtagctgggactacaggcgctcaccaccatgcccagctaatttgaaaaaattgtttgtagagataggatcttgctatgttgccgaggctagtctagaattcctggccacaaatgatcctcccatctcaacctctgaaagtgctgggattacaggagtgtactatcatgcctggcccaggttccttatattgtaaaatgaaaaggactagactaaataatagctaaggccttaaaaaaaaaacaaaaagcaaaaaacctctatattgccatagcaaaccaggagaattcctcctcctacctcagattgtacagcatgtgacccaagcaaagcctaatgtatattatagaataagagggatgagtgacatggtcaaagaaacaaacgagaaggttgactcaacaatatttagccgaaacaatagctgtaatagccta

SEQ ID NO: 35948 - DNA, 1044 bp, Homo sapiens
gccagacaaaccttcctgatttacagcccccaatctccattctcattgaagtctcatccatcagattatttccaagggctgatgcattttccaatgtatgtttttaaattcttcgattcagaaattagaagaacaaattatcaaaatcaggctctctgtactgatttcaaccaatagatttttttctccaaatgttttttctagattgcatagtaccttatacatatgtattgaaatacattgatgtgatttagatcaccattccctccccatcttcctcctgaaataacacctccaaggtacccatacttcattattttgaagcatttcatctcccatcccaccccacccaatctgttaagtccttgtaattctttttccattacctggccaacccatttacaaaggtcaactgctgactattgttctcacagacatacctattcctgcatgaccttcaaccaggacccatcccttaatgcctccaccatagagatagtgcccttaggattcaaagtgttctggggaagattgtatgactccactgacatgcccaactgcaaagtcatgcatgtagcctgaactggaccccagtgttctctgtggtccaactccattccccttattgatttccctccaagttcccaccacctctctcatctgtcagcagatgatctctcctctttattaagaaaattaagatcattgaagctggctgcagtggctcacacctgtaatcccagaactttgggaggctgaggtgggaggatcgctcaagtccaggaatttgaaaccaacctatttgatatagcaagacctcatctctacaaaaaataaacagaattagccaggtgtggtggtagaagcctatagccccagctactctggaagctgagatgggagagttgcttgagcctaggagaggtggaagctgcagtgagccgagatcatgctactacactccagcctgaatgacagagtgagattatctcaaaaaaaaaaaaatcattgagaatgagtaccttcatctttctttctgtgtac

SEQ ID NO: 35949 - DNA, 1599 bp, Homo sapiens
ctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatg

SEQ ID NO: 35950 - DNA, 1450 bp, Homo sapiens
tttaattaattgaaagcaaggatcgactaggcttttcttgtaactgatccattacgaagaaaaaaggagtaaggactaagaatagggagagataattaaacaacattaacaacctgtaagacgtttaataggacttctgtacagttcagaacagacgatgggaggggaagtaaaacgcttaaaacgattttcaagggaatcacagtgattgtgataaaaagctgtgcttttcgagtagtatggtctttacatttttgtgttgtcccaaatgtttttggtcggttctgcataaatagtgataggttctgcctacatctgtgggggcaggattcatgaagcatggcagacattccaccagtcagagctatgaacacttctgaaccaatggggactagttttgatagcagtaaacccaaagtttttttcagtggtgttttagtctttttctgtttactttttttcccggtatttttgcggtacagggaggtgaaatacaatactgtacttttgaatatatattgaataaatttggtaatcctgttggtaggtatatcctaaatatatattgatgtttagattgcctatgctgtctcacgtaatgaccggaaacccgaggagagagttgattttctttagttcaaagagaaaaaataagttttaaagatcaggatcaaattatttcacaatttgttctttgctacttcagcttcattaagtacatctccaaaggcagtcctttatttattactgtagttttgattttttttttcctccccggggcatggtctcaggagattctttttttttttcattgttggtaagatttgtgaaccatggaataattcttgttaagtcaaactagctttatcaaagaatttaaagtgcataactcatctactttatgattttggaacgtatcattaggctgcaaaagaggttattcttgggcatctgaaagaggtgaacaaaataaatggcattgaacttcagtttccttatatggcttatacttggcttcaaaagcaacaaaaccttaatagagcaagtcccttacagagaattatcgctttatgaagatggttatttattagtaaattttgtataaaaaaagtattgtagcacttgaaaatgactatttaagcctctatttttagatttagttcttgattttttttctcaggagaagagtagtatgtttcgatgcagacaacacgttttatgaagtgaggtgttcacctttgtgtttcttttttttctcctcaacaaggcataatttacttcgtagttttcttggaattctgttagtttatcaccgaattaacttaaattttaggttttatactattgtgaaactataagtattttcgaagctttgtttaaactgtgacaaaggtttgaaaagaggttaatagaggagtcatccgttaaaatatttttaaatggcttcaaa

SEQ ID NO: 35951 - DNA, 1052 bp, Homo sapiens
ttttgaaattatctttctttgatttcatgaaataagcacaatagtactctatcactctatttttgtcacttcaaattttgttccagacaccattgaatgaaggtcttgccaggctttaagtgatagtgtggaagacgatagaaaaggagaatatctaaaaattcactttgtggaagacgatagaaaaggagaatatctaaaaattcacttaataagactctacttatctggaggttatttattatagctttaaaagcatattgaatgtagtagaaaaactagaaaataaaaaatgacatctccttaatcacaacaggtatgacagagtctggggacttcacttttagggccattattattcagagcccatttacttatgtacataatgagctgtttttggttctttggtatcccagaaggcgtgagaaaggtacgtttacagcattgtgaagttatgacctgtggtgttacagtgaagcaatagaaaaatggaaagatgactgaataacttagaaaataatctgggacaacttactttgaggctaagtgccttgtacatttcatttccctgtaggaggattcactctgttataatatggtataattacaagaaatagtaatagtcctaaggcagctgttctcagactttttggtttgactcaaaacagaaattaaaaaaaattaatttatttgaaaataagctattgcatgttagtgtaacattgttttaataaaaatataattgttttctaaaataaatagcaaaaatagtggcaatgttttatatttttgcaagtctcttatgtttggcttaatagaaaacagctcgattctcatatctgcttcttcactccatctgttacagtatgttcttttggctaaagtatatgaagaaaatccagccttatacaggtatttggttggaaaagggaggaagattttctttcttttctttctttttttttttttttttgagatggagtttgctcttgttgcccagactggagtgcagtggtgcagtctcggctcaccgcagcctctgcctcccgggt

SEQ ID NO: 35952 - DNA, 1032 bp, Homo sapiens
ttcctaggtatgttctgaagaatacagtttctttagaataatactatttcccaaagatttttaataggtgttagagaaaaaaagagttttgggctcatctaagtgaggaaattctgagttgatagacctggttttccatcttctctttggcggacgccagtttgttatagatgattatttttttagtttagaaataactggatacagcttaatttacaaaaaaagtttacatcaatatttgagccaagaagtttcagagaaagatttatccttaaagtagtgtgtaattcttcatgatctcaagttttaaaaaatagacttaaggctgggtgcagtggctcatgcctgtaatcccagcactttgggaggctgaggcaggcggatcacttgaggtcaggagttcgagaccagcttggccaacatggtgaaactctgtgtctactaaaaatacaaaaattagccgggtgtggttgcgcatgcctgtaattccgcctactcgggaggcttgaactcaggaggcggaggctgtggcgagctgaggtcacgccagtgcactccagcctgggtgacagagcgagactccgtctccaaaaaaaaaaaaaaaaatagactttaagttttttgagtagtttcaggtttacagaaaaattgattaagaagtgtaaaaaattcccaaaccctccttctccatttcccctattattaacatcttgcattcatgcagtatatttgttagaattgataagccaatagtgatacattattattagctaaagtctattgtttatattaggcttcactctttgtgttgtacattctgtgggttttgacaaatgtatacatgtccctgattgttgctgataatggcaacaatctgttcagtagttatagcttatggatgagcgaaatgaattacaggaatgttagaagggatgagaaggaggaattgggaatactctctaatcaggcacttgcattacctaagatcagattacttttttactgacagcatatgtgggaataatgtattac

SEQ ID NO: 35953 - DNA, 1036 bp, Homo sapiens
gctgagatgggcagctcacttgaactcaagagttcaagaccagcctgggcaacatgatgaaacatcgtctctacaaaaatacaaaaatcaggtgggtgtggtggtgtgtgcctgtagtctcagctactcaggaggctaagatggaggtattgcttgatcccaggaagtcaaggctgcagtgagctgagattacaccactgcactccagcctgggtgacagagcaagactcagtctcataaatgaatgaatgaatgaatgaatgaatggaatcatatagtacatgacttttgggattggctttttacttggaagattccagagttgttgcttatagctataatttgttcatttttattgagtagtactccatggcatccatgtgctaccaatttgttgaatcatttcatgttgaaggtcatctggattgttgtcaatttttggctattagaaataaacctgctgtgaatattcatgtagaggtttttctgtgaacatcccagttttcactgggataaaagtataagagtatgattgctgcggtgtatcggatagaaactgccaaagagtgttttccatagtggttgtactattttgcattcccaccagcagtgtatgagagatctagtttttccacatcctagccagcaattggttgttactttttttttttttttttactattttaaaaactattcttatagataaggagtatatctcatcatggtatttcatgttagccttttcctaatggctaatatgtggaacatctttaactgtgctattcaacatctatattctcttcatatctgttgcccattttctaactggattttttttttgtaagtattgaattttgagagttctttatatggatccgtttttggatatatagtttgcaggtattttctcccattccataccttatcttttaattctaacagcatcttttgcagaacaaaagcttttaattttgatgaaatcccatttattattcttttatggattgtgcttctgttgtgaagtccaggacttttt

SEQ ID NO: 35954 - DNA, 1033 bp, Homo sapiens
ttcccttaatttacaatctgttaaactagtgtgtaaaaaaactccatccctttgtctttatatgtttacagttaggttctaggcttagataattataatttttttttcagcttcatggctggaggacatttgaaagttggtacaggatattaaccatcactggcctttggcaagtctattcattttgacaacgaaaatgttatcatgtattttcaaaatgactcttttgacaaccactgactgtcttaattccctaaacctccctatccatatgtgtttaatttccattaaaagggaaaaattttaaacatttgattaaaaaccttcttaaaacattccaattttaggtccacaattccttctgtgtaattctgaaattcagaaattcctgaaaattgaacttttctctttttttgctgtcttcactttgctcccagttaaaagggctacctgaagagggcaagtggccttaattatgcacaagcaagtgttctggcactatagtctcacccctgggcatgaacttttttccctaattcatttggttgataaaatgtgacttacgctgaactgtgatgtgaggctgatactggtgtttatttatatcgttttcccatcagagttaatatttgtaaattatacttccctgcagcagtattttccaaaatgaaaaattctcaattctgaaacacatctactggcctgaagagtttggataagagattgtagatctgtattgccaatgtatatgtattaattgtaattattaagagcaggagtttttaatttgtggttgatccatggacttgtaagttaacattagctagcagttaaagttagtgaaaatgctgtttttgagggggttgggagtctaataaagagcatctagacttatttccattaggaaattccagctttattttgtaatactaagtatgactattgatgacttttttttgtcagttctcttattctgtagtctacttcttttacatttgaggtagagaatgtgtggtgatgaattttaggtatc

SEQ ID NO: 35955 - DNA, 1049 bp, Homo sapiens
gcctcccaaagtgctgggattacatgcgtgagccaccacatccagccatattttttaatttttgcaatggagtctcactctgtcacccaggctgtagtacagtggcgcaatctcggctcactgtaacctccgcctcccaggttcaagcgattgtcttgcctcagcctcctgaatagctggaattatgggtgcccggcatcacgcctggctaatttttgcatttttagtagaaacgggctttcaccatgttggccaggctggttgtgaactcttggcttcaagtgatccacctgctttggtctcccacagtgctgggattacaggtgtgggccactgcgcccggctagattgtctattgaatttagatgttttaagaactgtttttcttgaaatgatggggacaaaagtgtgattggagtggatttaggaacacttgatagaataattgaagtcagtgcatgtggacaacttgtttgaggaatttttctgtaaaaggcagcagagtaatgggttggtagctgtagagagagatgtggtttcaggagagattcttttttaagatgagagacaaaatatacctgcttggtatagcatattgctgtgtgtggtcacaatcagtttagagtattttagcctgtttctctttgtaaggatagacttaatattccccatcataattagggttctttctagttaatttgactgcctttttctgtttccatttagggctccctaagtcatgcataatgaattcatggaggaaaagaagttgttacaagttactaggagaaacaaaggtgattgggaagtactctggcatagacataaacatgaggaagtgaactggtggaatacctgtggggaaattaatcctgctacaggatcgtatcttatggggaagagtttagaatccagtcaagactgtatgagaggctgggcacagtggcttacacctataatcccagcactttgggaagctgaggtgcttggatcacttgaggccaggagtttgagaccatctggcgaacatggtgaagcccccatctcca

SEQ ID NO: 35956 - DNA, 1088 bp, Homo sapiens
attgctcagaggaccgagaacatgcaggaatgtgaaatgtttatggagaattgtctttcaacccagtgtactctcgatcacagtaatttgccttcctctcatatacaaaatttgatcactcttttccaaaagtcttattccattagagtatgaggcttgatgatctgtctcatcaaaataagatctagatacagataaggatcctcaaagccatttgtaattagaaaaatgcaaaataaaaaccagatactgcaattacataggccaaaattaagaaaacagtaccaagtgttggtgagaatgtaattggaattctatttgctgggagtgttaaataataaaaccactttgtaagacaatagttttgagtagaattaaattacttatagactatgactcagcagtttcattcccatatatttacctatgagaacagaagcatgtgttcttataacgcttgtacacaaatgtacttttattcaggacaggctgtcttggtcaggatgttgactgggaaggggcaagtgtgaaccttgtagggtgatggaaatgttccatgtcttgattcctgctggttatatgattgtatttctctaccatctatactcttagaatgtgttcattatgtaaattgtatctaaaaatataaaaatggaaaattttgcaaatgtaaggattccttggtaacttcagtgtatatgtctaccacttaattgcacagtaatacatttttagacatgtttaggctaactatagtttgatataaaattttaacactgttcatattgaaataatacccagctttcttcttgatcagaattaggctgatgggaccagacattgatgttgatcttctagttataagtatgatctagccatcaacatcttttccttatttcttgtatatgttgtaggcatatcacattttatatatatttagtttttgactgttgtccttataaatgctcttacacagcgtttataattttttcattacttaagttcaaaaactttttttttactcttcttaccttcctatctttattctttttcatattattattttaattgtttactatttatgtact

SEQ ID NO: 35957 - DNA, 1028 bp, Homo sapiens
agtggtgtatttaacccattttaccttaagagagctgagataattttaatcaacctgtagtattcaaccctaatatgtatgtttgtataggtctattgtgttgaaaaaaaattaataaagcacacatattaggttgcatattaggtcgatgtggctggatgttagaaatttgaattttgttgcatttttgatttgataatagactgcttaaaagaaaggttagtacatttaagcaaatgtaatattttgaaattattaaaatgtaatttcatgaaattattaaaatttaataatataagctattactgtttcgcttatatttaagctctagtgttttctccttttaggtttttatatcatttcagtctaatatttaagtttatcataatatgctaggtacagttttcagattcattagctgttgtgcactgtttggaaggaggcaggaaatttgtggcatactttgttattcatcatatcatcaagctgtatttctttaaaagcacttgcttttaggattttggcttttaggctgtgatagtttctgattttttatgtagttcttatcagtgtttttcatttggtaagttagcatggtttaggaataaaaagaaatggcctctattctttgcttctctgtttattggtctggttattaaactggggacttaatctaaatttgttagttcatctgtaagattgttaaacacatgaaatggatcagtctaggaagtatataattctaagggatttaatatttgtatttatcaagaaattcagttttttcttttacagtctatgataaaactggaatgttaatttgttctgggtcttaatttgctcttctctttcttttctcgagttttggtttactgtatgtatgctttttattttattttattttattttactttaagttctgggatacatgtgctgaacgtgcaggtttattacataggtatacacgtgccatggtggtttgctgcacctatcaacccgtcatctaggttttaagcttcacatgcatt

SEQ ID NO: 35958 - DNA, 1061 bp, Homo sapiens
aagaaaaaccgtgtagctattaattctcttatatgaacataatgaataaaatgccagggattacaaggcagagaaaccagaaagagtagctcagatccttctgtctaatatggcaatactagcgaggttaaccaaggtatttctttttagttgagtcaaaaagcccaggaagagtgaattgaaagtttgtggtcaaagcagaaagcagttcttttaacttgagaaaatctgatgactggggacaaactagtggaaaagccttttcacattaaactaaaagaagttaaattgattaagaggatattacagattgatggggaagttatggtatgttgctcttgtgttttaaatttctaaaattgccattttgctttgtagttgacgttttgagcccagctgttttaataaatcactttatttaagataatgaaagaaggaaaaccatgttttacactgtccatgtttagactggtgatttctggccactgccaagtgttttgataaatgtagactgttaactggagtgtgcactcatttgtgccctaccatagcgtaggcattattatttgttgtgttatatctggtccaaatcatacatgtgttatcctctggaagctatcatcatttgagtttgcaatttccggttagttttgaccagaactcgaatgttttattctgtagtatggtaatcattgcctttggagtgcaggaacagtaagggactcctgttgacttaaattcaacaactgggacagtgggatgttgacacctgcctggcagagaccaccagggactcacctgcagttaaacagtttgtgtttattacttcatggtgagcaaaaactcatattattgggattcatgagggtcgcagaaggtgtaaaaaaaaaatacaggatttgggcttttgcttggtgattgggaaggtttcagaaaataacggtttgccgtggatgggatgctgtcaagaagtggggtaattctatgattgggtatcttaatgttatctatagagaagttgattagagtagaactaaagctgtaatcagtaaacaatacat

SEQ ID NO: 35959 - DNA, 1076 bp, Homo sapiens
tgtaaactagttcaaccattgtggaagtcagtgtggcgattccttagggatctagaatagaaataccatttgacccagcaatcccattactgggtatatacccaaaggatgataaatcatgctgctattaagacacatgcacacgtatgtttattgtggcactcttcacaatagcaaagacttggaaccaacgcaaatgtccaacaatgatagactggattaagaaaatgtggcacatatacaccatggaatactgtgcagccataaaaaatgatgaattcatgtcctttgtagggacatgggtgaagctgaaaaccatcattctcagaaaactatcacagggacagggaaccaaacactgcatgttctcactcataggtgggaattgaacaatgagaacacttgggcacagggaggggaacatcacacaccagggcctgtcgtggggttgggggagcggggaggggatagcgttaggagatatacctatacctaatgttaaatgacgagttaatgggtgcagcacacctgcatggcacatgtatacatatgtaacaaacctgcacgttgtgcacatgtaccctaaaacttaaagtataataaaaaaaaaaaaaagaatgagccctggttgtacccaacatttaacagatctggaagaagagaaaatgcaaaagctactgagaaggaacactactaatgggggagaagctagtcaaatgaaaatgtttgttttccttattgcattttagcttctcatgaaaaaggactgtgccttaaatatctgtggtatatagcatagtgtctgatactaacacatttgctgaataactttgaagataggtaatttcagcttgggataggttgagtttgaggcatgtgaacaaaatctaatgggcatttgaaaattcttagcagcagctaaggagggaggtgggaactggagatacagatttagaacctacaaatgtatgtggtaggaactgaagtcagactaaacacattgctagcaattttcaaaagtagaaaaccagtgtttcaaaactgtttgcttagggcaaaattactactatgtgtct

SEQ ID NO: 35960 - DNA, 1045 bp, Homo sapiens
gtttacaaagtgatgaagatacattgaaacaagtaggttattataaaaggcaaatctttgaaggggctctcataaaagtagccactcataacagaagcgactgttttctgtctgttgggaaaatatcttgtgagagtcttagattttaataaaagactgaatttcttacatgaacttaacttaaattctggtattttatgtaggctccctgatggattttctcagctgttaaacctaacccagttgtatctgaatgatgcttttcttgagttcttgccagcaaattttggcaggtaaattatggtttcttctaaaacgttttattattagctcttataaagtttacaaaactataagctgctttggtagtactactcattacagtttcataggctctttttaaattattcccaagcattgtgacttttatactttgtttggtggctttgacttaatttttccaagtaaacaataatcagtgagagtttgaaagaaaaaaaaagttttcttaggtggccaaaacagggcgtttcaatggggttaatttctgtatgcttgagatactgaatgctatattcttagcattctaaaatgatttaataattgatttatctgtcttctcccctggaatcaaaattcttaagaaaagagaatctgtttctgggggcgacctcatcatctccctgccaccctcaagtctctgagtaattttttaaacaaacagatgaatgtataatagatatgcagttattactgagtttaaattaactactagagaaaatgctagccaactaaatgttaattttgtagccatcttttatctaaaaatcattgatgtacttgtcagattcctcttctgtatctggcatttgcatcacttaatctgctcattttctctctagttttagtggaatgtacatcaatgaagtgccagaggatttctcctccttcttttgtttcattatttcttctcagagcagcactttagagttgcattattgttcttgaatctaccaagagttaatttttgtgagcatttttggta

SEQ ID NO: 35961 - DNA, 1045 bp, Homo sapiens
tcttcacctgtgaacttaatattacacttggatctacacactggatcaggataatctgttgaactctgactataaatactactcttaaattcttttctttattttgcccgacaagggggagtataccttttactactgggcacagatgtttttatagattatggtatgacgaccttttagactaacgagcaaattgtttttagtatatgttgtactctctgcgtgtgtgtgtgtgtgtgtgtttattgtgttacacttaaagtaactattttttatgtatcttctttctgacaccagtgaaaatctctgtggtttgaaattatttataaattaattcttagtacatagaaacactgaagaaaaaatgtaaatcagtcatttcaatcataagtcttaatttataaattataccacgggcaagttaaataggttcttgaacttcagtttccttatcttgaaatgatgataatagttcttttggagcacagccacattcattcactacaaaacactctggaaccaagcatttcacataagggatgcttaacttacgctagtattctgtcctctcatgtaaaagaacaattatctagtatattgcatagctgattataacattatttagaggatgcttacccttacttcctattttccagaaatcatcttcagagacaaagaaaagtaggaaattgagacataagtttcagtgagtaagacaaacaaaaaacttagctattgatgcattcaagtatttgctgtaattccccacatggcactgcttacagcataagcagggtttgcacttctatttttaacttaatttctaattcatgaaattattgttcacataaaacagtaatcactattgacagcttaatattaagtatactatattttgttatggaaacatacttccatattttattgtattgcttaatttggagattatgggtgaatttaaatacatggaagagaggttgtttgtaaacctattctcaaagctttaactatagaacctccagtgaatgaagctctttacattagt

SEQ ID NO: 35962 - DNA, 1026 bp, Homo sapiens
gatttggaagaacaggtgtagtggtcaaagaggtggaaaagtcctgggtatgactatggttgtgaatcatttagctgatgtgcatagggacattgggattgaggacatcaaggaattataaagttgtagtgttggggtggtgggcttatcatcccacattgacatcattcaggatattagcaggtcttaggtggagagaaaatctgtagctaaaatattagagtcctcagtaagtctatacctgggtgatcagtttgagtagcctctagaatggatagaaagggatattacctgatatcctgaatcttcaaagatgtgagatttatactaaagagtagaaagtgtaagtgacgagaatttgacaagaatgagaagcatggtataagttaacttaccttgggcttctgaataaattctggtgtaaagttgctttagaaataatctaacactaattggaatctctgggccaagctggtgattgaaattactgccctggaacaagggagagggaattatatgaattaaaaaatagactttgttggaaactgctgggctgtccttgcctttccaatcataccacaaaagtatgtcagtaggaatttgaatcacattccacatttgttttgaacaaaaacaaatacactacttcattgagtacgtgttaagcaatttaaaaaagcaattataagggaaaaaaaatcttgaatggagtaatgaaaacaaagaaaaggctaaatcaaagaatttcattcccattggtaagatttggtttcatgacatccttaatttgggtatgagattttaaaaggttaagcaagccccaaataagggcttaataaaaatgataattagaagtttttgtattatgttatttttgcagaaatattcgaattgaccatatttgggtattccaggagtttctggggttctttaaagctcattttgggtacttgtaatctctctgttttgagtaaaggatagtcattttcttttaaatttgtgattttattttgtattgcacaacta

SEQ ID NO: 35963 - DNA, 1034 bp, Homo sapiens
aatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaa

SEQ ID NO: 35964 - DNA, 1100 bp, Homo sapiens
aggtgaaaaccttaaaagcagccagaggaaaaaggacatgcaagaagaataaagacaaaggtaatggcagactttttgcctgaaagaatgcaagtgagaagacaatatattaacatctttaaactaatgaaagaagaaaactgtcaacctagaattctgtatgtaccaaagactatctttgaaaaaataaagagaaaaaaaattttttatgacataaaaacttgaagaatttattaccatcaagcttacactataagaaatattaaaggaagtactttatgcagaaagaaaatgatattagattgaaatctggatttacacaaaggaatgaagagcaccagaattggtaattacatgggtaaacattttaaaaattttttattatttaaatgtcttcaatatattacaaaggtaatagcagatttcttgcctgaaagaatgcaagtaagaagacaatatattaacatctttaaactaatgaaagaagaacactgtcaacctagaattctgtatgtaccaaagactatctttgaaaaaataaagagaaaaaaaattttttatgacataaaaaaacttgaagaatttatcaccatcaagctcacactataagaaatgttaaaggaagtactttaggcagaaagaaaatgatactagattgaaatctggatttacacaaaggaatgaagagcaccagaactggtaattacatgggtaaatatttttaaaatttttcattatttaaatatcttcaaatcttacctgttagaacaaaagtaacaatcaatgtagggtgggatctataacatatgtaaatgtaaaatgacagcaataatacaaaggtcaggaggggagagatgtaagtatattataaggttcttacatgtgaagtactgcatcattcaaaggtaaactgtggtaagttaaacatacatactgtaaaccataaaaaaccactaaaataacaaaatccaaagagttatagctaataatgtaacaaaggagataaaatgaaatcataaaataatccaaaagagggcatatagagaggaaaaagtgaagacagcgacaatagggacaaagggataacaaatagtaagatg

SEQ ID NO: 35965 - DNA, 1062 bp, Homo sapiens
taataaagtggttaagtttataagttctgaaatcatacactttgtgaattcaaataaaattattttttagttctgtggtctagaataagacatgtagagattacatgacttatactttcctcatctttaatgtagggatagtaatagactctgcctcataaaattgctttgaggattaaattaaataatgcatgcctaaggttttggcctgatttctgactcaataactattagttcctgttgttgttgttgttgaaataaaaatttaattagaaaaaaattttaggccaggcacggtggctcatgcctgtaatcccaacactttgggaggccaaggtgagtagattgcctgaggtcaggagttcaagaccagcctggctaacatggtgaaaccccgtctctactaaaaatacaacaactagctggacatggtggtgcatgcttgtagtcccagctacttgggaggctgaggcagaagaatcactggaacccgggaggcagaggctgtagcgagccaagatcgagccactgcactccagcctgcgtgacagagcaagactctatctcaaaaaaaaaaaaagaaaagaaaaaaattttaagtgacttatactgagagtgcttcagatcaaaacccatgtaaaaagagacccaaaggaaaattaatagctttaaatgaatttctaagaaaacaatatgttagaaaaaagtataattttaacttgtgaagttttataaagattaaataagcacaatgaagggattattaaaggtaaaatcagaaattattaaaacaagaaaaatatccagtagaattagtcaatgataaagaataaaaattggtttctaacagaccataaagtaagcaaacttacaccaaccatgatcaagtgaagtagatgggggaaggagaagaaatatgtttgaaatgacaaatagcacagaactgtgtactatgtagctctttatagtactaactttgaaacaaacagcataatttctaaaaaaaaaaaatactaattaccaaaattacctcagaaagaagaagaaatcctaaaagactat

SEQ ID NO: 35966 - DNA, 1097 bp, Homo sapiens
aggttagaagggagtggggtgatatatttaaaatagtgggggagaaaaaagctgccatccaaaaataccatatctggcaaaactattcttcaaaaaataaaggagaaattaagatttttcctagataaacaaaacctgaagtagtttatcaccacttaacctatcctataagaaatgctgaagggagttcttcaaggtgaatcaaaaagataataaagagcaacacaaaaccatatgaaaatattgaactccctggtaaaggtaaatatatagataaatatagaatcctacagtattataatgtaggcatgtaaatcacttttaaatgtggtaaagaatttaaaaacccaaagcataaaaagtaattataaaattatgttcatgaatatgcaatacaaaaaggtaatttgtatcattaacaacgttaagtggggagggtagagatgtaaaaaagtagagttttaatacatggctgaagttaggctgtttttagtttcaaatagattgttagaactttaagatgttttatgtaattgcaatggtaaccacaaagaaaacatttatagaataatacacaaagggaaatgagaagggagtgaaaacatgtcagtacaaaaaaaaaaattaatgaaacacaaaagaaagcagcaagggaagaaaggtgggacaaaaaaagctgcaagacacacagaaaacagtttacaaaatggcaatagtaagttcttccctatcagtaattactttaaatgtaaacggattaaacacattaattaaaagacataaattggctgaatggatattaaaaaaacaagatccaactatatgctatctacaagagactcattttaaatctatgggcacatacaggctaaaagtgaaagggtaaaaaaagatacgccgtgtaaacaggaacctaatgagaaccatacttaaagcttaagacttcaaatagactttaagataaaaactgtcaaaagagacaaagaagaacattatataatgataaaagtgttaattcactagaaaccattataaatgactagttataattttattataactttattattgattataaattatttatacttattatt

SEQ ID NO: 35967 - DNA, 1058 bp, Homo sapiens
gaaatgaagtagatttcaactaggggtatttggaaatgtggttttagttttcagtagtgcttacttaacatttacattccttcacaaaaggatccgtcagtttaggaaatgttgcttcagagatgactgtcaggctcttgaagatttcagaggcaaaagagttattcctgttggaattgctagggctttagtaggttattataatcacagattgtttttggttaaaaaggacagaaacagtgttacccaaggtacatcgagaagagacattattattaaaaagaaagatttcactgcgttgaaaaataaagattgtagtacagccaggcctcatgggaactagtactgggaaccagaagggtatcagcaatcaagatgactatctgcttctttctctgcagtggttattatcagttcagtttgtttctatctactccatttctttgcatacctattatgtactcatcatctggcttacagcttgctgtaagtcaccttccagcccaatagagagaacctgattgattgatctagctcatttggtcgagcctgacttccaaaattagaggttgctggtcagccagggaaatgggcccttgagactggtgactaatcatttatggctagagaagcttataggatcttttgagggtttcacatgaggaaaccgtgctaaggcctgtgccaaagcaatatagaatgtcttggtagcacatgtaggaggctgtacctaatgattgcggtatcttaagatggtttaccagaagacttggaaatttgagccttgaagaagagtggaattagcattcaaaatgggagttagcgaggacatcgtaaccaaatggaacagcatatatgaagacccatatgtttgtgatgtgttgctggaaccacaggtatcatttttgggtgcatttccatgacgaggcaagaacagaatagtacctttaaggaaatttgatatgtggagtgacacaatgaaatttagtgtttagaaagatcactgtgggagctttggtggaagaccattaataaggatttgaggttgggtgctgtgt

SEQ ID NO: 35968 - DNA, 3047 bp, Homo sapiens
atactgagaaactgcatgggaaaaaagaaatcaggtaaaaggtttattaaactggaatattaattatatcagaaaattaataccaccaataacactgggtcttttattgtgttagcttattactgaattggaaggaagaattttatcagtgttgcttggttgaaacctgctttattcccatagaatctttcatatatctgagaagccctactgtattttgttataaatgttcaagatgatgggcgtgtagatgtcccttttattgtttattttacttgatagagatgaataaatgcacagtcagatgtacctttttagtgtttttaatattacaacttggacagttttactgtttttgaacagaaaaatttaagcatacttttattgcaatttagttataagtaagtaaatattttgaaacactaacctacagttggtattggtgaaacattcagatatacgtttttcattagttgtattaaatacggcagagatgaatttatggaacctcgagaatttcacagtgagctgttaaaatactgattatgcactacaagcaaagaaatagtgcattattgtactaaaaaagatagcagagtgagtgtgaaataaccaaagaaaagtattccagtggagtaagttctgtaagaggagatgtgctgtggtgctgtaagcaagcagtgttctgttgacctcactgaatgcatcctttccttgatgttgaacaaacagcatcatgacataagtgagaaaaaccatagaaaaaaatttaagaagttttttcagtttctttgaattgctgttttttagtgtagacagtaatgtgagaagatcctaagttgtaaaagtaacatttgatgtgtaacagtttcatgcatattaagccttagcctttgttaataaaacatgccatttcaaaataaaatatgctttcattatacttgtccaaatatgacctctttttgttgttgcgtgcatttcagatttctttttataaatgttaacacgtagaaaaagatacggtcaaacataacaagggtgtcagcctaatcatcagtcataactttatgtccacattttctggtagatggattttgactattaatttggttttgtatgttttctctatgtgatatttgtgcattattagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagtatctcaggaacactttctgatctcagcgcaacatttttctagtttttttcccccctagtctacatctctcataaaaactgatagcttctaatttttgtccttccccctggaattttaggcatacaaaatcatcaaggaaaataagtaaatataacaatctgggagtaaagaagagcctttcatttttatgatggttatttatcatataacttatttccttgacttatgaagactttttgttgcctatgtggggaatggatatttgagaaacttaagtatttgcatgtaggtttttgttagcttgaattttttgttgaatatttttcagaggttactagcttctaaatggattctgagattaggactataatactgtgagagatgttttcctcagttgactttgaggagtatagtttgggaaaaatgctaaatgcttatttgttttatacttttataagctctgttatttggagggtaaatttggtagaattctatcttggaaattaagcaatggagctttttcttaaagtacttttgccattacctttaggtaattagaataagtatatagagtaattagaatggtaattgaaagttaatttattaaaaaatgtgcttatagtggatttatacatttatagtagtatactatatttatagtagtatactcttttgaaaggcagtgggagagtttgacaacctactgatacttaagctgaaagtgaaagacttcataatactaagtagtcaacttttggccagtgttgaataccctttttgtttgtatagtctttctacaatgtcttcaataggtagttttacttattaaaggacaagtaatattaaatttgggacattactagattagaactctgagtttccttaggtgcatacattaaggtagtgacgatggagtttctgcctcaaaacctcaatttatcaagaatgttcaggttttacaaaccttttgagataataccaatttataacagataaaacaggtgaaatcaatataaatagtatagtgtatatgtgggtatatataaatacatgtgttaataccaataactaatacatataaagcagattattgttatttgatgttttcagtaaggcctacctgccttttgttgatgcatgttaagaaatctgttctccagaattttcactgaaataataaagataactttgtttttgaaagtaataaagtaatataaacttagatgctgcaaaggtagaaaatagtaggttttatttgcttcctataaataaggcatagccattatttaaatcaagttttaaattccaacttgagttccatccatgtttaaagatatattcagataatattgtttagggatttatctctgcacatgtggttgttttaaatatttttacaactgaaaccaggcatggtgcttgtgg

SEQ ID NO: 35969 - DNA, 1598 bp, Homo sapiens
gtttagcatgattttgtgcattgtcttttaaaacacttttggagaattaataatagaaatgctttaccagctaccacatgagtgttcttctaaatatatccacatgtagtcaactatttaagaattttttttttttttttttgcctaaggggataaggaaaaataatgtgaaagttgcagtccttatcagaagtaattgattagaattcagcaatgaatatgccaaatcgtacttatttcagagtaagtttttcatttttttaggttgtagggagtttttttcctactgagtgttattagattattttaatgttactattgttattaggcaattaaaatgtttttaagcaagctttaaggcattaacctcccccttcagataagtatacataaattggttctaaaagttaataagaagttttctgaaaccagggaactttttttttcctgaaacatttttagtagtttcccaaggcatattttttggaactgagttcttttaggcatctctgatgttggtgagatgctttattaactgaatggatgtaggcttccttttacgttgaagttgattacatggagtaagtttttgttttctatttgaaattaaatggaatctgttggagggttatcaaaattgtttgcatcacaaataggtagtttcagtaacaggataggggcactcattaagaaatttcaattcgcacatatttgttttttctttttcttttttttgactaatttggttatttgccatttctggggattaaactttaaaaaatgttcttcttttctgtatctgatgttctgtgtgctattagtgatgcagccaacacgaacggttgtcatgtgtaacacaactttcgatcaccgcgaaaacaccgtcctgggaaagcgtccatgcttgatatcgtttggttcatgaacattaagtttccagtacaggtgacccatagctcaaagtgttaaataattgtctacattattcaatttttaaaataatattccattaatgagattgttaatatttgaagttttgctcacttttatttttcctagtagagcaggataaaaggaaagacttaagttcttatttatttctttatacagatctgatagatagattcatttattattattattttttaactgcaagggtaattgtaaaatcatagtgtaaagtttgtgtggtgtttctgctttttgtaatgtttggaacttgcctctgcaggtaaaatcccagaggaatccaaagccctctctttattggctcctgctccaaccatgacaagtctgatgcctggtgcaggattgcttccaataccgaccccaaatcctttgactactgtaagtactataagctggcttatgaaagaggtgaatgttcaactgtgtgaccagttgaatagagagcttcagattatttgcatttggatcttcttcttttttttttttttaatagagaggattcgaaatcactgcttaaactttttttttcactttatcagtgacttaacgctgcgttttggatttactcctgaagtaataggggattcatttaaatttgagaaccccaatagattattcactagaaaatc

SEQ ID NO: 35970 - DNA, 1682 bp, Homo sapiens
tattttcctgtcacagtggcgctgtcattaggactgtgcttccttttatatattctttttgtttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattctttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacggtgagttttagagaaattaacaataatttttttttcctcagagttctgttagtgctaagggataatattttaattggcttcatttgttaaaaatctgttgtggtttaggtttttaatgagagaaattaaaccttttttattgttttagtaatctaggattaatattgattgccagtgatctgaatctgatgtcagtgtgactcatgaggtttccaaactactcagttcagcttgcgtagtatgaatagctttgtttagcagcttcttgtacacctgagctatataaaaatgtatatgtaaatgtctgtaggtactataaattgtcttgtgttggtaattgttgaagagagagaggtctttttggaggaggtagaactattttagttatgaatttatttatttttgtttttaaagggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcaggtttgataatgcttaaaatttttacaaagggatttgctgatgacaattggaaacaaaattttttacggagggagaaaaggttactgtacgcaagtggaacctgtaaagtaatataagaacattttctcctaatttcagagtaaacatttctctagcagagtggggaaagagatgatactgggcaacattatttgaagagttttagctattctttgtaaccactattttaatagaataataataattgttattttcttagagggtgggatggcagggaaaggtactttttttaaaaagcacattaagaatttgcgtcttaggctttttcctgaactttttttgaa

SEQ ID NO: 35971 - DNA, 1076 bp, Homo sapiens
ttaaccaagaagagaagagagatccaaataagctcaattagaagggaaacaggagctattacaatcaatactacagaaataccaaagatcattcaaggctactatgaatacctttacacacacaaactagaaaatctacaggagatggataaattcctggaaatatacaaacttcctagattaaatcaggaaaaaatagaaactctgaacagaacagtaacaagtcgtaagattgagtcagtaataaaaaaaaatttgccaacaaaaaaagttgaggaccagatagatccacagctgaattctattagacattcaaagaagaatttgtaccagtcctattgaaactattccagaagacagagaaagaggttatccttcctaaatcattctgtgaagccagcatcatcctaataccaaaaccagaaaaggacataaaaaaaaaggaaaactgtagaccaatatccccgaggaacatagatgcaaaaatcttccacaaaatactagctaactgaatccaacagcatatcaaaaagataatacatcatgatcaactgggtttcataccagagaagcagggctggcttaacatacataaatcaataaatgtgacacattgcgtaaacaaagttaaaaacaaaaatcatatgatcatttcaatagcagaaaaatcatttgacaaaatccagtatccctttatgataaaaaccctcaacaaaattggcatagaagacatacgtcaaagtaatacaagccatctatgacaaacccacagctaacattatgttgaatggagaaaagttgaaagcattccccctgagacctggaacaagacaaggatgcccactttcaccattctattcaatataattctgaaagttctagccagagcaatcagacaagataaataaataaagggcatccaaattggaaaagaggaagtcaaactattgctgtttgctgatatgattgtatacctagaaaaccctaaagactcatctgaaaggctcctagatatgacaaatgaattcagtaaaatctaaggatacagaatcaatgtacataataaatgagtagca

SEQ ID NO: 35972 - DNA, 1022 bp, Homo sapiens
ccatttttctctagttgctttgtttcttcattcaacttactgagagagaaatctctttggctcagcttagtttagagattgaatttccctgagacaggtacctacaccttgtggaattattattgttccagaacggtagtattccatctggtatggttggcctccaaaggatacaagtaggaatggtcaaacctaaaagaagctggaatccaaactgacactatacagtctcccaaatagggttctggaagagatgaccatgagggcacagttctgatgagttatgattctttgttttggacagctacatttgaagtagttttttttttttttttgtaaatggaaattagataagatgtcatgtataggatattcttaggtctttgaaatgtacttgtccattgtcattgccagactctgactgtggtgggtatggcccactcttttaattttgggaggtaatttatcaaggggtaataccctgatgacagtgtcagagtattagaactaagtggaaccttatgaatattccactagaaggattagaggtggggtcagtggatgagcttcttgtggggtgggggcttggaggttgggggaactggtctgtgtgcccagagtcaaacagaaagtgttgagcgtgtgtctgtttctttttgaaggtgggatgggaaggggagacactgggtctttaatccacatgatgtcacctgtgcccaggcaagattagaaccactctaaaccaaactctttcattttgcagatgataaaactaaggcccagagggatgaagagctgtacttcaagtcatttttctgagtcattggacaactctagattatgatctaagtttctgttactctgtctgttgtttgcataggcacactgattcttatagacagttatctaaaacgtggcattataaattttgttcttgaagactgtgaagtggatggggaaaaagttattccagttatttctcagaatgaagtgcaaagacgatgcctaggccaatgttattt

SEQ ID NO: 35973 - DNA, 1027 bp, Homo sapiens
ttattgtttttagagcccaacatttataagggatgccactgatgataggcagacatcagaaattgaactgtgacagcaacatagcaacatatatcttaaatcccaattataggctctgattttaacccttcttacagaagccttgagcttctctaagtgctaaaaattctcttcaattgctaggcttaaaaaagtgacattctgttcctacttgtcatttcggtttatgtagtaataacaaaaacacggtgataaagcataaacctaatataatttttccaggaagctaggattgtaaggaagaatatagcatttattaccaatattcatagagatattttttaattctgttttaacaccatgtataagaaaatcattgtaccctctacttcctacttaactccaattcatgtttcacttatttctcagcttcagtggatgatgttggatgtgtcaagagcactttatgaaaccatttatcatgattgtgtaagaatagggcaaataactccagagtgctgtagccccaagcagctccgctcgctgacagaagcaaatgtcagattcaagatagacatcaggtttctctgtaatgctgggctatataactttaaaagcttattgttatcaatgtgattgaaaatttaaatgacttaaaataacctttaaataagatgtctttcttagctgtttgtctaagtcattcctgttgattttctttttggatatatgccctctgcttccaaatgtaatataacatccattggttttcctagcacacttaactggccataatattataggattaagatttggggttatgaatgttagtgctttgtatactgaatttctggccaagtcaactgcctcttcgtagcctgtgtccccattctctcctaaacacttgggatgtttttctaaagtttggctccaggatcactgattgggacattatttaaatattttatacttcttaaacaaatcttcaaatgtttaaagaaatggtgaggtaggagagccctctcta

SEQ ID NO: 35974 - DNA, 1030 bp, Homo sapiens
ttcatcatacagctaaaatagacaacctcaaaagcataagtaatagtataatgtaacataagttatgaattttgagtatcattgttttgctataatttaattataagctactgtaatttttattagtatgtttagccaactgccatgtaagttcctgaaaatttaatgagcatcatgagctggtgcaaactggctccagtatatcagtgggttagcccaaatacacacatggaatactctaatacagcagtactccagaacatcactgggttaacacaaatacataacatggaatactccactttaatacatcagtattctaatacatcactgggttaacccaaatacatgtggtaaaacctaggctccaaactggcacattgtcacttctgttcatatcccgttgatcaaaacaagtctcatggcagagctcaaagtaactggatgggcaagcacgctctgactctaggaggaggaactgcagtcacatggcaaagggtgtggctacatggagggtgaagaattggggccagtgattcagtgaattactgctgttacatacttgccgtgtcacatagtagagcaaaatctatattatgttaactgcacttaatcccatctttgaagtgtttacatcatactgctgtgggagtacccatggctataagttctgttagcagatttgattgagaatctttttttttttgaaaaaagtacgtctcatacagtgtaatagctgctattcaggaaagatttaggggtaaaaaatgaagtctgaatttttactctccatgttgtgaggctttctcaggaattatagatgcagattttcatttcctagtggattgctactttatcgtttgatttttttatacttttccccctgaggaccttcgtctgatattatatactcagtctttttctcccatgtgttaactttgtgtgtcttaagtagcattgatatcttcataaaatttgtcaaaattccttttttgatagtttttaattcacttctaatttgggacagcaa

SEQ ID NO: 35975 - DNA, 1050 bp, Homo sapiens
accacatatgtgtcccagaattcattgttcaacaattatatattgaatacttgtgttttaagaaacactgtaccagacattcagcctccattgttaaatgaatcagataaagtccttgccctcatcgtgcttacagattagggaaggaagcagacattaaataaacacatgctgtgataagtgctgtcaaggaattggtgtgctgcgataaagaataggggctacagatgggatggccaggggagactcctctgaggagtaatgtttaataatgtcctgatgctaaagtttagtgtctgggacatagaagtggtacagaataatcctcctttaagcagtcagaagggagagtggtatccatcaaacatccttcaccccagtcgtttttatgaggcaaccaaaagtggtttggttctaaaggactgtggttgctgtggagtaagtagatctctccagtagcttcataaaaggtctgggagcccagaggtagagatggagtggtcaaagagactgggagcttgaagatgaggacagagctacagaaggtactgttttgcaattcttgattcagaggagaaatgagataagggaaatgttcaggtgcacagaggagataggagaaaattaaagatttaactgttgaagtttcttttgaatacaaattaattatcaaataaaaattaagaaatgaagtttagaggaaagaataatttgcttcatcaataaaaccattttaatagaacaaataacttttcattttattggtaggtggctttattcagaattatgttaagattgtttttaagcaggaaacaaacaagattcagctcaaagatgagagaatcacacaaaattaaatatggaaattctaggttgctgggatatgctttctgtgattatgtttggttagtggccaacaagtgaatgcatcatttcttttttttagggaatttatgaatagactgagttctgtcaacttatttacattgaaattgtaggttttaatgaaaatctagggacctaggttcaattatatttgtttcaatatta

SEQ ID NO: 35976 - DNA, 1052 bp, Homo sapiens
tcttgtcagtcattagactagatcggttttcttcttcctacaaattttatatactaaaaaattttgaaaaaagacatttttctttgggaaaaatagggaatgtcagatccctttggagatggtttattaagaattcagtatcttttcagtacctattggttatgatagcttaattttaaattactactttttcaagtgtcttaactcccctagggtttttgccaacgccaaagaaatatctcacattaatgccattttttgatgtgcaaagactaaattgagtaaaaaacttttcagagtagatggattacagtaaataaaacggctacataaaaaatgaatttggtgtcttagtccattcaggttcctataacagaatactatagactgggtgacttataaacaacagaaaatgtattttgcacaattctggaacttgggaagttcaaggttaaggtgccagcagattcatcgtctcgttagggcccatgttctggttcatggatggctgacttcttgctgtgtcttcacttggtggaagggcaggcaagggacctccctgagatagcttttataagggcattaatcctattatgaggggatccgctttcatgacccaatcaccccctccacaaagccctgcctcctaatactatcgcattgggggttaggatttcaatatgaattttggcggaacacagacattcagtctattgttcttagtaatggccatctcttcattctctatggtaatgattgtgagtgtcctaggctaagagtttattaagaatgtacagtgaatgctgcacaattttattttgattctccccagggcaagaattttacatatgtaggtgtaaaaattacaggaacccaaggacatatataaaatgtctctagtgaaagtcatcttttgtttttgtgtagctgcaaaagatgctacaggttacactgcactctcaggtatattatataaagtatgcttcttgcgtttttgcactctctctcacactctcactcatgtgctctgtctctcgctcgcttgctctctc

SEQ ID NO: 35977 - DNA, 1035 bp, Homo sapiens
gagccacagctgtgtgttcctcatccctgggttgggctgccgttcagagaagaggtcacttggtgggtataccagtttgctaagtctgctgtaacaaagtaccaccaacaagggggccttaaaaacagaaatgaattttctcatagttctggaggctggaagttcaagatcaaggtgcgagcagggttggtttcattatgagtccttgcttctcagtttgtggttggctctcttctctctttatcttaacatatccctctttatcttccatgcctggctgtcctaatttcctcttcttataagaacacctgtcatattggattagatacttaacctaaatacctctctaaagaccctatctccaaatacagtgaattctgagttctgggggttaggatgtcaacatgattttgggatatggtggtaggggggagcagaatgtaattcagctaataacagtgggaaaatgttagctcatagactgatggaaaccaagggcaggggtgtgtgctgtggtaatgaacagtgggttctacaccctggaacccaggttgatttcttttggtagtatttgctcaggagtgctttatgaaagacttaccatgaagacagagcctgtattaccattgatgacagtaacagctaccgtttgagtgcctgtttgtaccagactctttacacgtcaactctggtccccacaaggatgaggatgtcgctggtaggtccgttttagagaagactgaaattcaaaataattaaattacttttctgagtgtgcaacaccaacctagattcaaacacagctctgcaaagctagtcctagtttcgctgcactgtgtggcctctgtgtcttgcttgcttttatttgcggaaagagtgcgggacttggagttggaagatgaggttcgtgccttagcttaaccatcgaagtctgactaccttggggcaaatttaactctgtctgaactttggtttcttgactagtcacatgatattggtgataatatctctatcactggaagtataagcattaca

SEQ ID NO: 35978 - DNA, 1026 bp, Homo sapiens
tttggttttccagatggagaaatattgtgttttttaaaactctgcccgcaataggcagtgtctgttttataatatatattataccatgtcaaggtcagactatttagacttttattcttctattacttgataagtggacaaaagagaagggcactttagtagcatcttgaccttgttagatggctgggatttttctcactgatcattttccttctcttttcatctttcttccttagatgtgggtctatagacgcacgttacatcttccgtagcccagggaattccctggacttggccactaaattcttattctacttttgttatataaaataataggctgattttttgggggaaaaatctaggttatggagtcttttttattcacaaataggtatcttccttctgtgagaagcattggttggttggtttgccaggaatgtaattctttctcttgtggacccgccgtctgggttgtcagtggtcttaactttcccttattgtgtgagaacggccaagctctggcattgctcccaggaggtgcttccccaaaagggatttattctatgagtcatttgaatctaataattaaaacaacatgtagcttttaaaaaaatttgttctttatgtatcatatgtagagagaacagtatgcacattatgtgtgtaaaatttgatgaattttctcaaagtgaatatgcccgtgtaaccagcacccatattaagaaagcagttattccagaagcatcctcatctccttcaagtgagtgcctcttccctgagatgaacactaacctctaacactgtggattagtttcgctactctttgaactctatataaatgtcatcatacgggatgtcccattgtgtcttgcttcatctaccaaatgctgcgtccatgaggatcatccttgttgtgtgtggcaatagtttattctttctcatttctgcatggttatgccattctattattatttacctattgtgattgtgacaaattatgacaaacttagtggcttaaggcagtac

SEQ ID NO: 35979 - DNA, 1763 bp, Homo sapiens
caggaggtaagcgacgagcaaatgagcattatcacctgagctctgcctcctgtcagatcagtggcattagattatcataggagtgtgaaccctattatgaactgcgcatacgagggatctaggttgtgtgctccttatgagaatctaatcctgcccctacccccagtccgtggaaaaattgtcttccatgaaactggtccctggtgccaaaaaggttggggactgttgaaatagatcatttggcagaggggtggaggctgatttaaggggacccatacaatatagtggagaagggtttggagactgttccaatggttctggtgagagatagtgaccttagttaggaagtggtgtgcacagggaggggaacatagtggccaggatagatttaggaagaaaagtcagcagaacttggtggttgcatgtaagggatgaagatgaagaagagtcaagtatgttttaaacttatagtgaaaaatacatttatatcacaacctggtacacatgctaccaacacacacataactaactggtcataaaatatgttgctgaaacaaactttcatgaaacaatattttaccttatggtagcatactctgatattttctcttccattctatttcaatttctgcaaaatgctattctatttcagtttctgcaaaatgactctgcattgattccactaatgggtcaagacccacggtctgaaagtcacctgcacaggcttctccaggttatcctgcaatggacaggatgtttcttcctcattagatttctttgtggtccagtgtatccagacacctttcactcagtggaggggagagaggaggagggcagtaaaaagtatagtttccaagttcagtgcactatagaaacatttgaggcaaaattgtgctgagcacttcttgagccaactgatggccacatggtgagacagttaaagagctgcacacaaggatggttatttgtgttgcagatgtcatttatgtggcttttttggagggaggggagagggctatcgttttttttcctactccctttgctgccagaatgcctgttctcattagaatacagagttggtagagttttgggtgccggaagagcctcagaggtcaggagtccacaggtccctggtccaaaactagtgactacttggtgttgcctgtggtcatgggtcactgtcaactccttgtgactcacttggatcactctttataatgttgcagtggaaagccccctgcagctgtggtgtttgcttctgggactctgggttgggttcatgttgaaaaccattgttggttttctctgatcaaataactcaggtttttaagctctaaaatgggggataataccatatactgggtttgattgtttcatgaggattaaatgagacaacatgcagaaagtatagtgtctgaggcacaggaaacatttaaaataaatggctactgttattttcttcctgtaactaaaatattatggacattggcctactttgctcattttaatttgcactaggaaagatatggagcctttctcactttcatatatagaatgagctaaaattaaagttcttctgttggtgtgtgctgaaatttttaacagtatagaaatttccatggaaaataaaaatgcatttgaattcaggaagaaggatactaaaatacatccaagttgagatggttccgtaggtagcttcttaaggacctcagttttgaatttgcttagggtgaacaaagctgttcaacagtgctggctttatg

SEQ ID NO: 35980 - DNA, 1031 bp, Homo sapiens
tctctttagtcccctttaatctgggatgtttccacagtctttgtcttttatgacatttgacatttttgaataattttttaatggcttatttttaagggaatatttctcatatttgtttgctctctcctcatggcgagattcaggtttttgcattccaggcaagaatacgacactggtgatgtcaagtcctcttaaggaatgaggtctggaggcccatcacatccatctgcccctctctgtgatgttaattgtgatcatccagtcaaagtgttgcctgatttctccactgtagttaccactttctctcccacaatctatgagcaacctgggaggtacttttaagcaatgcaaatacgcttttcatcaaaattttccccaagaatccattgatgattcttgcctggatcactcttttctatgtttgaaaatggtgatttttccaacttcagcactctccataaatatgtgtgtatttgttagcagcatggattcccacatttctatttttaccccggtgtagacctttatgtttaacatgcttattagaattttttttttttttttttttttttttttttgctggtgggcccttctttgttttggcctttggctcagcttagaagtctgtacaagttacttttgcatgggtggtagggttgtatgatatggaaatagattttaaacaccttttattgatgaagatgcaaatgatatataaatcaatgtattgtgtcttataattttatgcattggtaataaattatgttggatatttggaaataatgcagtaatggatgcagattttgttcaggtctagcctctagtcctgcttttgccattagatagctgtataaacttggacaagtccgtttctcaaattctctcatctcatttgtacttgtaagatgaaaagaggcattaaacagtctataaagtccctttcttctctggaatttcctgattcttctttcagaataattttgaatgtgtgaaataattatctttaaagaaatttctttcaggatagttta

SEQ ID NO: 35981 - DNA, 1021 bp, Homo sapiens
tcatttaaataagccctcttatcgcaattaatattattgtttggtttatgatccttaaaaatatattccctttcagcatttcttggggttctaatttagctttcttatacatgttagatgatttgcaatttagattttaatttgatttctattctttcaaatatcatttttcttgtatttcatttttatttaaagcatgattctctctgtattcatggaagctgggcataaacaaactgctagaaaaatcaagctattaagtgagctgagaacataaaacattttaataggaatttcatataactaaactaagtatttgagagcccaaccagagaattatggctctttgaaaacaaactttatgggacttagtgttcttagtctaccctctattacagttcttaaaaaaactatagcatttctatcgttgactttaaatctttgtcacttcttgcatatgtaaagggttaaatgtgtctctgcttaatgacttgggggccatatctgtttgaagactgagttttggtctctgtaggtctttagagtttagagtctatttttttctattgagagtcttagtgtgagtgtctctcttctaatttgggagtgtggaggattgttttatttttccagttgtgatcctcataaatcaccccaacactttcagcgtcatgaccttaattctctaggacatgcaatatacctttcccaattaagtggactcatggtctggctcaagagtgatattctcagaatggaagagcacttcttcctgacccctcttagaatgaccactgtgtaattctgcttgcctacttttctgctaagatttttattcagtggtttggaggctgctatcatccttagcatataggctctttgctttgctttattaactgttcttcaaaactcagcagatgatgaaaaagactggtatgtttgagggtgagaaacttaggactgaattctagtactgacgtttcttggctctgtaattttggacatctgtcccttaacctcg

SEQ ID NO: 35982 - DNA, 1038 bp, Homo sapiens
ctaagtacagtcatgcgtcacttaacaaggacatgttctgagaaatgtgttgctaggtgatttcattgttgtgtgaacatcattgagtgtacttacacaaacctagatggtatagcctattgctcctagtctacaaacctgtacagcatgttattgtactgaatacgtagtcatttgcaacacaatggcaagtatttgtgtatctaaacatagaaaacatacctgaaaaatacaatataaaagatattttatatctgtatagggcacatatgaatggagcttgcaggattggaagttgctgtgggtgagtcaatgagtgagtggtgagtgaatgtgaaggcctcctacattacagtgcactactgtagactttacaaataatgtacacttaggctacactgaatttataaacaatatttttctttattcagtgataaattaaccttagcttactgtaacctttttactttatagactttttaattttaaaaacttttaaattctttcgcaatatcacttagcttaaaacatgcattatgtggctgtagcaaaatattgttttctttaagcttttttctatttagaaatgtattttttaactttttaaccttttttgttaaaaactaagacacacacacacacacacacacacacacacacacacacacacacacacacacaggcctagtcctacacagagtcaggatcatcaaggtgtcattaggcaaaaggatgtcttcagcgctattacgatcttatgggaccaccatcatatatgtgtcccatcattggctgaaatgtcagtatgtagcacatgactgcatgtgaaaaatatctggccgtgtaaatcagaggggaacccatatccttgtaccaaacatcaccatggacaatattacaaaatctcaatatacgcttttttgaaatgtgttcaaccaaacgttttctttcccccttgtttttctcagttggtatttggaattgtttttgtttctgtaaaccatttaattgcaataattcttaaaatttaaatttgac

SEQ ID NO: 35983 - DNA, 1027 bp, Homo sapiens
catatgttgtggttaagagcactgaagcacactactggaagcactgaagtctattaaatttctgtttgaatgttggcccaccacttattggctttattttcttgggcatgctgttttcttctaagctttattttgccatcaataagatatattacttacctcccaggaatgtggtaaaactaaataagatgtgtgcatgtaaattacttaaagcagtgtgaagcagaaagtaaaaacaccacaagttcctaataagttgtggctgctgttactgttgtatttgtagacagctgagcctcctcttctccttcccttgcatcatatggctttcccaaattctacatttgtgactctggagcaggttaaaacttttctgaggcttagattcattttctgtaatatgaagatactaaaaattacctgacaggattattacaatgactctaccaatggtaggcaaatatctaactgtcttagtcagttctggctgctctaacaaaatggcatagactgtgtggtgtgaacagcagacatttgttgcccacagttctggagactcagaagtctaaaatcaaggtgccagcagatttggtttctggggagggctctcttcctggtttgcagacagttgccttcttgctatatggtgagaagaaatctcatgtcttttctgtttttaataagggcattaatcccatcatgagggccccaccttcataaccgaatttaatcctaattacctcccaaaggccccatctctaaatgttaataccatcactttgtggattagggcatcaacatatgaactttggggagggggatacacacattcataccacagggctagctctggcgaggcaaatgggtacttaataaaaatagctttattatgttcacaattcatatattcctgcattctcttatttactcatttctttaagctgagttttccatgcctagtttttgagtttgtattatgagccatacgtaaggccttgtacttttgacttaattcttggtttctagc

SEQ ID NO: 35984 - DNA, 1032 bp, Homo sapiens
gggattcagagatgtggcaaattgttctctgactttaaaagctatcattcaattattgggaaatggcattcaggaccgaaggagcaaaaagctcatcttaagatgtgttttaaaaacctgtcataaaagagttaggtggcccctggtttagttgcttttccatcatcaggaaaccctttaatctttcagtgaatgacatatgatagggttttaaaaaccaagccaccttgctgttccattttctccttgttgccatctcatcttcctgactcatcagatttggtgctgatctgcttgcaaagtaggaaaggcagagggcctggcacctgtgtattcagttgaaatagccaatttcagaagagtttgtacattttgacctttctgaacttctttggatccttttgaagagggaagtaattctaacctggaggcattcccagtaattattttggagaataaactgatatgtgtatccctattattgtggtctatcttttgagtaaaaaaatagaatttataatattttaatatgactacttggtctttgtagaaaataatttttttttttttttgagatggagtctggctctgtcacccaggctggagtgcagtggcgcgatctcggctcgctgcaagctccgcctcccaggttcacgccgttctcctgcctcagcctcctgagtagctgggactataggcgtccgccaccgcgtccaccaccgcgcccggctaattttttgtatttttagtagagatggggtttcaccatggttttgatctcctgacctcgtgatccgcctacctctgccccccaaagtggtgggattacaggtgtgagccaccgcactgggcctgtagaaaataatttaaacaatatttaaattgatcatgtaggtggtcattttagaaaaactagaaaatacagataagaaaaaatgcatttaaaattaccccatattttatcacttagggaaaagatagtttacaaagcagaaaactgagcttttacttctatcttttgatgcattaaat

SEQ ID NO: 35985 - DNA, 1031 bp, Homo sapiens
tctaaccatgtaggatagttggcacaaatgtttttctatatacttttagactttttttctaaattcttatttgataattattgatttttggcatgtgttttctttccagctgggaagtactttctgcacagaccagttatgtattagttgagtgctctgcttgcccacaaaatttgctgcatcttgaaacagaaaaagccaggagagctaagtgttagacagtttttagtggtcatgtgtagttgtttaaggtactgaggcatttcctcagtttcagtaattcattttatgaaatttcaaaaggtaacatttttccttcaactgttggtgatatttgtttaggttcaggaaagcttttacattttatgtgcaggaaatcactctaaacaacacatttaataggttccagtagtcaacagagatgctatattcatttagggaatataacagattttctttgttttgccttaacacttggggctttataagatttccccagaaaccaggactgtagccattcttagccaagttatgatttatagagtgatttattgatcatggaagatttcccagagttcctcaggatatatcattaatgtaactttgtatatgctgtcctgctggagtggaggctccctaggggtaagaagtttggttccctgcactgtgcctagcatgtaacaggtgttccataaatatttgtagaatattgttttgtgtgatttttaaatcatgtgtctcccttattgcctagcactctcattgactaaccctataattgatcaagtaattattgaattcctacattaaattgctccaacttttaataagaacatgctatgttcctaatataatggtgaatgttgagtcctccatttcatgagctttcagcctagtacaattttttttttttgcatttaagtcttttatgagaacagatgagtgatggattcactactgattaatgtttgaccagtcttctatataaaggaatacaatttaattctcatccatttgggctttttgtcaag

SEQ ID NO: 35986 - DNA, 1132 bp, Homo sapiens
gaaaaacacagggataagacaaattacttgttggggagaggacaattgaagggttcatttgccagtttgcaaagtcagaaagaagtacgagttgctctttgctgctgtttctttcacgctcaatccgggctttcctccacagctcattaaggcaaaatctagtttatcaaaatccaaacagttccactttcaataatggcaaataaataccatctctactacattacctgttaaattggcctttgtgggtaaacctagaaacctcccagctgtttataacattgtttctctgagaatgtggtctggtttctcaaacttatagatgcaccttcagagcacagctttgtatgttgtggagattagctggggaaataggggttggtcaggactaggggtcataccagccttaattctttttccatgttgagtgcttctggaaagatgcagagggacactctgggcaagagtgctcttctgtgctagaaggccattgcccgctcagtagtggtgtctccttggtgaatgatgattcccctgaagtgaaggacttcatgctcttgcccagaattaaaactggctgggtgactgggagaagcatcagctaacccaaagtctgtgtgtattagctgtgttctccagagagaatcaatagaggatggatggatggataagaggggattgattagggaaatgtgtttacatgattatggagcttgagaagtcctacaacaagctgtctacaagctagaaaccctggaatgacagtagcatggttcagcacaatacaagtctgaaagcctcagatgcagggaaactaatggtgtaattatcagtctgaggcagaaggcctgagaaccttgggggccattagggtaagtcctggattccaaagggtggagagtctggagttctgatgttcaagggcaggagaagacacatgtcccacctctaggaaatggagaggaggaaatcacctttcctcagtcttttttgttctgtctgggccaccatctgattgggtagtgcctgccgacattgagagaaaatcttcttcacttagttcatggactcatatgtcaatcagtctcctctggacacaccctcaaagacacactcagaaataatgctttac

SEQ ID NO: 35987 - DNA, 1046 bp, Homo sapiens
gaggaagagtaacaccctcttgtagaaaataacatcctttagagcatgtgttctcagtaggcacaagattggttcttccagtgtgaaacaaatattaaatggtacagtgatttgtggaccttcaaaaacccacaacacataaacagatacaactggcaggttggggaaattagtaacaaaaagtctattaaagttctttatagagataatagtgaaaaataaaggttggggaacactgatttagagccttttcagttttttagtataatacctgataattaaaagttatagatattctaaaagacaaaaacatgtgaccaaaagacagtagacagacaatataatgtgcatttgcaattttgctccagagattggagttagaacatatggacttaaaaatacataattaatgttaacttatattaatcagttaacaaaataggtaaaagaaaaacagatggaaatttggaaaatttcatcagagaattgaaatttgtgaagagagaaacaaatagaaaactgaaaagcatagtatctgaaattaagaactctctggatgggtttaaagttaattaaacacagtggaagacaggattagtaaactggaaaacaggttaatagaaaataaactgaaccagagaggaaataatatatacacgtattccacttgcaaactgtttgcaaagtaccatctttttccatatccttgccaaaaatatgtattttaacaatgtttatattttgccaatttctgtgtaaagtgatatctcattgttaatttaatttgaatttcactaacaacgttttaccttttcattgtattttgctagttagttattcttttctgagaaataccaattcatattttgccattatgtatctggggtcatttgtatcaatttgtaattgttttctgaggtaatcttttgtcatttctgttacagataaattttctagatctatatataaaacatttgtgatgaatatactgttttattttacaacaaatctggatttatttgtatacaagatacctcagagatatt

SEQ ID NO: 35988 - DNA, 1069 bp, Homo sapiens
gctgggggcgcggccaccaagctgtccagggacaaggccctgccgcctcctcccagccggaccctggaagggtccacaaaggtgtcaggttcaagtcctccaataggcccattttttaaaagtgcttttaagtttccgcttttttcaggaggggagggcaagagcagctttttctattcaaattcttttccttgtatgtagataccaaaaggaaactcggcactgggcatgttcggatgtgaatggttttgctgataagcaacagcctccggaaccaaagcctcaaaatagtcgtctcccccgcccctcgcagaagcggcgagtggtatctgccaaacagatgacaaagtacctccgactgaatcccacagacagcgctttgagcagaacgcacggctcaactcatgtaattactgtttatagctggccgagcctgactaggagagggcagacccgagaggaaatcagtttcccggacctttgagaggaggctgtgtgttaattaaaggctaggacgggacgggtacttctcagacatgctccaagttgttcttgagatcacagttcccatcacattttctctggagggagtgagtagataattgggattttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaaggtaaaaacgcggggatctctgcctggagagggaatgctttcacttcccaggggcccacaggcggagctgcctgagcccctcaggagctggggttttgtgtattgggtgacactttgaaaagtttatgccccgctaggggagggggtactgtttcaggtatttcttcgtccttgtggtttcctgggtaaccctgataaatgtgcttctcataggttttctccttttgaaatgtggataataagacatttccttgtgagaggtgggggaga

SEQ ID NO: 35989 - DNA, 1063 bp, Homo sapiens
tgttggggtcaaggaatcatttgaattcctgtgtggagatggcccatagaagaggaagcttggaataggactctatctgaataatttgggaaagtccttcttccgttggttgaaatggaaatagctggtgtctcacacagatggaaactggaggccctggaccccagcctcaccctccatacacacccatctctagtgtgagtaagcatgttatgttaatctgagctgtcttcactacctgtaactagtcatttgggagtgacatcatggtaactgagtaatccttttgaaacttacatagtagagccaagatattaaaatggtcctggggctacctagatgaaagtagatacaaagtgtgcataaaattgtctactaaaagtagagtcagtctctatcagtaggaacttggtttttgtgataatgtggtacattttgtaactagatagatctcaaaagttcatacattgtagttctggtactgtccttatttccaggcagatagaaaaaaagaaaagaaaaaaattccactaggaacttggttgtaaattctgaaaatgttgatcttaaaccttattaatacaataaaaggacctgtgggaattttagctacattaatgtctattggacatgcctatttgagaaggtaattatactaatatcacaactgacatatcatggttttattttaaagaaaaaagaccatagcagagaatttaggctttgatcagtacttgaaggtaaaatagattggtaagaagaataggcagtcattactgtatatctcttatctgaagcaccccattgcttactttattatagaatcctgggaatttttacattctgctttgtggtcctacatttatcagtgactgattttgtcagagtttgggggctcttagcaaactgtaattgcaggcagtagtacaagcaaaatgcagatcttgacatctggtaggccaaccaccatttttattctgaagttcttgaataagcttttagctgttcaaagtaagtaccagcaccttgtgcccctggaaagtttctaacctgacatggaagt

SEQ ID NO: 35990 - DNA, 1050 bp, Homo sapiens
attaatatcagttcctggtgggtggagattatcagtctttaaattgctactctttgctgctttcctctgcatagatacagagaatctgtcagctccctggctagtccagcagaaagccctgggcatttcccagagttgatggcagaggagggtcgtctcttgtcgcctttttagcctgatttattgcccttgaattttttaataaggacatattttaagttctgtctagggactgagggcttggatcattcatgcagtgaactttgaataagttggaaagattggctgggccctgttatcataatggatggtgactatttgacatttacagtggtatgctccatttgcactaaaataaatgaatttgtatttagacatgatttgcaaaatttttccctatcacacttaaagtagaggttatttgcattcaaagttaaacactgaaaaactgcgtacagacttagtgaagatttgtaaaatacatgttaattggcataacaccattaaacctgattgtgctgatctgttagctggagaaagagcaggaatcatcttgttcccatatccctacaatctaaattgttagagtttctaaagatgggggacttctctgaagtgaatattcctgtcaggcctgttgaccttactgcctagtgacctattcataggtcaggatggcagttctccctgctgggtcagtttttattccaccttctttcgtgagagaactaatttgtacagctcttacaggtggagaactagatcactggtgtcctttactgcctctgatatatgtggaaatgaatcagtggaaaattcagttactcatcgtgacctacttctgtcacttgcgttgaaggggtgcttatttgtcaaaagcaatctgccccccttccaaaaactcttgctccatggctgctttaactcatttaatctatagattctttcagaatgtttgcagttgcctaaatctttctgtgaattatcctgctgtacctgtaatccattttagattaagcctctggaggccaatgaaaaaatctgactttg

SEQ ID NO: 35991 - DNA, 1032 bp, Homo sapiens
gtaagtatgtttaagagctttgatttaagaaagtttctttgtcacatggataaggatccagaattgatttcatgaagtgagtttggagttggatatacacatctgtatctatcagtagatgtttagctctttacattgtgttcacctataatctgttctagcagatagctcaaagccctgtgcataacaagaacttaataattattaaagtagaaaaaaactattttcagtttgctgtataacagggatgagattagacactgagaactcaaagtacactttttgtgtatctagatatataactggagtttatcccttaccatcacttacagttataaattatttagagaaagagagaaatggaatattgtctgcctattgttatactccatttagttttacttatcgggacaggagacagaatgattaaaatgatcattatccaaactttaatatctagcctgtagaattttccttctctacaaatattttacttagcattgttgactggtttgaatgtctgaaatagattagggccatgaaattcattatgcactaaataatatgagatttaaaaatgttatttgctctaatgtacaataagaaaattgtaacgggattcttaaatgtttaggtagtctaaatgttacatatgagaactgcaattaaatgtaacatcgttacatataattgcataatcgtggactatgagcacatttaatatatttgaaattattttatgtggagcttccataagtaaaaacgactaaagcttgcccaggtgttcaagttttgcccttaattctctctcacactgatgaaccatattctccctcagtcttctccatctcaattaatgccaccatatacccatttgcttctaaaatcttgaagtcttctttgtgttcttttcccctttattccactcagttccatttttcagcaaatcccgttggctccgctgccaaaacataacagctcttcaatcaccctatctaaatcaccatctctcttaccttgtctgtgctggta

SEQ ID NO: 35992 - DNA, 1029 bp, Homo sapiens
atctgggattacagacgtgtgtcaccatgctcagctaatttttgtatttttagtagagataaggtttcaccatgttggccaggctggtcttgaactcctaacctcaggtgatctgtctgcctcggcctcccaaagtgctgggattacaggcgtgagccaccgcacctggccttgaggctagtttttaatctatttgttaacatttgaaatatgacttctccaggtaatttaataaacaaattgcaccgcgctgagtggatcacctgaggtcaggagttcgagagcagcctggccaacatggtgaaaccttatctctactaaaaatacaaaaattagctgggcatggtggcacacacctgtagtcccagctacttgggaggctgaggcaggagaatcgctcgaacccaggaggcagaggttgcagtgagccgagatggcgccattgcactacagtctgagcgacagaacaagactccatctcaagaaataaaaaataaatgattacagactctgattgttctacatttgtttccctttcttgtcagcgtctaaactaacataccttagacttgtcctttgaaggttaggaattgggagttctggagctgggctgccaggttgtcaccctaagccagcactgcatgctgtgtgaaccttgaccatccaaattgacgcacctctttgtgcctcagttacttccataaaaatgagataataatagtatctatttatagaattgttttgaggattctatgtttatctttgtaattgcttaacatagtgtttaacagatgttagctgctgttgctgttttatttaaatactactaatttttgcccctttccttgagatcccttccaactagatgcattttagttcacctccaagtccataaatctaagatgctagtcatattggatattgacatcatttgaatgagacgaagaaaggacatagtttgtgctaagctcctttttattctggaatttcccctataggtaaactgagaaagttattggcaatgtcgtt

SEQ ID NO: 35993 - DNA, 1081 bp, Homo sapiens
agaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaacttttt

SEQ ID NO: 35994 - DNA, 1082 bp, Homo sapiens
caatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaattt

SEQ ID NO: 35995 - DNA, 1051 bp, Homo sapiens
ggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaa

SEQ ID NO: 35996 - DNA, 1061 bp, Homo sapiens
ttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttt

SEQ ID NO: 35997 - DNA, 1028 bp, Homo sapiens
cccataatcccaacacttttggaggccaaggtgagaagatcgcttgagcccaggagtttgaggacagcctgggcaacatagaccctgtctctaccaaagaaaaaaatttgtttttaatttaaataaatgcgagattactattgtatgtttcctttttattatacttgttttactttggaaaattttactgtgtttaagacataataagaccatatttggaatctgctcattaataaattataattgttggcatataaactgttcaaatttacctagcaatataaagatttcaggtacagtgtatacttgccctagtaagcagtactttcaaactcttcaataaacaaaacaaaactttgcatcatttatttatacataaaccataaaccaagtacataccattcttaattgaaataagtccaaattcctctacttaccaattctgcttgatatttgaaagttaaaatgtttcttctaaaatgttctaaaattcacatttttaaaattttggacttactgaaacttagtaaggttttactgtgaatactttcaaaactgtaaacagaaaaacatatatagctatataataacttttaaataacaagtctatttttaaattactaatttaaaggttttttttctcccttttgctagccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgagtccttgcaaaatattatcctacttttcaactgtgttctaaatcaaccctctgtgtttatttgtattaagttttgggcttctggtatgatatgatttttaaaaagcaatctgtgactaaaagaaaggtctgaagctatcactatagaaaatattcttacctgaataca

SEQ ID NO: 35998 - DNA, 1034 bp, Homo sapiens
aaactaccaaaacctcttgaaaaggtacctatgctggtgccagtgccagtgtctgagccagtgccagagccagaacctgagccagaacctgagcctgttaaagaagaaaaactttcgcctgagcctattttggtaaacttattcttaccattgtagagtctgttgattatttcttgtcccttatttcactgatacatgcaagagcattcaaatgaatagtaatattaataccatttattgagtgcttagcatgaggcaagctctgcctaacattttacatgcattaactcacataatctttacacgtactctctgaggtattgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaaggctttgttatccaactacaagccatctctgcagaatttattggcgtaaacatagaatgttctcttgaatttttttactgctgcatatggctactaaataataagcctgtaacattggaatatgcaaaggagtaaaacaggaagaaggcaacttttcagggagtggttaagaagatgaattaacacttagcctcaaaaataataactttttattaaatataaggtatgtaaatgtattctatgatagacctacctgtgaaggaaaggtaggtcatgtagaggaggctgctttgatgaaattgcaatgaactgtattctgaagctctgtttttttaaacttagttaaaaccagttgggaaaattatctgaaaaaaacttgttgagacagagtctggctctgttgcccaggctggagtgcagtggcgtgatcttggctcactgcaacctctgcctcccaggttcaagcaattttcctgcctcagcctccctagtagctgggattacagacgcacgccaccacgcccagctaattttcata

SEQ ID NO: 35999 - DNA, 1002 bp, Homo sapiens
agagtcttgctctgtcacccaggctggagcacaatggcacgatcttggctcactgcaacctctacctcctgggttcaagcaattctcttgcctcagcctcctgagtagctgggattacaggtgccagccaccacacccagctaatttttttattatttttttatttttttatttttagtagagatggagtttcacgatgttggccaggctggtctcgaactcctgacctcgtgatctgcctgcctcggccttccaaagtgctgggattacaagcgtgagccaccatgcccgaccttatttctttactttgtctactaaattcagagtcctttgaggatgccatgaagtcaatgccttgtagagtttgacttcaagaaggtgctcaataaatgtttgaacaatgggataaagggagcttgaaggaaatggttaatggcgatgaagttagttaatccttagtagtcaggatagaatttgtgttgagtagtgagaagcagtttatattatgaaataaagactaaagactgaattgtcatttatttggactaacttcacatgttgctgataaaaattaattacttctcagtttcctttgcagcaaagtctagaatgtgaatttatttgcttccaactttaaactgactcactctaagttggcatttcactgtttttttttttgcccaggctggagtagaatggcgcaatcatagctcactgtatcctcaaactcctgggctcaagtgatcctcctgcctgggcctcctgagtagttaggactgtaggcagctgccttcatgcccagctaattttttgtagagatgagttattgctatattgcccaggctagtctggaactcatggtctcaaaggatcctcccacctcagccacccaaagtactgggattactggcttgagctgttatgcccaacctcattctttttaattgaggaattaaatgatcacttttttcttttttaacagagacagggttttgctatgtt

SEQ ID NO: 36000 - DNA, 1054 bp, Homo sapiens
caaggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggtaagtattatcattcgttttttttctaaactgcatctaactttatgaaagtattttccatcaatagtttataataatacaagcaggacgtgggcagcatttcttaagagatcgcactttcaaattctccttcatggaatacctataataaaaagtcactaaataaaccaatggagtctatttgtcactttgtgcaggaaagttcgaagttagggtggatactactatcgctttctaaaggaaaatccacagattgaatttgatatgtatatatgcgatctccaccacgtttggaatggttaagtcccaaactctgcattttaggtgataacgggtcaggaagtggatgaggatgtagaatatactcaaagactacagccacccctaacacaaggcattttgtgttagtgtggctgatgtgcatccagttgttggtgaaattatttgtgcccaaaaggagtacactcaaaagctacttttttggttcacttcaatttgatcccacttttgaaactttctattaatggcatttgccctttccctacaaatacaagcactctttatggcagcataaacatagtaacataaattatactgttaccacatttacgtagtttttttgttgttgttgttttgtttttttgagatggagtctcacactgtcgcccaggctagagggcagtggtgcggtctcagctcactgcagtctctgtctcctgggttcaagcaattctcctgcctcggcctcccaagtagttggggttgcaggcacacaccaccatgcctggctaattttttgtatttttatttggttttggtttttttgagacagggtcttgctctgttgcccaggctggagtgcagtgg

SEQ ID NO: 36001 - DNA, 1036 bp, Homo sapiens
gttttgtttttttgagacagggcctcactctgttgctcaggctggagtgcagtggcgtgatcctagctcactaccaccttcacctcccaggttcaagtgatccacctcagcctcccaggtagctgggactacaggtgcccaccaccgtgcctggctaatttttgtattttttgtagagatggggttttgccatgttgcccaggctggtcgcgaactgctgagctcaaagggatccacctgcgttggccttccaaagtgctgagattacaggtgtgaaccaccacaccctgccaaattaagggtttatatagcagggaagatatgtacccatgtatgggaagacaggaattagggaggggtaaggaagaggagttagtcaataggaagcaggttaggcaatcatgatgggtgaggggtctgatgtcttattgtctagagggtgtgatcttataagtttcagttccttgatactatctgggagtcctgatggtttcctgagaagggaactcaggtaagacagttgtaactttctcaagctttaagactgggagggtcagtttctatgtttattcaaaagaaatcataaacatcagttctgtgggacaattgggccagtttcactgttgacaccaaaaaacagaagggtcaggccggtgcggtggctcacgcctgtaatcccagcactttgggaggccgaggcaggcggatcgtctgagatcagaagttcaagaccagcctggccaacatggtaaaaccctatctctactaaaaatgcaaaaattagccgggcgtggtggcaggtacctgtaatcccagctactcgggaggctgaggcaggaaaatcgcttgaacccaggaggcgaaggttgcagtgagctgagattgtgccactacactccagcctgggcaacagagtgagactctgtctcaaaaaaaaaaaaaaaaaaaaacagaaaggtcaaataggctgaggcagtgttttattagcacattttaaagtttataactgttaaaaaaaattaattgggatgcaact

SEQ ID NO: 36002 - DNA, 1892 bp, Homo sapiens
gggagtaaagtcaattgggcagaggatcctgcccttaaggaaattgttctgcagcttgagaagaatgttgacatgatgtaataagaattcatttctgacatattttacatttctggcaatctcaactcttatttggaatacttctgtgcatttgtctgtccaccgtaattttagaaaagcatatccataacgtttacagttgtagtacagttgtggttagttatttgtagtgggattgaaagtaatttttttctttttatatttctatatttagtttgtttttttgttgttgttgttttttgagatggagtctcgctttgttgcccagactggagggcagtggcgcgatctcggctcactgcaacctctgcctcccgggttcaagcagttctgcctcagcctcccaagtagctgtgactaaaggtgcacgccgccatgcccagctaattttttgtattttagtagagacggggtttcaccgtgttgcccaggctgctctcagaactcctgagctcaggcagtccaccgcctcggcctaccgaagtgctaggattacagacgtaagccaccgagcctggtctagtttgcattttttttctatcagttttataagttaagaaataaaaggaattaatgttactctgtcttatttttttttaattcgtgccctttacaaacagtagtactcttagtaattataaaatagaacttgtcactttttatagcatcgcaatccgtttttgaaaaactctaatttgaacactttattaatttggagctgttgaacatttttacagctaatgtagtattttcaacatttttttttccccttgagatagaggctcgctctgttacccaggctggcatgcactagtgctatttcagctcactgcaacctccacctcctgggttcaagcaatcctcatgcctaagccccctgagtagctgagattacaggtgtggcccaccatgcccagctaattttttgtattttcagttgagacggtggtttcaccatgttggtcaggcaggtctcgagctcctgacctcaaattatctgaccacctcagcctcccagactgctaagattacaggcatgagccactgcacccggcctcaacattctttttagaaggacttgaaacttgaaatgatgctagcatttgttttcttttctttttctttttttttttttttttttttgagacggagtctggctcttttgcccaggttagagggcagtatggcacgatctcagctcactgcaacctccacctcctgggttcaagcaattatcctgcctcagcctccctagtagctgggacctgtacaggcacgtgccaccatgcctggctaattttgtgtttttgatagagatgggattttgccacgttgcccaggctggtcctcaaactcttgagctcaagcagtccacccaccttggcctcccaaagtgctggaattacaggtgtgagccacctcacctggccaagttccttcttaaggatcaattctgagagagaaattgtattagcttttcttaaaatcatgctgaataataaccccaagtctcagtggcttataacagacatttctgttttgggtctgtccttcagctgataattctaggactcaggctgagggaacaaccacaatctgaaatgttctcatggcacagggcaggagcttatgacgtcaagtccaattataccagtatgattaaagtttctgtttgaaagaggctgacattgacaaaacccaacgtcattgaggcaggaaagtatacttctcccattgcaggggagtggtggatttcagagttggagaaagtgggtattttactgaaagaatataatttattaaactcagctatcttggtcataaatatgacc

SEQ ID NO: 36003 - DNA, 1090 bp, Homo sapiens
atttgcttctgtgcccacataaaatgcataatatgtactacaaatatataaatatattgcagataaacccacctcagtcttattcgttacatagcaatttatagattagttgaaaatagtactttgttcattagattcttagcattgtatattcagaagatttcatattgacaggtccatttaaggtcctctgtaccactatctggaattttacggacaaaaatgttaatacttttcaaacatctgttccaaaaacagtattccaaaaatatgtattccaggccaggcatggtggctcacgcctgtaatcccagcactttgggaggccgttcgaaaccagcctggccaacatggtgaaaccctgtctctactaaaaatataaaaattagccgggtgtggtggcgggcacctgtaatcccagctacttgggaggcggaggcaggagaatcacttgaacccttgaggcggaggttgcagtgagccatgattgcggcactgtactccagtctgagtgacacagcaagactctgtctaaaaaaaaaaaaaaaaaagtattcctatgggtataggaaaaagactaaaataaagtgctatcaaatgttttaatttgggccgggcatggtggcccatgcctgtaatcccagcactttgggaagccgaagcaggtggatcatttgaggtcaggagttcaagaccagcctgggtaaaatggggaaactccatatctactaaaaatacaaaaattagcggggtgtggtggcgcaggcctgtaatcctggctactcaggaggctgaggcaggagaattgcttgaacctgggaggcggaggttgcagtgaacagagattacgccactacattccagcctgggtgacagaggagactccatctcaaaaaaaaaaaaagtcttttatttgttttacgtgggtcttgggattatagtgttttcttctttgtgctcttctgtgttcttccaaatgttttacacagaatttgtgttacttttgtagtcaaaaaaagtattctttaattttctaattttcaaaatgattgttttttcttccctgttaggtattaatatagtagggaaa

SEQ ID NO: 36004 - DNA, 1080 bp, Homo sapiens
aaattagctgggcgtagtggcaggtgcctgtaatcccagctactcgggaggctgaggcaggagaatcacttgaacctaggaggcgaaggttgcagtgagccgagatcgcaccactgcactccagcctgggtgacagaattgagactccatctcaaaaataaaaaaaaataaatataaataaaaattagccaggcctggtgatgtgccgtataatcccagctacttgggaggctgagacaggaggatcacttgagcccaagaagttttggttacagtgagctattacaccactgccttccagcttgggcaacagagcaagaccctgtctcaaaaaaaaaaaaaaaaaaagaagaagaaaatatactgggaaaaggatatgggtcagtgatagaaaaagttctcaggccaagcttttattttattagttttttatttatttatttatttttgagacagagtctctgttgcccaggctggagtgcagtggcgtgatcttggctcactgcaacctccgcctcctgggttcaagtgattctactgtctcaaactcctaagtagctgagattacaggtgcccgccaccatgcctggctaatttttgtatttttagtagagatggggtttcgccatgttggccaggctggtcttgaactcctgatctcaggtgatccacccgcctcagcctcccaaaatgctgggattacaggtgtagggcaagcttttagaactataaattactggctgggcacagtggctcatgcgtgtaatcccagtactttgggaggccaaggtgggtggatcacttgaggccaggagttcgagaccagcctgggaaacatggcaaaactccatctctactaaaaatacaaaaattagctgggcatggtgatgcacacctataattccagctacttgggaggctgaggctcaataacagcttgagccagagaggtgggagttgcagtgagctgagatcacgccactgtactccagcctgggcgacagagggagactgtcttaaaatgaaaaaaaaaacgctgtaaattattatatttatttatttattaggtttgcattgtct

SEQ ID NO: 36005 - DNA, 1028 bp, Homo sapiens
cttgttggattttattcagcagcatctatcatgtagataaattcccaggtgtagcattacagcttctgactaatatagctgccattcagacaattaatgttcaaagagttttctaaagtgataaaaccaaagaaaagcatgtggaaaagcagaagcttagaaagttgtggtcactgaatgcactccctggtttttatttgtcagtgaaatctttatgcattcattgttaatattttaattccatggctttgtaggctgtgctgtgtctgaaggggtaacacctagggaaacatgaggccccttatgggaccccccaaatggaacaacttcactttctcttttatgtattgagccctgtgttaacatttcacttaagaagagcaccagtgctttaaaaaaaaaaaaaggtaaaatattaccattttgatagactgtaaagagttagattcctgttgaagtgttaaggaaatttaactttgtgaaacttttaaaataaagtttataaatgtagctaatctttgaaaaaccaatgcagtaacactgatttgtaaatgttgtggtcaatccctaggtgcattaaagtttcagtcacctgccgtgtgtgtgtgtgcccttttatgtttgccttcctagcattcctgtgttcactgtgcatgttcttgaaaatattttcacttgtcagaaaataaactggaaagtcattgaaaacccgtaggtcacgatgctcaggtgactcactgtttctccttcccccattattcgcaataattcaaagtccaggccactatattagtttcctaggactgccatgacaatgtactacaaactgagtggctcaaaacaactgaagtgtgttgtctcacagacctgcagcctagaagtctggaagcagggtgtcagctgggacatgctccctcaaaaacctgtaggggagtcctcttctagtttctggtggtttgctggccatgtttgatgttccttggcttgtagatgcatctctccaatcctccattctcgcatggccttct

SEQ ID NO: 36006 - DNA, 1074 bp, Homo sapiens
ttaaaaatgaaccactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaagaacgattattaaattagttctcctctatactgtactatggaattgactttttaaaaattcagtttatggctgggcatggtggctcatgcctgtaatcccagcactttgggaggctgaggtgggtggatcacctgaggtcaggagtttgacaccagcttggttaacatggtgaaaccccgtttctactaaaaatgcaaaaattagcctggcctggtggcatgtgccagtaatctcagctactcaggaggctgaggtgggagaattgcttgaacctgggaggtggaggttgcattgagccgagatcacgccattgcattccaggctggatgacagagcaagactcctgtctcaaaaaaaaaaaaaatcagtttacattttaaaaatgactcatttatgccaccaatatagtcacccttcagtatctgtgagaggttgcttccaggacccccatgatactaaaatctgaggatgctgaagtccttgttataaaatagctttgtatttgcatatggcctaaatgctcttgtatacttttttttttaattgtttttttgagacagaatctcactccatcatctaggctggagtgcagtgatgcaattttggcccactgcaaactctgcctcctgggctcaagcgattctcctgcctcagcctcctgagtagctgggattacaggcacccggcacaatcccagttaatttttgtatttttagtagagacagggtttcaccatgttggccaggctggtctcgaactcctgacctcaagtgatccgcccgtcttgggctcccaaagagct

SEQ ID NO: 36007 - DNA, 1059 bp, Homo sapiens
aacagaacacttcaaagtccttccctgtgtcctctccttttctctggagaccactgtcctgacgtatgatcattacctgcttttatcattttatcatcttgtatatcctaaacatttcagtttagttttacctgttttatttatttatttttgagacagactctcactttgttgcccaggctggagtgcagtggcacaatcttggctcactgcaacctccacttcctggattcaagcaattctcctgcctcagcctcccaagtagatgggattacaggtaaccaccacaatgcacaaccaatttttatgcttttagtagagacggggtttcgccatgttggccaggctggtctcaaattcctgacctcaggtgacccgcccacctcctaaagtgctgggattataggtgtgagccaccacatctggccagttttacctgttttaaaactttatgtaaatataataatgcgatatgtattttttcatttttttcagcattacctgtaactgcatgtattcatagttcatcagttttggcttcatagcactgtagaaatataacatgagccatatatgtaattttatactttcattaaaaataaaaagataattttttttttttaagacagagttttgctctttttgcccaggctggagtgcaatggcacggtctcggcttactgcaacctccacctcctgggttcaagtgattctcctgcctcagcctcccaagtagctgggattacaagcacacaccaccacgcccaactagtttttgtattttcagtagagatggggtttcaccaggatagccaggccggtctcgaactcctgacctcaggtgatccacccgcctcggcctcccagagtgctgggattacaggcgtgagccaccgtgcctggccaaaagaagaaattaattttaatatatttcacttaatcttgtatatctaaaacattacttcatcacgtgattgatgtaaaaaatgaatgattcaggaaatattttacattctttcttcatattatatctttgaaatccattgtgcatttttaaat

SEQ ID NO: 36008 - DNA, 1045 bp, Homo sapiens
agattctggattccttgcatttccatatggattttaagatcagcatgtcaattttggaaaaaaatgccagctaggattttgaagggttatattgaatctgtaggtcaattttggatgtattgtcatctttacaattacaagtcttctgattcatgaacgtaagattcttttgatttatgtaggtcttgttaaacttcttttaatagtgttttatagttttcagagtgtaagttagtatgtttaaaagctaagcaagtgattcaaatgtgcaggttggagttgagaaacctactttagtaaccatgagtcatactgattatattaatatctgaaatgtttctgagttactgatcttttttcccttgtttttccttttttcttacactaactcaggagttcccattcctgaatgagtcactcctttggagttagacctctagtatctgtctaccattatttagaagactgaaggttttccctgcagacgtaggttttcacagtgctcgttgttgccatttagacatgtccatggtagatagggactgagggttggtactcctatcctaccacacccctatccctcttagttctcttactacttactctttgaaaaatgatgtcactgtcaagacagctggaaggagagcctcttgttcccattagcagacatccagggtagaggcctgatatttccctcaacttcaagtgcctcccaggccaatataccatttaatatcctatcaccactgggagaactgttaagagtaggaagtttctttgttacagggccctttctagtagtatgcaagactcctgaaacagagaaacctgccagaccaaatcaatcattagtcaatttgctatttatagcttgattagatccatgtcttcatcatttttggtaagatagagatctatggacagaaatttacattcagtgtaaaaaggcttgccaagcatatgttttgaacaagattacaagcatgattggctatttcaaagctgtgaatacttttgagagtagcatttttcaggccctttagaa

SEQ ID NO: 36009 - DNA, 1051 bp, Homo sapiens
cttcttgacctttttattccttctctgacttcagggagtcagggtggggaaggtgggaccaacatgatggtgtagacccatcttactctcaggtgaggaagaatcacggtaggtatttggagaagagcacctgagctgctctaaaggagagctgccctgtttgttttcctgttggcatcccacaggggtttaggatgttttcattaactctccaaggagtgttagatgttgtttgtcacaaagaattttttcacaagtgacataatcagaacacttctaatgagtacaattaagctttgaataaaaatttatcctcataattacctcttgtgaagatcttttaaaataatatttcattttgctatttcggaaataaattctttcttgattggaataagaatcttaataaaatttccctgcatattccctaaattaataattcatactccttaagcatgttcagtgtgagtgcttgtcctttttgaatgtaatttcaagagtaagtctgagttactttgttgtttttttcttttttttgagatggaatctgtcacccaggctggagtacagtggtgcaatctcggcacactgcaacctccatctcccgggttcaagtgattcttctgcctcagccaccaagtagctgggattacgggcgtgcgtcaccatgcctggctaatttttgtatttttagtagagatggggtttcaccttgtttgccaggctggtctcgaactcccgacttcaggtgatccctcctgcctcagcctcccaaagtgctgggattacaggcatgagctaccgcacctggcctagagaaatctttgatttgtgttttcatcctgctttcttctgtccttaatttcttagagatatcctcaagttacttaagggaaaattgttacaaagacactttgctgtttagaattatgcctagctggttttctcaagtactcattctttaaaagtgagatgtagtggtgtgaccctgtagtcccagctactcgggaggctagggtaggaggattgcatgagtccaggagttcaagtc

SEQ ID NO: 36010 - DNA, 1050 bp, Homo sapiens
gggattacaggcgtgagccaccgcgcctggccttaaaaacattttaaatggcagttaaactcaccatgaagaggacaatgtacataatgcaattgaagcaacaacatatgaagacctatttgtaggttcacatatgaacaggcaaagactatgttacaagtgctgctggctaccagtaattattaaacacatgctgatttcagagatgttaaatgtgaaaatgtattggtcttaaaaatgatgaaatatggaaatattaagagtaaaaaaatgcactctaggttagcattattttaaaatatgtatgctagtctataaggagattatttgtattctgtttttcagtatgaagtgagagtgtttacaaaatattgcagataaaattccaacagaaatatacattgaaaggattctgttctttaacatcatagatatgtaaattttgagagaaacataaacttttttaatatataggattttatttaaagaccttatttctattttaggaaacccaagaaaacatataacgtctttgaaggaagctgtggatatgacctgccatggagagccatctctttataattccctaagcatggctatgcagactctaaagttagtattatacattatgtataattgaattagaagttttttaaatgagttaagttgaagtgatgtgttaatatggggcccataaacccagctataacaaaattgttaagtacgagaattatgtagtgttatttatgatgtttagtgtggtgttggttagtaatttttattttacattttagtaagatattgttaaaggttttataaaaatataatttaaaactgtcggcagtatcaatagtacaaaaataggttgatgaaaaaatattttattaaaatgagatttaatatagtataataattgtaagttggttgtacctttattaacatttattattttattttgaaagtaatggccaaaaccacaattccttttgcaccaatgtcatatatctgtaaattaatagatatggcaagttcagctatatggaatagagc

SEQ ID NO: 36011 - DNA, 1064 bp, Homo sapiens
taatacttaattaaaaccaggtaccacgatctcatgatctaagaatcaggtcactgggcttgggttcaggttctgcaactagcaagtaatgtgaattttgacacattattgaccctctctgggtaacagttttctcttctataaaatacaagcattgactcagtagcatcaccttcagctttaacacctaataactctaagtttgtacatgacatttacacaataagaatacaaagaggccaggtgctgtggctcatgcctgtaatcccagcactttgggaggccgaggcaggtggatcatctgagctcaggagctcgagaccagcctggccaacatggtgaaaccctgtctctactaaaaatacaaacatttgccaggcgtgggtggcaggcagctgtaatcccagctactcgggaggccgaggcaggagaatcgcttgaacccaggaggcagaggttgcagtgagtggatattgcgccaccaaactccagcctgggcaacagagcaagactgcatctccaaaaaaaaaaaaaaaaaaaaaaaaaagaatactatacaaagaaacagctgggcatagtggctcacgcctgtaatcctagtactttgggaggctgaggtgggcggatcacctgaggtcaggagtttgagactggcctggccaacatggtgaaaccccgtctctactaaaaatattaaaaaattagccgggcatggtgatgggtgcctgtaatcccagctacttgggaggctgaggcaggagaattgcttgaacccaggagacggaggttgcagtgagctgacaacggtgccactgcactccagcctgggtgacagattgagactctgtctcaaaaaaaaaaaagaaacataaaaggaatgacaactctgaagcaaaacctaaatttgttgcaaaatttgctgacaaatataactaccacctccagcttcggtgtatatatgtatgcacacacacacacacacacacatatatatatatatatatattttttttttttttttttttgagacagggtcttgctctatcacctaggctggagtgcag

SEQ ID NO: 36012 - DNA, 1033 bp, Homo sapiens
aagattgacacagtcttgaagtcaatattcaagttctcatattattaagagcatatcctggtgtgtggtgataactaatggatatacaatgaaatgtaggtttaacatattttatgatttttgttatggtgaggtataattcatcttttggtttaatttctcagttataacattaaattttgcacattgggcattgtggaatttagttgtcttaagggtttttttttaaaagatgataaattagtaagtaaataaataaagcaatggaaggtctttgaaagtttagccagtgaaaaataattttatagcattcacattctataattaaacataaatgtaatactgctaataatagttgtttttgtgtgctattttccattagtttgtgatgatgattttactggtcattaaatagttagagcatatttaactgctttctctgcaggaatgtaaaatataaagtgcttgtgtttttcaaaatttccatggagtccagcacagtaatacatattgaatatcaaagacatgtgcaagtcaataatacaaataccgttttataatacgtagcccaaagatgttttgtaaatattatattgctgttatggattttgaaaatgagttgacatttctttctaccctcttggaatcacattgtaggtaaaacttagcagatgcttggaaaatacccatatttcacataggtattattatgcctttgatatgattgccatgctaaacctcaaaatataactatttacatctcatttgctatttgtttccttgtttttagtatacatctatttaaaaatgtgtttatttcagtttaactgtagaagttttaagaacaaaaggcccttgtgttgttgaagaaaatgaccccatatttgagcgcggttctacaactacatactccagctttaggaaaaactattactctaaaccatggtcaaataaaggtaactaattttcatttaaaaatgtgtaagttctctatttgaaatgaattgactgtttctgaattaaatcagttctc

SEQ ID NO: 36013 - DNA, 1028 bp, Homo sapiens
ttggcctcccaaagttctggaatgacaggtgtgagccacttgtcctagcctctttttttcttaattcatcttgctaagtgtttattaatctaaacatctttttaatgaaccaacttttcttaatgtaattttttttttttttttttttttttttttttgagatggagtcttgttctgtagcccaggctggagtgcagtggtgacatctgggctcactgcaagctccgcctcctgggttcatgcccttctcctgcctcagcctcccgagtagctgggactacaggcacccgccaccacgcccagctaattttttgtatttttagttgagacggagtttcactgtgttagccaggatgatcctatctcctgaccttgtgatccgcctgcctcggcctcccaaagtgctggaattatgggcgtgagccactgcgcctggcttcttaatgtaagttttaggtttccaattgttggtgtgtttttattgatttttttttgttactgtttagcacttccttccatttactttgtgtttgtttttctagcttctttatttatttattatactttaagttttagggtacatgtgcacaacgtgcagatttgttacatatatgtacatgtgccatgttggtgtgctgcacccattgactcgtcatttaacattaggtatatctcctaatgctatccctccgccctccccccaccccacaacaggccccggtgtgtgatgttccccttcctgtgtccatgtgttctcattgttcaattcccttttctagcttcttaagatgaaaacttagagcactgattttaaagccttcttttttaaagtagacatttaaagctatacatttcgttttttttgacacagagtcttgctctgtcgcccaggctggagtgcagtggcggatctcggctcactgcaagctccgcctcccgggttcatgccattctcctgcctcagcctcccgagtagctgggactacaggcgcccaccaccatgcccagctaatttttttgtattttta

SEQ ID NO: 36014 - DNA, 1051 bp, Homo sapiens
agtgtagtagcgtgatcacagctcaccacaaccttgaactcttgggctcaaatgattctatcacctcagcatctcgagtagctgggactacagtcatgggacaccatgactggctaattttaaaaacattttttagtagagatgttttccaggctggtctcaaactcctgggctcaagcaatcctcgcacctcagcatgagccactgtgtctggccctagctttttctaatttaggggaaaaacaaccttgtaatgactgttaaagtcccagttggttttggaaaacaaagagttgattctaaaattgtcatgtacacaagaacaaaggctcaagaatggtaaagacagttttaaaaaacaccaactttgcagagggactgtgctagtagactaattttcgagctagagtaactaaagcagcatggtattggtgtagggttagatgaattgactcagtggaactgaatatagagtttaggaagagacatttaggaatctgttatatggcagaggtagctttagaaattagcgggcaaagatagaactaacttcattagattgagctgagatttgaaaaacataatatttgatccttgtgttaccatatccgctaacttcctgatggattgaagactacatgtataaaacaaatctttacaacttttagaagaaatgtagaaaaatatctttgtaatgtgaaggcctcaggtaagacatttctattaagacgtagaaaacacagactttaaaagataagattgataagtttgatggtagtaaaattaaatacttctgttaacaaatcctccataaagaaaataaaaggcaagttactgatcgggagattttatgtgtaatatctagacaataaaaatatatagagaactcttgctgataagtcaggaaaacataaacacctagtagaaaaaatgaacaagaaaaaaagaaaaaggtatggctaaatgtgaatatgtgttgaaatggtcagtgcgtggctatcagttatattattgttagttgaaatttattttgtgacagagtcttgctctg

SEQ ID NO: 36015 - DNA, 1038 bp, Homo sapiens
tgacctctagttccatctatgtcactgtgaatgacaggatttcattcttttttatggttaaataatattccattgtgtatatataccacactttctcactttctttattcatttgttgctggacacttaggttgatattatgtgttggctattgtgaataccactgcagtaaacatgagagttcagatatctctttgatacagtgatttcctttcttttggacatacacctggcagtaggatggctcaatcaaatggtagttctatttttagttttttgaggaactttcatacttttttccataatggcattcctactttatattcccacgaacagcctatgagttttcccatttctccacatcctgaccagtatttgtaattttttgtctttttaacagtagccattttaacggcagtaggatatctcagtgcagttttgatttgcgtttccgtgatgattaatgatgttgaacattttgtcagacacctgttggccatttgtatgtcttttgagaactgtctgttctcttttgcctattctttaatcagattatttgtttttttgctattgagttgtttttgttccttatatattctggttattaacttttgtgagatggatagttgggaattttttctcccattctgtaggttgtctcttcactttgttgattgttccctgtgctatgcattgaaaagtctttccatattgcttttattttaagattaaggccaatttttacttcacattaattttaggttcccttagccattttttcagtttttaaaactggatattttattgaaatgttttttactaaaatgcattagacttatattacaaatgctatattggattaggttgatgattgatctcagagcaatttaactctgataatgtctaggaaacattacagatgaatttgtttacatcattcacttctcctaattactaattatgggattattttctatgtataatccctttttgatctcaaagaattatagaattttaccactgaaaataaccttatat

SEQ ID NO: 36016 - DNA, 1077 bp, Homo sapiens
acaagatacaaacacccaacacctgtcccttgagccccatctctatgccgtctggcctggtcactctcaggtctgccttgcacccctggcgaactctttttattttgttaaaactgaaattctatacccattaaacagtaactctccattcctcccaccccctaaccttttggcaaccacttttctacatcttgtctctttaatttgactcctcatgtaagtggaatcatacagtatttttttgtgtgaccattttatttcatttagcataatgttttcacagttcatctatgttgtagcttatgtcagagtgttcttcattttcgaggttcaataatattccattgtgtgtgtgtatcatgttttgtttattcctttatcatcaatggacacttgggttgcttccaccttttggctgttagaaataatgctggtatgaacatagttgtataaatacctctttgaatctctgcttttactttttgcgggatatacccagaagtggaattgctggatcgtatggtaattcttttaattctttttttttttttttgagatggagtctctgttgcctaggctggagtagagtacagtggcgcaatcttggctcactgtaacctccatctcccaggttcaagcaattcttctgcctcagcctcccaagaagctgggattacaggcacctgccaccacacccagctaatttttttgtatttttagtagaggtggggtttcaccatgttggccaggctggtctcaaactcctgacctcaaatgatccatctgcctgggcctcccaaagtgctgggattacaggtgtgagccactgcacccggcctcgatcttatgttaattctatacttaacttttcaagcaacctttatactgtttttcatagggctgttatcattttacatccctatcaacagtgtacaagcattgcagtttcgctacatcctcaccagtcgtagctatgttgtaactttggctagtaatcatcctaagggttgtgaactagagaaacgtgttgaacatatttagcttccttacacttttgcctgttagtctgccattcca

SEQ ID NO: 36017 - DNA, 1059 bp, Homo sapiens
aagactgcagtgagtggagattgcaccattgcactccagcctaggcaacagagcaagactctgtctcaaagccaaaaaaccaaaaaaccaaaaaaaaaaaaaaaaaaaaaaagaaccagaaccaaaccatgggaataaaagtaacttaaaaatttcaagacatcagatacaggactgtgactccatattgccagttaatatagtggaatgttaagatgatacccaagacagtcaaagcctcccataattcaatatcgcacactgttttctggttgtaccaaaaaataaacaactggaaaatgatttttacccttaaaagcatgtacacttaaaaaatgggatgaggtgggatttccttcttcttaaaaatgtttctagagttactaaaaaacttgcatttgtgaaatagttgagaaaaatattcctctggaatgtacaagaagggagacaggtactattggtaagacatagtatatgatattaatcagacttggctttttttctctctgggcttcatcagaggctggactttccttggtttttgtttctctgttttctgtaggtaaatctgatttcttggttagccactttggtttgttttccctttgttccccgtttttctcttgtttgcactttttttgtctggagatttatcctttcctgctgccttttttggctttgtttccacttttgcaggagcaggtttagctgacagtcatactaatctcatcttgggctctttccttcaccgcccttctgctgagctgatcttcctcttgggcatcttgtggtcaggagtgtgcatgctgggtgcctgtgagccgcaccatgctgagagccttctcaaagctgggctgcctggctgctaccactcctcccatcctgtcttatcattaagtatgatgttaccatggatttttcataaacgtcctttaccaggctaaagaagttactttctattcctagtttgttgaatgtttctttcattaaagggtgttggaatttgtcatatgctttttctgcatttatggagatgatcatgtgaattttgtttttcat

SEQ ID NO: 36018 - DNA, 1059 bp, Homo sapiens
accggaagtgtttcaaatttcagatttttttgaattttagaataattgcattatacttacatttgtattatacttaacagttccacatcccaaacctgaaaagccaaaatctgaaatgcttcaatgagcatttcctttgagtgtcatgtcagcactcaaaaagtttagaattttggagcatttcggattttcagctttgggatgctcagcctgtacaaaattgtaggatacacatacactgtattcagatagaagacattttttattttccataatcagatttatcagtctttttgtgtatggcttctggagattatgttatacattgaaagtcctttgagacttaaatttcctagttaatgttaatattactgatttgttgcgaatttgatttggtgtaaggaatagggccaagttaattttcctcatatgacttttaccgtttactgaataattcatcttatttccactgataggaaattctgcttttatcagtaagacagtaaatcttcatatttgtttggatatattcctaaaacttccttttcttttatgttgattcacctatttgttctggggccagtatcatcatactgtttgaatttttgtagttttctttattcttttttttttttttgagatggagtttctctcctattgcccaggctggagtgcaatagcgtgatctcagctcactgcaacctccacctcccagattcaagtgattctcctgcctcagcctcccgagtagctgggattacaggcagccgccaccacgcccagctaattttgtaattttagtagagacggggtttctccatgttggttaggctggtctcgaactccggacctcagatgatccgcctgcctcggccttgcaaagtgatgggatattacaggtgtgggccaccacgcccggccgaatttttgtagctttatgatgcactttggtatcttatagggacagtatctctcccaaacccatacaattttcttcttttttcaagtttctcctcattacttatatgttctcaaattaatatgaattttagaattaac

SEQ ID NO: 36019 - DNA, 1090 bp, Homo sapiens
agccacatttagattccatttggcaggttgtccattaaaatatttaagtagataagtggcatgatcctatggatatggtagaatcatcagtgtggtggcaatgtggaggatggattgatatagggaaaagactagacctaggtgacagtggagagttgagtcttgagatgaaggagtcaaagttagagttgtatgtaggaggggggcataaatacctgaggagcaaagattatagagttaataactgagtggaaggggaaaatggatgactttggagtttccaactgggcagaatatttagttaggtggaactgccattaatacaaagaaggctttggtgatgggttttgtatgaatcaccttttgctaggttgcgctttgtgtaacaaataatcaaaaaatctcagtaactcacaacagtaaatattagtctctcacttgattttgttttgtttcttaatctctcactcgtgttggtggcctttggttagctgctgctgtgactgttccactgcagggtaggttcaggtctgctccatgtgtcttcccattcctggactgaggctgaagagcagccctgaattaaacatgcccttctcatggccgaaggcacaggagcaagaggctgaacacaaattggatttaaaatccttgctggcatgtgatgaaattaatgtgtgctcacattagacaaagcaagtccatgagggtgggggagaatgggatgaatgatccagtttagctgtgtttcctgattacaaataaaagcaactataataagtaataataatggcaggaattttatagtgtacccaccatttttctaaaggctttatgtggttttactcatgtatttatcataatgatcctgtgcagtaggtacaattgttatttctgttttatagatgggaaaactgtggtatatagggtccaagaaatttgtctgagataacacagagcctgaatttgaagccaggtggtctggctcataactcttgagtccagggtcttaactgttgctctataatgcttctcactcacccagctctacctaggtgggttctatggttgaaaagatggggtgggaaac

SEQ ID NO: 36020 - DNA, 1033 bp, Homo sapiens
cttaggttgttagttttttattactaatctaggactgatgacttttcaaaaaccaagtgtgagtttataaacttgttagaagtaattgttttgtattatataaattaatatgtgaactgtgattaaagtttgcatttatatcctaagactgctgtctgctaatggatgttaatagtgatacgtactagaagttgaaggttgtattggggtatcttgtaatgagtgtaattagttttgaagaaatctcttaaattctctctccaatgaaatttctgcctttcagagtagaatgcatgattattgccaatgatgccaccgtcaaaggaggtgcctactacccagtgactgtgaaaaaacaattacgggcccaagaaattgccatgcaaaacaggctcccctgcatctacttaggcaagtcaccagagtggtaaaataaactattattagctggtaaaatgcaagatagtttggaaggctgtatgtattacatttgggatgggtattttataaacctgttgatttctcctgtaattataaaggaaacacaggttctttgctgaaaactctgggggaaagtaaacaagaactgttcatagtactagtgcataatactcatacattttgacgcatgccagtttttttctctatgtgttgtgtggttttttttttttgttctctagatcctgtttttcttttaactttatggatcatactatgaaaaaaatagtagcaagtatttatagatctcttgagtgccaggtactgagttaaatgtgcaagtattatataatttgagcagatgtaatttaaagtaaatttaatttccagtgaaagtaaacttatatttgaaattaaaacacatttaaatcaaagaacctgaaagcaaagcagtttaaaatgggcctttcctccgggcgcggtggctcacgcctgtaatcccagcactttgggaggccgaggcaggcggatcatgaggtcaggagatggagaccatcctggctaacacactgaaacctcgtctctactaaaaaaa

SEQ ID NO: 36021 - DNA, 1007 bp, Homo sapiens
tatttaatgttactagccttgcccattgtaaattcatttacctagttatttcaaagagtatgtctattggcaatcatacccgtatcgttttctgtatctttgctgctataaaaatgtggacagattactatagaccttccaggtttcaacattttcttttgctctcaaggagaaaagatagttaaactaggtacttacttttatgttctcttctgtttcatctttccttcatggcagattttaagaccccttaatcgtttctggagtttaaagagttgatgtgtgggtgtctggtggtctttctttgagtctcatgtcatgagaatgccttctctgggccttctccatatctgaggcctgatgacatgatgatctttgcaatgttcttcttttattttcccagtggtgcagtttaaatgtgtcccccaaaagtttatgtgttggaaatgtgattgccattgtggtgatgttaaatggtggcacctttgggaggtaattaggtcatgagagctctgccctcatggatggattaatgctatcattgtgggagtttggccttcgtttgctctctgtctcacacacacttgccctctcttgccctcccaccttctgctgttccaccatgggatgactgtcagatgccagtgccatgctcttggatttcccagcttccagaaccgtgaaaagtaaatttcttttttaaattctttctttctttccttctttccttcttccttccttccttccttccttccttccttccttccttccttccttccttccttccttcctttctttctttctctttctttttgtagaggtgaagtcttgctgctcaggctggtcttgaactcctggcttaagttatcctcccacctcagcttcccaaagcattgggattataagcatgagccactatgccaggccaaatttcttttctttataaattactcagtcttgggtattctgttatagcagcagcaaacagtctaagacaccaattatgg

SEQ ID NO: 36022 - DNA, 1027 bp, Homo sapiens
atgagccaatgtggcctctcgttgttttatttgtttatttatttttcgggacaggtctctttatgttgcccaggctggtcttgaactcctgggttcaagcaatcctcttgcctcagcctcctgagtagctgggattacaggcgtgtgctaccctgcttggcttgttttaaaaatgcatttcaaagcaggcacggtggctcacacctgtaatctcagaggctgaggtgggcagatcacgaggtcaggagatcgagaccatcctggctaacatggtgaaatcccgtctctactaaaaatacaaaaaattagccgggcatggtggtgggtgcctgtagtcccagctactcgggaggctgaggcagtagaatcgcttggacccgggaggtggaggtcgcagtgagccaagatcacgccactgcactccagcctgggcgacagagtgagactctgtctcaaaaaaaaaaaaatgaatttcaacctgtgatggagatggatagggcctaggagaaacaaaatcactgtttgatttctttgaggctctctgacaaaaagattgaggaggaaacagaacatactggataagactgactttttggattctttgtgcatttcaatctatccagttggcataggtaagcatgactactatcaaatcagtggtattgatcagtcagtatagttgataacgttcttaaattcttgacagctattgaattgagatgtatattttgtggcttttattttttaatggtggctcttcaggtaggggcaggaaaaatgggatgtgggcagtaatatctgctttctactttgaattgaaaaagaagtaaggtgacagatttaaaaaattattatatttttaatggcttttctatcaagcagttggaccttttttctccctccaagttatattacatttatcacagcatttctatgaattggatagtattctacaattttgcagggaggaactgaggtctagagttcacctagcttttcagaattagataaaaaatctcttagctct

SEQ ID NO: 36023 - DNA, 1047 bp, Homo sapiens
gtttccttggttgttgaggaactgtggagaaatgtgtcggaagtgcccttagccatatggtaaaattcccggaagtagatatgctaataatttgtcagctattcccttgtgagacttttctagatctctcttccatccttcttcccctactcaaatggtgtcttagtcatttccagctgctataccaaattatcatagactactgggtgtcttaaaaaacagacatttatttctcataactctggaggctggaagtccccagagataagggtacgagcatggcctggttcttgatcagggccctgttcttgactatgttctcacatggtgaccaaagagatctcctgtctcttccttataagggcactaatcccatggggagggggggccctacctcatgacttcatcccaccaaattactccccaaaggcctctgcctccgcataccatcactctggggagcagggcttcagcagatgagttcggaggagacacaaacattcagtctgtagtagatggtatgatggcatttagtttcatttctctcacctttgtcttactacatttctttcttcctttctttttctttttctttttttttgagacggagttttgctcttgttgcccaggtggagtgcaatggtgtgatctcggcttaccgcaacctgtgcctcccgggttcaagccattctcctgcctcagcctcccgagtagctgcgattacaggcatgcaccaccgtgcctggctaatcttgtatttttagtagagacggggtttctccatgttggtcaggctggtctcaaactcccaacctcaggtgatccgcccacctcagcctcccaaagtgctgggattacaggcgtgagctaccacacccagcccctgctttctttctttctttttttttttttttttttgagatggagtcttgctttgtcgcccaggctggagtgcagtggcgtgatctcggctcagggcaacctccgcctcccaggttaagtgattctcctgcttcagcctcctgagtagctgggtttacaggcatg

SEQ ID NO: 36024 - DNA, 1031 bp, Homo sapiens
actccagggcataccagtcatacttgataccttagattggagcctgtgtcttttgactctgagccctgtctctacccagctttctcattgcatccctgaacctctgccggtacattcgaacagtccttgaagctctaagtctagcaaccagcccttggagcctttcctgcttttcttgcatgcagcatggtgctgttgcttgtatagtgaagtataaaatcagaacccagaatgacttcagggcattaaccaggcatgtcaaatgaaattctagtgagattttctgtgtagtgtgaaattttgtgaaagtgacaacttcactgtgaattgttttcctataagtaactttaatacaaaaattcttttgcaatataatttctcaaggccattgttgtttttcctcttaggtcattgctagaatcgtggatggaagcagattcactgagttcaaagccttttatggagacacattagttacaggtataaaggtgaagaattgaaaatacgaacattttctgctgctttgaaaatcaggaatctcttgtttcaagactttgatacacttgacatgggctttgttgttgagagcactacaaatgtgtgagccacttttaaaaggaactgctttataaacataatttgtagcttaatggcttcatggatccaaatagtttaaaatgttaatagctagatgctgtggtgtgggtccctatctgtgactttgtgacattagttgtataaaaaggttcttatagtaaaattagtagaaaatacttgtagttctttttgtttttctggataacaataattattttgaaagtttcagcactgtttcctttgttctttactgtccaattcaacgaggaagttttatattgtgtttagcttcccagaaggatatagagtgagttaaaccttctcacagcctctgtgtaggtcttaagctgattcatgcagacactagattgagaattcagtatatcacgtcaggaaaaacaaaataaggatgtttataaaagttaattttttaa

SEQ ID NO: 36025 - DNA, 1089 bp, Homo sapiens
taaagattcaggctgggcgtggtggctcatgcctataatcccagtactttgggaggccaaggtgggaggatcacttgagcccaggagttccagaccagcctggcaacatagcgaaaccccatctctacaaaaaatacaaaaactagctgggtgtgggggtgagtgtctgtagtctcagctactcaggaggctgaggtaagagggaggatcacttgaagcctgagaatttgaggctgcagtgagccatgactgtgctactgtgttccagcctaggcaacagagtgagaccttgtctcaaaaaaaaattcagttttctggcttatcagtatgttgatactctctcttatctgttaatttttcttcaataattattttgatattaaaaatgatatttttatagtatccctagtgtctggtacatactagacactcagatatattaaatgaataaatggataatacactaagccaattatttaatcaaatcaatcaagacaaatggataactctacatgtatcgtgaccctttctagaagcaaaagaaaccagagtctaggaccttaggaacaagaagattgtgacatgagctgttttataccatagacaaaatctctttgcattttaaacttggatctgatattaaagaatgtgtaaatatgcctctttcttgtgaattgaagcccttggaaaagcacaagacataaatcttctttgaactttcttttgaggatttgctcgaatatttgggtacccagtaggtatcgttggaaacaacggagttctcttttctgaatctgcaaaaaaggcaagtactgttaaaaatatttcaagattttctgttttaatttaacataacgttgaaggtcaaataatgagttaaaatttattgcataaaaatgcttaactagatgcctcagcaaccagaacactgtgtgcgcgggcatgtgtgtgtgtgtgtgtgtgtgtgtgtgtgtgtgtgtgcgcgcgtgtgtatatatgtgcatgtatgttagtatttgaaacagtttttatggtggtttacattaacatgctgtgacgaaccatctggagcactattaaaaatgtact

SEQ ID NO: 36026 - DNA, 1034 bp, Homo sapiens
tgatgggtacagcaaaccaccatggcacgtgtatacctatgtaacaaacctccacattttgcacatgtatcccagaacttaaagtataattttaaaaaagttaaaaaaaaacctaggtgtgatattatgtgtttacaacaaagcttaccaagtattctaaaataacagaaagaaataatttatgtacaataacaacattaatgataatatatccatggataatacgttttggttaatcaaatattctagctaattgagagttgccaataatccctcgtgggattattatttttcaaagttgtagaatccaataatacagtcatttcttttacacaaacacctaaaatttatctagaattaacttagaatttcctaaaccaaatttatacattagcccaagatatacttaaattatttatagaagacatgaacttacaaatctgttgtttcttctcccacccaaatagaataatatcttcaaagacagtctttttttaaaaaaggacatattgttccccttaggtagatactggcattttattgaaatatagttcaagagacatgcattcaggcaagatgagtgcacaccgtgctacctacttggaacccaaactcagaacagtagaattgaatcttccttggaagactcaggaggaagatcatctctctgtgcctcagggtcctcatgatgaacctattggtaattatactgtaaacatgagggtgtgcggattagtagcgatttcttatcactgaatcattagtgagcaaactatttattttgaggtggtgtcctcaatactaatatgattgtgcttcaatatagaacaaggaatatccctggatgttatagtccttctgaaaaagagtcattgattgcagatattgttttaaaaaaaaaaaaaaacactcaaaactgctacagagaaaaaagaaagtgtgaaaaaagagaccatggctatcttctaggttattcgaagaaaatacctgagtttgcaagtatgcactagctcactgcatttgcactgtcctga

SEQ ID NO: 36027 - DNA, 1067 bp, Homo sapiens
gctgactggcgcgcagtgctgggaaagctgatggtggaggaagggaagggctggcttcttcccgttggcaaatggcagactgtgggcaggacggggcagtccaggaaacaagatgaaacacagcccacttgtctgtcatgcagacatgtttgtgagtatagcttttggtacagccacataatgtatgctaattgctatattccttcttttttttttttttttccacgggaaatggctcggtgagaaagctctgaaaccaaagaggcaatgcagaaatgccaaaatgcagacattacaaaagagagaggaggaacaaagggaaacaggggatccaaatttacatcatggtttagcgttctgctaaatcagcacctccctggtccatgcaagtcatatggaaaataattgagcagaatttcctatttgggttgattttcactgcatctatctcataggttgcaatttgttaattggattttttttaaaacaagaagcaaaaattttacccccaaggactagaaagttagcaagttaagttgaaactccaaagtaattatcagagcttccagaaaatattaataagacagtatgagctggttctctctctactactgttctgaacaagacacttctcagttgaccacaagactcagatgcaaactggggaaagcacacaactgagcccacttaaaagaatcatccatctgtaagaaaactcattcagaatattttgtatgtgccaagctgtgtacctctagtgttccgttagatatccttttgcaactgtcattctttaaatcaaataaaaacagaccaagatattaaaggaatgctttgtctaatgaagcaagagtgcacagacattttatattgaaagagaatggaccagaaatgagaaatatattttactttgtcattggagtcaaaagaagtattgataagtagactttctttcccccagtaacccttcattttttttaaataaaaaagtaacattctttagagcagttttgtagttacgaaacaggaacttttataatgaatttgattagatgtgacggaaggaa

SEQ ID NO: 36028 - DNA, 1081 bp, Homo sapiens
gcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaat

SEQ ID NO: 36029 - DNA, 1784 bp, Homo sapiens
aggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaag

SEQ ID NO: 36030 - DNA, 1043 bp, Homo sapiens
tttgattaactattggaaagcacattttggctcgtaagtgtacatttaaagcacgtttttgaacttgtgtaagcaaataaattaggaagtaggatcaaagcagggtaggtgcctataaatgaaggcttatctaaccaggtacatttctcagcattgagacactcactcagtcttggttttgcttgtgtcttcttaatattcagattataatccatatccagtcaaatatgttggaaaacctgataaagactctaaaaaatgctgcagaaggaaatttatcaaaatttgtgaaaagacatgtgttctcggaggaagtggtgagtatgcaagtgctgcagaaatcatttaaaagtgaaaggacactcttaaaaatgtccactaatttctcaattctaaagcttaccttaaagaaattgccaaatatggcagcttctctgttgttcctgttttaagacttccatgtatatgtgcaaagatttttttttcttccaacagaatatatcctctgaaattctaggaaacttttcccttttaccttattcttttctccacattgtattcatgggccctggctctctttttcttctagatgacgattttacacctttttccttttccctcaagccttcaataccttctcctcacttttcactctcagttgatcactgtatttcttgtttcttggagaaaatagaagtaatcagaaaagcatgactgctacatagagagcctctggccccttgccctatatacccatgatgactggatacatctctcacaccagcctcttcagtcatgcactggatcccatcctctctgacccactccacagcatcagtccagaagttgactcactcttttggctatcatcagtatccccttccctgtgggtcattcttgtcagcaaacagtaggatatagtatctctcatcttaaaaaataaaaagaatcttctgtacaaatgaaaagacagaccatatgtttagataagaagacctagcctcataaaaactcagtttttttcaagttactgtgataatgta

SEQ ID NO: 36031 - DNA, 1043 bp, Homo sapiens
cttccattttatagctgcaaattactgggttgatgtcaggtagggtgaggagtatgttccggttatagctggtagcaagatggctgcatgcatcatgaggctttggcctaaaaagcttgtcattatataaaaaagctatagagagcagagaaaatgtcatttccaatttagaagatcataatcgatttttaacacattggtccttaggtgatacagaattcaacaaaaacggggcttataaaaagccagggttcataaaattacaaagattatagacaaaaatagataacatataagacttaccagctgggcaaggtagctcaagtttgtaatcccagcacttagggaggccgaggcaggcagatcacctgaggtcaggggttctagaccagcctggccagcatggtgaaaccccatctctactaaaaatacaaaaaaattagccaggcgtggtggcgggcatctgtaatttcagctactcaggaggttgagacgggagaattgcttgaacctgggagacggaggttacagtgagcctagactgcgccattgcactctagcctaggcgacaagagcgaaactatgtttcaaataataataataataataagacttaccatttgccaggtcctgtgcaaagcactttatctcatttgatccctgggaaaccccataaagtactattatgccatttctcagataaagaaactgaagctcagagacgtttagttgcttgcctgtggatataacactagagagcgggagagcacagtatttgaacccaggaggtctgatgctggaggtcatgtttttaaccttatctctgtattgcctgcccaagtgctggctgtgtgcatgtattctcaataatccctggccaacttcctgctttgctgtcagtagcagagctgaagaacttacaatagacggcagagggcgtccagagtcactatttttaaaaggtgctagttttcaaaagcatttctggaattcagagagaacagaggtccacatagcaggctagacaggaaaggtagctgtag

SEQ ID NO: 36032 - DNA, 1881 bp, Homo sapiens
caggggagcgtttgcctcgcctgttaagctgtggcgtttgagggcccttgagtgctgcagtcggctgccccgggacggctgcctttcactggttctgggcgctggccggcgctgcccgagatgggccagtctttgtcccgccctgggcccctctgcccgggtctcctgcgtccgcacacagcgcccatcgtccttacatgcagcttgccgttctcttcctcccggcggttctttctccttggggcctcttggcctcacgacatgtttacataatgtttgtgactgtacgagttttgcgtgggcttgtgggttttgcccttctacctccactcccatgcgtacaagcaacagggaacagctgctgaggagcagattggccaccacaatcaagctattttcggaatgactttctttaaaaatgatcgcgtgttgcttactgattttaaaaatcaactggattttgcaaggattgcttagagtttaagtctgttatcttaatcgctaatcaggatggtctatcagtagatgtaaatgtagaaatttgaaattggaggctatctacaaattgattttgacagctgtattaagaagcttaataactgtcctttgaaacagtaatgacttaaatgatgaatgtgtaagtggtactttttttaccctaaagaaaagatacttttaaaattgcaagatgtatggtgtaataggtgtttggaaatgaaggttgtaaaatggctgtcctgacgtactactcacttttagaataacaaaagttcctgcagctttttaagtttccctgttatatcaaagctttcatgttagagtggtgaagaagctatgtttagtggaaaaggggaaagttccgttttttgggaaaggatctgttttccactttcaccttacctggcaccgtagttgttcctagagaaggctgtgccaggatgaaaattagcaaccacaaaagggaaacaatagtttgtaggtgcagatatcttttttagtctctagctatgcagtgcataaatttatactagcttggcagtacgatttttacttcatgcaatttaacgtgagcctaatgaagtactagtgttctgttttctttttcctaaaaggggccgccacccttgatgtggctgcatctttctcctagtcaggaattattaaattcctcccactgaaatatctataaaaatcttgtttgcacttctacctcaactctcagtggctttattaccattatataatgtgagcagaataagatttttgtaaaaatacatgattctagttgtaagcttttccaatatcaacatttcttattgtattcattgtttttatgactgtagttttgcttatttataattttaaagccattccatgaactcagtttttctaaatgttgtaaatgagctactacattgaaatgtaaacatctgtatttagaagaatttcttgaattttaaccatgttggattctgcaaatgtttttttaagaaaagaaacctggttataaagtgacgtcaaaccaagtgacataggtaatgaaataaatgaatttatcaaatataaactgcagagaggagcacagcagtaagtgggggagttctttttattggccagggtataaattgtgatattttttcctgagattgatatttgaatacatattggtgctaaaaagatatcttcccccctcaaaacagtttggtttaccagcaaaaggatgagaaagctgagagaatcaaagaaactgatgaggttttcaaaaacaatggcgaacaatgccatcctcaaagaggaaggatcagaaacagtgaaattcccctggaggttgaggatttttcttagttgaccctattcagccattgccatggtaaatctgtt

SEQ ID NO: 36033 - DNA, 1031 bp, Homo sapiens
tcgagcctgaatctgaatctagatctgcttgactgcaaagctcatcatgctgttttatttgtatacttttatatcatatacatattcagaattttatactataactaactatagatcacagaccacatttttaagatagctaaactgagctgggaataatgaatgggtaagttgcaaagttaaacaagacagggcttaactttccacattttagaaaaagaaaatctttacctggatgagatataattggtaacaactatataaaaccgggttctaaagtgaatgcaccaaatatctgtgggtgcaattcttaatgatcttaacacaaataggtgagagaaaaccaaagaaatctcaaatttgattaaatttggggaataagagaaatgaaaaggcccgtaagtgctaaaattgaaatatacgtttagtaaaactcctggtaaagtaaatgaaggttttactggggaaacaagcaaaaaaatatgtgtttcacataaggagaatagaactgcctacaaggtgtaggaagttaaatttatactgaaaattagagaaaaattcatatttgagttgcattttatagatgactccgaagccattagtaaaataatttattagtggagcccctttatcctagatgcatatgtttctaccacaaatgaaaaagttaatgctaggaaggataagattccaccacttttgtttttactaagaaaggaattaaggaagagaagtatttcagcaaatcatgaatatactaaataaatgcaaataaattattaggaataggtggtatccaacaagattttaaagataagaatataaaagtacagaactattgattattatgctaccatttgaaattgtgtttttgaaaaatatttaatgaaattaaatatatattttgactggagcatagcagaactaggaaatgatgagagagctagcaaaccatgaaggacttttgtgccatttattagtgctgggattatctcttgtcgagagatttacatactagtggagaaagagat

SEQ ID NO: 36034 - DNA, 1027 bp, Homo sapiens
aacacatggactattctccatttttagtttcaaaaggaatgtttacctatcatttttaaatctgtaggcatctaaaaaaaaaaattttgcccctccccaacctccactctttatgggtatgcactattaaaaatttgcacatgtcctttctaacatttttcagttgcttagaaatacatattgctctgcagcttgcgttttgcacttagtatatcattcaaattctttccttgttgatacagaagtttgacgtattctttttagtgggtatattgatagacatatcataatatttttatggaggaatgtttttaccaattttctatagatagaacaaagttacaatgagcatatgttaaattttaaactttgtttctaggtctcacgctgttgcatgtgtcaatcagtttatcatcagtaggactcaagctctaatgttgcacattgattcttttattgaggtaagacttgttcttgtctccctcccaaccccccagctttttttttttgagaaggttaggtgatgctaactgcatgtagttttgctttaaaacaagaatcatttataattctaaactcaatatttaattaaattatttctgatagtattaaaactggatatgggatagactaacttttgttagctgagaaggcacttttactaatttttctacttgtatcattctacaaacactgattttggtggcggggtatgtttagtatcttgactactttaaaaatttttccttcaatatactgttcaaattgcatatggaaaccaagtccctcagctcatgcagtttttgaaatgtgaaaaattggtgaggttagattaagttcatttggtagaatctgaaggcacagactacaaggacagtattttccattggtttccattgtaaaattagaggcatcaggaaaaatagactctttaggcattttgaactttctgataaaagtggaaagaaaagagcataattttctggccaggaaccataagcaccacaatttcttctcaaaatctctg

SEQ ID NO: 36035 - DNA, 2039 bp, Homo sapiens
tgtttttctaaatacttttgattcaagattggttgaatccatagatacagagggccaactgtatatatattactttccggcaggatctcagaatgtgcccagtaaagtccattcacaacattgaccaggatgggagcatgaaatgaatctcttcaatttgagggaaaaatatgaacacataatactcaatctgtcctttaaagataatgtttcttgtagaaacgcttcctctgagtaaacctgacctgattggctggcaaactaacaacaatgaatggcttccaaaagagagggttggggtggggggaggggaacctgctactgtagaaactagtagagcaagctcataaatgatcaggatcctgttgagcgcagtttcaagcattcatcataatcttcagtatacccagaaagtttagcatgtgtactttattcttcctagtgcctatcttcagttgccacagcactgcagtctggattccttccgtactgtgaacctgtgtatcagcgttgtgtaaacctagtacagaagactcttgcacaagccatggtaatttttttaaaatgtcttcctcttcttgacatggtggacatttttctaaagataggtataatgtatacagactttttaagtagttaattaaaaccaaacttacaaaaaacattgtgtctaatttcagctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctatgaatatggttttttaaagttaacatttacatcagctttgtttttttattattaaactgaaattgcatggaatcccaacatttataaatgtacactttattggttaaagtaaacttgctgtgattgaaacaggcaagatggcaggaacccctaatatttccttgagcttgccatcatctcagctttttaggtactcctgtgactggaggaaagcttagtaatatactttagagtaaaggacatgcccaccagggaagccttggtaccatggactagttaatagattcttttttgagtagccacctttttggtagaggtacacagaaatagtaataatcaggttttcttctctagcaaaccagcatactttttcagatattgcagaaaacttccaacaaatgtcactttaactgagactgggcctgggggctcacacctgtaatgccagcactttgggaagccaaggcaggcagatcacttgaggtcaggagtgcgagattcgagactagcatagcatttgtcttggccttctgtgacaatgataagaaattccttgaatgttgtacccggaattgttcttaaacctatgggttataaatgagttatgggatttttttcccccttttctgcatctcagcatgttgggtaacaattattttaatacagccgggcacggcggctcagacctgtaatgccagcactttggaaggccaaggcgggcaggtcacgaagtcaggagatcaagaccatcctggctaacacggtgaaaccccgcttctactaaaaatacaaaaacttagccaggcgtggtggcttgtgcctgtagttctagctacttgggaaactgaggcaggaaaatcgcttgaacccgggaggcagagtctgcagtgagctgatactgtaccactacactccagcctgggcaacagagcaagactccgtctcaaaaaaaattattttaatacttcatttaaaccttaatttaaaatattaattgaatgttttgtcat

SEQ ID NO: 36036 - DNA, 1060 bp, Homo sapiens
cataaggcctggcgcggtggctcacgcctgtaatcccagcacttcgggaggctgaggcgggcagatcacctgaggtcaggagtttgagaccagcctggttgacatggtgaaaccccgtctctactaaaaatacaaaaattagctggcgtggtagcgggtgcctataatcccaactatttgggaggctgagtcaggagaatcacttgaacctgggaggcagaggtttcagtgagctgagattgcaccactgcactccagcctggtgacggagcgaaactttgtctcaaaataaataaataaaatataaatttttaggtgccttgatatttttgtaattgctttaattttaattatttgtatttctatatttatatgacatgtcagagttaatacgggaagcaaaatatttcacattgatattttaacgttcaattttttcttttttgtttttttctttttgggatgatctctaggtatagagatgcagccttatattcctatggtgttgcaccagcttgtagaaatcattaacagacccaacacaccaaagacgttgttagagaatacaggtaccatatgactgaactgtttcagtgaagagaaaatttgttgccttttaattttaatatgcgtagagaaaccaaagcaaaactagcttttaaaatcgagcttattttgtatttaattgctatttcggattttcagtaatgaaatagactgttgcagctacattctataaccagttttcagtggttatatattcagtggtataaccagaaaaacacttttttcccctattccagtgttttaatacttcctgcaatggatcccagcaaagataactattgaaccacctgaattttgcttttaaattaattcggagagtaactgggagctgggaagtaatttttttttttaatctgtccaaatgtagtcaaaaagattcagtggcaaattggttaacagtggcatttgtagtttgtatttcatcatataattttcttcgaattgggaatttaggcagtatgttatgggattttttttttaatttatttttttt

SEQ ID NO: 36037 - DNA, 1048 bp, Homo sapiens
ttctcaacattgcttcaactattccttttttctttcttttttcctgcaagaagacatcggcactcatagtgatggggtaaaattgatttcattttggagcatgaatttatagtctctgctgtaacaaggacttttcatttcacgtgctttgaaagaaaactcagttgggttttggcccactgtttttgtttttcactgtatgtttcactgagtacctaccatgtgcccatcacttttttttttcttttttttttttttttttttttttttttttttttttttgagacagagactctttcgcccaggctggagtgcagtggcgcaatctgagttcactgtaatctccgcctcttgggttcaagcaattctcctgcccgagcctcccaagtagctggcattacaggcacatgccaccatgcctggctaatttttgtatttttagtagagatggggtttcaccatgttggccgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtacaccaagttgaattacactttagattgaattggaggagtttttttggcttgcttgcttgcttgtttactccaagctaaaatttaaatctggaaagatttcaccatccaagctgtctaacctagaaggtagtag

SEQ ID NO: 36038 - DNA, 1029 bp, Homo sapiens
tgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaac

SEQ ID NO: 36039 - DNA, 1044 bp, Homo sapiens
ctggtgtattaaatgtgcaatagcattttatctaaaaatgtatataccttaattaaaaaatactttattgctaatgctaacagggaagaagtgagcacatgcagttggaaaaaagatactgatagacttgcttgacacgattgccacaaaccttcaatttgtaaaaatgcagtattttcaaagtgcagtaaagcaatgctcaataaaagaaagtacagtaaaatgaagtgtgcctgtattttacctccagctccctagcagttttcaaggccagagtggcactggagagctgtcattgcatgtctattgagttctcatcaaagcgtatctgtaggttcttcactaaaggggctgttcttcaaagaaaaaaatctttaggattagtaaaatgttttttggtgtgtttcagagaagtcaagataaagtgagactgtatcaaaaatatgaatgttatattgtgcattgacttgtccagggttgtctattaaatgtccataagagctaaattaaaaggaaaatgtagacagggtgggaagttatagtatttatttatttttgaggtggtttagagttgagagggaggttaggcatgttattggtgtttgcaggatagtacctcctgacccttctcttacccctccaaagaactttttgaaaaaaaggaaacttggtaaaaccaattttttaatcagtaatgtgattatacaatatacaatctatcttctgcctatttttcaaatcttggactcaccaaaagtgaatgctcgccacatgcagtggctcacacctgtaatcccagcactttgggaggccaaggtgggaggattgcttgaggctaggagttgggagactggcttgagcaacatagcgagaccctgtttctacataaactttttttaaaaaactgaatgctatccaggttttttatttttagtgtctaatttactgttactcttaaaaagttcaccgaaggagaagtttcaaacccttatctttttgtttttttagagacaggttctcactttggccaggctggtcttgaac

SEQ ID NO: 36040 - DNA, 1053 bp, Homo sapiens
tttattgagcgttttttgcgtgaagtggtgctgaattttgttgaaggccttttctgcatgtattgagataatcatgtggtttttgtcattgattctgtttatgtgatggattacatttattgatttgcgtatgttgaaccagccttgcatcccagggatgaagctgagttgatagtggtggataagctttttgatgtgttgctggattcggtttgcctgtattttattgaggattttcgcactgatgttcatcagagatattggcctgaaattttcttttgtgtgtgtgtgtctttgccaggttttgatattaggatgatgctggcctcataaaatgagttagggaggagtccctctttttctattgtttggaatagtttcagaatgaatggtaccagctcctctttgtacctctggtagattttggctgtgaatccgtcttgtcctgagctgtttttggttggtaggctattaattactgcctcaatttcagagcttgttatcgatctgtccagggattctacctcttcctggtttagacctgggagggtgtatgtgtatgtgtccaggaatttatcaatttctttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaatttatcaatttctaatagattttctagtttatttgcatagtggtgtttctagtattctctgatggtagtttgtaattctattggatcagtggtgatatcccctttatcattttttattgtgtctatttgattcttctctcttttcttgtttgtt

SEQ ID NO: 36041 - DNA, 1050 bp, Homo sapiens
agctactcaggaggctgaggcaggagaatctcttgaaccggggaggtggaggtttcagtgaacaaagatcacgccactgcattccagcctgggcaacaagagtgaaactcagtcttaaaaaaaaaaaaaaaaaaaaaaagctgggggcagtggctcacgcctgtaatcccagcactttaggaggccaaagcgggcggatcacttgagattgggagtttgagaccagcctgaccaacatggagaaaccccatttctgctaaaaatacaaaattagccaggcgtggtggtacatgcctgtaatcccagctactcgggaggctgaggcaggagaatctcttgaacccaggaggcagaggttgtggtgagccgagattgtggcattgcactccagtctgggcaacaagagtgaaacgctgtctcaattaaaaaaaaaattgtagacacaaggtctcatgttgcacaggctggtctcaaattcctagtctcaagccatcttcctgcttcggcttcccaaagtggtgggattacaggcatgagccaccacacctggcccaacttcccttttaataatgactataaagattgtcacttttttatgatgaggccattcagtttctataattctaccttaagaatttatagcattcctaactaagcataatatgttatttagaaagttgttttgacttaataatttagtattgtgtagctgtttcttatgaaagatgtttcttgctttcagaaaatatacatgtttctggtggggcatggtggctcatgcctgtaatcccagtgctttgggaggccagggtggagggataacttgaggctgggagtttgggaccagcctgggcaacgtagggagaccccatctctacaaaaagtttttaaaaaaattagtcagtgtgagatcgcaccattgcattccggcccaggcctacaacagcaagactggtggcacatacctgtagtcctaactactcaggaggctgaggcaggaggaggattgcttgaggccaggaggttgaggctgcagtgagccatgattgc

SEQ ID NO: 36042 - DNA, 1002 bp, Homo sapiens
aatatgttgaaatcctgtctctactaaaaatacaaaacttagccaggtgtggtggtgcacgcctataatcccagttatttgggaggctaaggcaccagaattgcttgaaatgggaagcagaggttgtggtgagccgagattgtgccactgcactccagcctgggtgacagagtgagactctgtctcaaaaaaaaaaaaaaaaaaaaaaaaaaagagagaatgtacttacttacacatacctagatggtgtagactgctacagacctggctatatggtttagtctgttgcttgtaagctacaaacctgtacagcctgttactgtactgaatactgtaggcagttataacaaaatggtatttgtgtctttaaacatagaaaagatatagtaaaaatcagtataaaagattaaaaatgctgcatctgagtagaacacttatgttgaatggagattgcaggactggaagttgctctggttgagttagtgaatgagtagtgagtaaatgtgaaggcctaggacattactgtacactactgtagattttataagcactgtagatttaggttacattaaattttattaaaaattgttttcttccttcaataataaattaaccttagcttattgtaacttctttagaaacttaaaaaaattttaaacattttgactcttttgggatgacatcttaaagtagaaacacattgtacagttgtacaatagtattttctttatatccttactcgatcagctttttttctgttttaaaatttttatttttttttaactttttaaatctttttcctaaaaactaagacacaaacgcacacagtaaacatgtgcctacataggcttagtatcattaggattgctcttttatctccacatcttgtactactggaaggtcttcaggggcagtagcatgcatagaactatcatctctggctggacttggtggctcacacttgtaatcccagcactttgggagggcgaggtgggcagatca

SEQ ID NO: 36043 - DNA, 1082 bp, Homo sapiens
caaagtgctggaattacaggtgtgagccaccgtgcctggcctctcagagcttttgatatatttattgtgaaggcaaggcaagcagtggtttcctctctggggatatcagagtaacttggaaattttttccaaacaactttctcatctctttcaacccccattacccaggcagtactggaggatctatttgttttgaagtttgaaaaggttctccaggtgatctaacacatcctcacttttggttgagaactgctgaaatagagtatataggctttcccagatttctttgatgacagccatctcttttggggattgtatattattatttcttttttcttttttttctttttctttttttttttttgagatggagtctcactctgtcgcccaagctggagtgcaatggcgtgatctcggctcactgcaacccctgcctcccgggttcaagcgattctcctgcctcagcctgccaagtagctgggattacaggcacgcgccaccacgcctggctaattttttgtattttgagtagagacgaggtttcaccacgtttgtcaggctgatctcaaactcctgaccttgtgatctgcccacctctgcctcccatagtgctgggattataggtgtgagccaccgtgcccggtgtatattattatttcaaggattagaaagacattttgaaaatctatgggctagattataaagcatttgaaagtaaactgtagtttttgctttgccaactgattgtttttcagtttttaaaactctttgttttttttgtaacattattctcttctgggtctcctaattttctgatcacgattatagattttaatgtgtaatggctccaaattcggctgggtgcggtggctcacgcctgtatcccagcacttttggaggctgaggcaggtggatcatgaggtcaggagatcgagactttcctggctaacacggtgaaacccgtctctactaaaaatacaaaaaattagccagcatggtggtgggcacctgtagtccaagctactcgggtggctgaagcaggagaatgatgtgaacctgggaggcggagcttccagtgagcc

SEQ ID NO: 36044 - DNA, 1028 bp, Homo sapiens
taagtaccccattcccttccctgctcagcatacttacagtcctccagatttctttaatctatttattagttactatatcatgttcttgcaagatacatgtttcactccataagtaaaaataatttagtgcattaaagaagttaaaatatgatatggcattccagaaaatgggtaagagatctgtgaagtttgggaaccatatttcctcagtgcagttcatagacctaaggcttgaaacctaaatcatctttaatttcttcttcccaaatttcattaaatttttaatcttactgattcaattgtattagtatttttcccttcagactttcttttcatgttttctctagctgcctaattaatttgcagatttcatactggtacagcagacgtttcttctccaatctattttacatgttatagcacactcatcttttgcctatacagttatgaacttataattgtaccacttacaaatctttaaattttcacgttgacagaatgaaagtgggattctggacttggtttcagagcctttaaggatctcgagctgaccagattttagtcttaactttcttctttttttttttttttgtttcaaccacaagtgtttattgatatattttaatggaacaataaggcacaaccgtggattaaaacagtttgctatacagccaaaagaggggaaagctataaccttaggaactttagatatgcaaatcaaggagcctctgaagtacctctctatagatcagtgtcagacattcttccgttttcacttgatcacaaagtctgactgatacttcatgaagaatttctcattcatttatatttgagccatccagcccagctacttccctgttctctacccttttccatcactttgcagtggtattttttttagcaatccccttcctaaataattatgtacacatcttcaatagttttccaaagcaaggaaacaagcacgcaagcagtgaatcagagaaagtcagccaagggcagatgtttggataaatagactcataggg

SEQ ID NO: 36045 - DNA, 1045 bp, Homo sapiens
tcaattgattagtaagtaaatgtttaaaatatatctagttcatctgttagtggctatattgtaaagaatcatggccttaaattatttttataatgtataggtttcattactgttcatgtagggagcttatagtattttttaaccaggtttttaaaacagttttccttatcaataatttcccaatatgatattaagccacttagggtggttttttgtttttgttttttaaccaatggcaatagtagagcagaaagccactgcttaaaccactgtaccatcatcaccttctttcaaacttcttggcaggaaaaaatgttagaattcactttgcctgaaatgccagaggctcttggcatgcctcttcatagcctgaaggcttttgagatgctagtaattgtgggagacaggcccttttcagagcttcctcttcctggagcttcatctgcaggtgtcatacagcccactgtgagggcaaacagataagtactttaccccaatgactggagtgttttggcctaaagccagagaataaactctttggaactttaacacttccttttatgttcaaactgcatcttttttaaaaaaagaagaaagtagaaatgttctaacatcttgattaatttgattctctagaaggattgggttattattattatgccttttctggaacatttcttcagattatgcataagtttagaaaaatataatgtttctcatctaccagtaaggaagctgtatttcaaaatgtgcaattttaaatgacttttaagtggatagaaagtcacctggggggccaggcccggtggctcatgcctgtaaacccagcattttgggaggccgaggagggtggattacttgaggtcaggagttcaagaccagcctggccaacattgtgaaaccctatctctactaaaaatacaaaaattagccaggtgtggtggtacacacctgtaatcccggctacttgagaggctgaggctggagaattgcttgaacctggaaggccgaagttgcagtgagccgagacgatgccactgaactc

SEQ ID NO: 36046 - DNA, 1028 bp, Homo sapiens
gaaggataattattttaaatagaaaacagcgtatctatattatttcctgtagagctgagagacatgctttaaacttcaatacatggctacaacatttttcagaaatcaccaaagccaaaaagtaacttctgattcagaatgttaaacggtttcactggcattctctgtcttattaaccagaaagcgtttataagatgagtaatattgaattttacctatttttaagttgtgtcacaattacaaattctattataatttaattatactaaaaattatactaaaaacttttctaaggtgctaataccttttgcagaatcatgcattaaaaataacaagggttgtgggaaaaacagttgaagcagcccactcaaaagctatgtaattttgttaacagaagacttaacagaaactttaacatcagttttattaaaaattctaacagagtttaagagacctagtaaatgaataataaataccaaaataaaagtaaggattttatctttaaagaaatgttgattgtagcttaatgatagggggtgtgaggaaaatgaggataaatgcagggtgctgagttgtggagatgagagcaaaatgcagaaatattgaagaatagcacaataaacactgaggcaaaacaaccaaccaaactgagccaagtgaagaatgtagagtgaatggttatcatgtactgtgatactcctccatagtttgtggaagttactcatattgatgtactttgcattcatcaggtattgcttggtgatgcaaagaaaacatgaaggtgcagcaaaaattgcttatgcaccaacatgagtttttcattaatgatgctattcccctgtttaccacttgcttgtgaaatgaggcacattacaaatccaaaaggtagcaaaacaaactatcttataaagagacttgctccaggttgctgtaagattcttaatttttcaaaatatgacatcctcaagagttaataactactttttgtcaatacaataatcactaataatattcttagaacttgaaaa

SEQ ID NO: 36047 - DNA, 1024 bp, Homo sapiens
cacatagaaaaacaatggaattcattgtaatatattttatctgctatataaaaatattattttaacacattcaatatgaaaattaatgagattttacattccttttgtgtgtatgctgtgtcttcaaaatttgctctgtatgttgtagcacatctcaatttggactagtcacatttcacgtgctattggccactgtagtagatagcataattctaaaattagagaaaaccacttgagaaaagagctgtttttgccttttcctaaaaaaaattaaaaaggcagtcacattatgttggcctagaggttatgttgccataggagaaatgtcccacagtagttgatctcaagactttttccaagcttgtaagtttcagactagctgttgatcagtatctgttcaccccaatgtcctgcaccaccttggtctgcgtatatacacagctgcatttttagcatcctgctgagttttttcaacctattgtccatcataatgagtcatcaaaaagctgtactctggaaaaaatagttaaatgggtagggggttacaaattgtaaaacactttttgcagtaaaatgacagttttattaaaatgtgtatctctaagtttatattcatgcaatgaagaattgactagtgtatgaatgcaagtagggttttgtttttgcctttttttcatgttcctcaaataactgaggacagttatctttcttgttcacagctttgtatctagtacctaatccagggtcagacacatagtagacactaaataaatatatatttgcctaatacttttataagcaggaaaaggtttttgtttttttttaaatgaagacaaatacgcctattttttaagaaagcaaaacacctcaggaagtgttgctactgaattattggtacagttaggaatttggaaggaaaagaatctgttcaccaaagtaaaagataaatgaattggagttatattttttatatttgttttatgtttaattagaaaattgggaagacaacagaattgagtcgctc

SEQ ID NO: 36048 - DNA, 1006 bp, Homo sapiens
tgaaattgtaattgcaaaggtctgcttggcgtttttcaggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcat

SEQ ID NO: 36049 - DNA, 1083 bp, Homo sapiens
agtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttttgtacttaatagtttggagaggttagtaaccagtactttttttttttttttgtagccatagatattttcttcagttaaataacaagatttatttaagcctttactatgttggatcctgagaatataaaattttaagaagtttaaagtccctaggtgggctttaagcctagcagtggcgataattgtcttttcttaaaaaaatcttctttcacagtgtaatatacatagtacaatagtagaagcattttcaaaatctagagatgggaatgatttggcatagggaaagggggtaattgcagaatttaggaaaggcaaacaggaggtaatgacttgaataagattttaaaggatgaataggaatagggatggaggttgggggacggtgaggtggttgggtgtgatagactttccttgagtgccttcagtgagctagatactgttgtagatactgggtttatagcaataaacagaagtccttatggagcttacattctagggagaggagatggatgataaaatgtatttatctcttatagtaataagtgttatgaagagaaataaaccaggatagaaagaaattgatgagtgagtgtggaagttgctattttactttgggtagttgagaaagaccactttgatcaggtgacataagagtagagatctgcagtgagggaaagagccatgtagatgttccggaaggagaggaacagcatgtgcaaaggcccttgggtcatagcctgcttggcctgttcaaagaatagccaaggtttattggctaaagaagagggatggtagcagatgcagtcaggagtggcatattaagggcaggacagtttgtgtagggctcttgtaagttaaggtaagggcttcagactttactatcgagtcctatagaagtctatatacagattcatttgattgttccatacactg

SEQ ID NO: 36050 - DNA, 1087 bp, Homo sapiens
aatatctctggtattgaagaggcaagtatcaaattttgttactttaaaaaacaagatttggctgggaaaagttaacgttaatgcattaaatgggttgttttttttttttttaacttagggacttcaaagtccctaagatgtgtttctaccataaattaataaatatcagggagctcattaagtctgaatgctattagaatacatattccattccaggcaaaatttcacctgtgcttcacagtgaaatactagttagccagacttagtttaataaaacatttgtttttaaagagactggtcagcattgctaatttaaatttttcttttcttaataggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatgtgagtttcctagtaatggttttaccagggaattactcatttagcagctgatttctgatctcagggctcagaatggatatgagtatttttaagtttggaaatgcaagctttaaaaataacagatttgtaactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttcatctatatagttcgtattaccagtaatcttttaaaaatggcttgccagtattctggcatttttaattacagtgtgatagggattttattcggggcagaaaatagtgtagctgaatatacatctgaggatgtggcagtgttatgctgttttctgtgcttaaaattttgaagaataggaatgcaggaggaagtcagagg

SEQ ID NO: 36051 - DNA, 1077 bp, Homo sapiens
tggacatagatcttacttagaatgagaaaaataatgcagtattaggtaattgagaattatgtttatagacttgacttggcttgtttctgtttgggatcccaaggatgtgtaggtatctaaccttaaatattgaataaataagtatatatatatagtaccctaaatataactattacctgcagagcactaatgacccttgctccctactttgaaactcatgaatttacaagaaggtgtggagttgttcaggtatcttgggatatatatatgcattctaaaatctgtagcagcataactcctttgggaatcatgagacatttttgtctcttacctgttattggataaatttacgttcttctaaaatatttattgggcaggagaatcactggactcataaatattcccactttgcatagacaggtatccttaggaatccaggaaaattttaacattgtgtgtcattgtattctttggttctgctcccccactattgaccaatgtatgagatgggaagaggggggcatttttttcacttttttttttttttgcattcttgttcttggggctatgacacagtatttatcatcattggcaaatgaatgtctttccttcatccccttttaatatctgataattatttgtagatttggcttttttaagaatttctactcttttccttttcctagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatat

SEQ ID NO: 36052 - DNA, 1064 bp, Homo sapiens
tcgtggtgttactaatgtaaagttttcaggctttttggaatagatgatgagcagcacctctggaatcatttacctgataacattgaatctcttttgcaattgagtcgttctggaaaaatgttttggcttgattgcatgttatttaaaagttttatcctattctgccactttagtgttgaatttaatttcaggactgctttattacagttttctttcctactgtttaaaccttttaaagtaaatttaattttaagcttctacattagaatattagctttgtgtttcttacttcttggcatttttaggctttcaggaaatcaaatccgtaactataattgttatagattaaatgtcatcttaaacttggtttcaggaaacttgtatttgcagtttcaccttaatatttcctgttgccaaaaaatggacactcaaagccagcatgatcctttttggtttggctactgtaaggctgtgctagatttattcctaagtgttgtaaaatggttggctaggtgtgagaacctttgtgtacagctgaatagatggtgcgatatgatagccttcactttaattattcctgcttcctatagattgccttttctgggttagaattaaatggcttattggtctctaatctatatacttccacacagactttttaaagaaagcagagtgaaaatcaactatgtgtacaagcttataatatgtatataaaatattttatttttcagaattaaggcagagtcactgtaattatttctaataccaattccaaaatagtgactcttggacaatagtgcaattatatggaattatggctggttataagcctgtagctattcagacatatcctatacttggtgaaaaaatcacccaagatacactgtactggaacaactataaggtgagtgtgggacgtaatgagggagaagggatttgtgtttatgccaatttctctagcatatgttatactctggatgctctaacagagaattattaactgaaaaccatctatcagcagcttatagtttgggcagataatttgatatctattttttcttgga

SEQ ID NO: 36053 - DNA, 1050 bp, Homo sapiens
gcacagaacagatgatcaatcaatgccaaatgaattaaattttaaaatttgaatctcatatgtgtaaagatgtttattgaagtattgcttgtaatagtagaaatcttgaaaaacccatgtctattagtagtggactggtatagtaaattacagtgtgcccttataatggatggtaagtctattgctcctatgaaagctaatatgtgttactaagtgaaaagaagcaagatgtggaacagcctacatggtatgattatctttttgttattttaaaagtacaagtacgtggttattgtatgctggtgtagacatgataactttttttttctggtagaaatcacagtaaactcaatagctgaagagacagagtggggtgtggctttctaaccatatgtttatttcagtggcaacaagaatagtctgggtgatgagatatgtaccttttttgctttctttgtaattttatgttaaatacaacttaagaaatgttactaagaacaaagagaaacggtctgtaagaaattatgtaatgcataaataggtcttaccagtggtaactctgttaacacactattattttttattaagacccctgttcagattaaggaatttggtgcagtttcaaaagtagacttttctcctcagcctccatataattatgctgtcacagcttcctcaagagtaagtataatattaaatttctttatttttcttttgtatagtttactactgatcttgagccatctggtgaaatactgtttttcatcttgtagattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaagtaagagacagttggtttctgtgtgttctggttttattttgttgtaagctctttttttctctggactttggttaaaaagatagagatcagtt

SEQ ID NO: 36054 - DNA, 1106 bp, Homo sapiens
ctccgttccttatctcctgactgtcttcctgggaatctgcttattaaattgttcatgtcagttggatggttaccctcctttatttctctcgtctttaaccttgtcttcttcacattgtagccaatctccctattctcttccctgtagctgccaccatctagtcctttctgggaaatccctttatataatatgaatataatatttgcgaaaactgtaatgattacaataacttaagtttcaggcagtatagccacaccaccaataataataatgtagaaagtggttgtgtttttatttgttactgaaagttcatcatttgttactactttcatttattcagtaaaaagttaaaagtgccaactgcatgtcaggtattgcactaggtgctggaaatacaacaagaagagagctcatagataaggtagaagaaaggtaaatcatgatgatagtgtataagcctttgaaagagtgtcatgtgtaagtttattattgtatcaatcagagcaataatgaactgttgctgttggacatggaaatgatgctattacactgaaaatagtatttatcaatatggaatttgtctttttttgtgtgtgtgtgtgacagagtttcactctgtcaccaggctggagtgtgctggcgcgatcatcttagctcactgcaatctctgcctcctgagttcaagtgattctcctgcctcagcctcccaagtagctgggattataggcacgcaccaccatgcccagctaattctgatttttagtagagatggggtttcactatgttggctggtctcgaattcctgacctcaagggatccacccaccttggcctcccaaagtgctgagattacaggcatgagccaccacactgggccaaaatttgtttttggtatgtatactagttagcaggattatagacctcccaaagttatactcaggtatgaagaagaatgtagtttcttcaggtctttctgagagccatttgatcctcctgatcccctgtctgctgggtagcagaagatgacaaaatgactctgctctagggatgttgtctgatgcaatgatctaaataatttgtttaggtcttgcatgctcatttacttag

SEQ ID NO: 36055 - DNA, 1026 bp, Homo sapiens
attgtgctgacttttatagtagccatttccttgcttttctttacagtgttacaacgtatgtatatatgcctaagtaataattttaacttttactcttcttgaacttcatattaattgaaacatatcctgtgtattttgtgacttgatttttcccttttgacattatattcattacttccttctgtgttaatctgtaattcattttgattgttagaatattgttgtatgattgcactgcaatttattccattgatgaacattaagattactttgaattttgaccatttatattttttgcatggtttcttgctagggtttataggtaggaatggaattgttgtggactggatttgcgttagtttctctgactttattagataatgttgctgtgttttccaaaggggttgtaacagtttacatttcctctagcagtgattgtgagttctggagaccttggttaattatttaacctattttattattttttaatagacattttaagaacaggtttaggttcatggcaaaattgagtggaagatacagatatttcccatatattccctgcccctacacatgcacagcctcccctattatcaatacgccccacagagtggcacatttggttatgatcgattagcctacatttgagaggttaatttattctttaatcttccaagctaagcctttggctaattgaaaggtatggccagatcttgtgtggatatggtaatggttctaaattgaccagtaacaaaaccactttcctttagtaacacttaaactgtctgaccttccttgcccttgtgcttcagatgcctggaagctttgacctgtgctgtttttgcagatagtaaccatagagttaggacaggattgaatactcttaggaaccttggatctttattgtgacagactcatttcatgggcaaagaaactgatgcccggcagagtgagaagcacaaactccacactcccttcctatctggggcagttggactcctgttatgcagtaaggaatggcttatt

SEQ ID NO: 36056 - DNA, 1034 bp, Homo sapiens
agatcatatctgttttccacagtaatcacctaataaaccactggctgccagctaatttgttctactacaggtagccccattaaagtgagaggcatcttttcagattaaaaggagaatgaaatgttgaggtaaagtactatgtttaaaattcagtactgtttcattctttatgtaaacctttaaagtatgtagtatatgtcaatggtttccaatagacttcttctctaggtggaaaaagaaagatggctttattagtatctgtttttatgatcttatgtatttattgcacgtaggtgactttcaaggatcattttgccagttggatttgtaagatcaggggcagtgatcctaagggctgggatcctggggctggtgtctttgaagctctgtgtgggttttgatttgtgttgtttcagttttcagggcagatggtccccaagcttctcccgagtgcagctcagtgaagaagcctccttgcattacattcactcatcggaaacgctgaccctgaccctgaaccacacagccgagcatttgttggaggcagatattaaactcttccggaaatacttttgggatagagcctttcttgtcaaggtttgtacatagtgattctagcatgtgataatgcatgcttcagagaatgcaggcatcaatttcttattatgagaacagtgttttttgggggtaggactttttttaatgaaaccttgggggacatgaaattggaaactgcattagatcagtagaatgaagattattatatattttataggagtttgtataatattttcattttcttttctgagccagtcttttccatagttgggttttaatactttaatattggatattttcattaatttattgattgtattataattattatctaaagcagttacatttagggctatcttacatgtataatatctacttctggattatcatattgctcaaatgtagttaagcatttgttccagtgcagaatccagtacagaatccagtacagattctgcttgaatggaaacaggtaa

SEQ ID NO: 36057 - DNA, 1034 bp, Homo sapiens
tctagatacctcaataatttattggagtggactttataatcacaaaggccaaatggagatggctctccagtttctatgagattttcatcttatgaaaaacacttgatacaagaatcagttagagtggaatggccttatgttccaagtttccacatccctctttttccttcctttcttgaggtgtatggctgatgtgagcagagagaccgagaaggaagggctgagagattctttatggcttccgaagaccttaattcttacttgcctgacaaagggattctattgtattcttatctaaattttttgtgatgcatattacttggttagatattattttaaatataagcaggtggtaattattttataggttgtccacactgaagctttacaactttggatgataaatattatgagattacatatagattttgtataaaaagtattcctgctttattgaatcttatctaaaagtctgtttttatatgacagctatagatggtgactttgatttgagtgactgatctgtactcactgaactacagcccatactcagtcttctccaaggggacatgtttagtctccgggtttgggcattgcttagttatctgtagtcctgtagaacaatgacagtaaaaccttgctgtggaaacctgagtttgctttacaatatataagagctctccaggtgaacccagtcagaagccatactttcagagttgtaaagggttcatactttcgcactacatttcaattgacagtgatggcctgacagtttctaataaatattaaatgttaaaatggaaggtggtgctaaatatccaaactgtaaagacagaatattaggaaattaaataataggcaaactcgtagccgtatcttttaatcactttttagttatttcctcataacaatccaaatgctgataatttcactccacagcttggctaaaattaataagcagctaggaaatttaagtttttcaaggtatattcaaaattacttataaggataaaaattaagtttgaatatattct

SEQ ID NO: 36058 - DNA, 1023 bp, Homo sapiens
attggcatggctgtacgtgaagcaagttgttagaattctaccctgacagctctgtaaagttcactttggtgggagtatggggaatggatgggagaggcctagtggaagatggggaccagccatggggctgctgaaagcaacgcagaagagaatctgccctacagcagtgtgacaagatgggagagttgaggacacatgagtgaggtcctgaaagtgtaggatctgattggctgtcagtggtaagggagaaggacggtgtctccattcctggggtgtagcactgggtgggatgggccttccaggaagcagaattgtgacaaaatatacgttcagttttagacaagttgaatttgacaggtgtttggggcagccaagttaatatacgtggctgccagtttgactgaaattaaccaataagcacaagaatttggacagaaatccaagccctctgactccaaataattaatgggtatactttagagcccttgaatctagacaatgcttttgtatttgtctacccttgaaagagtactagaaactgtatgcatattccagcagagggcaatattcaactaaagtggaaacattcaattagtttttgtccattcatgagtctggaggagactcaactgaaagaacaaaacattttgagcataagagcttcctcttaaaaaaaaaaaaccaaacaaaccctaaagcaaacttcctctttaaaatctattagaagattcttagtagattatgcttttctgtcccctctgggacaatgtgtagtaggggggaaactctaagcttatatctgtagctgctattaattaaaagactataataattctagcctggacattaactttgctgtctctgtgagtgtgataaatggttttattattgcctacgatccagttatgtttctatagttttatgattctagttgtactcccagaataatggcacattatttcaaatgaatggccaaaaagtcttcttattttaatatgctcctattaataagctaattattag

SEQ ID NO: 36059 - DNA, 1034 bp, Homo sapiens
atgtgattacaagagtaaatgtgggagatgtcctctgagaataaaataacctgtgtacagctttcaggtgtgtttcagcttgggatagattcattactcacttttagctgttaaataatattaagtataagactagttttctgtttacatgtgatgatacttgtaacatgttttcattgatgctttccaaggttgtttttctagttcacaaaaataaacattagtgtagcatatatgtaattttttaaaaatccacctgactttatctcttccagcgtgtcaaaagcctggtggttcaacacaatgaacatgaagaccagcacagcctagatttgggtatgaaataacgcttttacctatactcgtaggggcatcccagatccaggtttagagtggacaagaagcaagtaaattttaacataaaatattccttcctggtaaccttatctatttcctgaaacgcatccagataaattttatttgtaggatcatttgtaatactatgactctagaggttgagactccatttacaatctaaaaaacaaggcaatcaaagcttttcctgaacagttttactctgagccagaagctggctctggacttgtcatatgttcccttgttatttctgtgaagtaggcactaccagtctcaggttcaggtgaagcagttgaagcactggtggagagtagatggtggaaccgagactcataacttcattccacctggccctagaatctccaagcttaccaaaatcccattttgatgcccagtggggtccccttggagctgagcctatgtgatctacactgctgagctcaggaaaagaccagatgtttgttctgggatttgagtctgatgtgagtgtcctttcagaggaaccaggtgttcctccacccttggcaaggtagaggtatttcctccctctgacctgggaattctcatctgattacaatattctgtttcacaactccctgaggaccccttcctaaatctcctcccaggtactctctatttcttcaaggctaatttggacc

SEQ ID NO: 36060 - DNA, 1095 bp, Homo sapiens
tccatctcaaaaaataaaaaaaataaaaaaataaaaaataaatgaagaggatcttaagcatggcatcttagaagctgtgacccctgtgagtggaagctgaccctcttggctgttatttaataacacatgtgtatctagactgaaaccgcaagaatgtttcgtgaaacatgggagggggggaccttagcagaactcttctgaaaaatacgttttcaatcctaatttttggcagatctctctctacaccccaggctacagagcttctgtgtagtcctttctttttttcttttctctttttttggggagttggggggttatctctttaccacaaactaaagcttcccagtgaatcattttgaagtaaaggggctggagacagtgaaatatcccaagaagaccactgggaaggcaaagttatttgtataaattccaactcaaattttattctttttgttcaaggaaattttcttactgtggttgttgaggtttcaaaaccaaggttgagaatcacggtcagagatccctgagggagctcagcaatgctgaaatcacccctaacgtactaggttttcagtagttttgggaattagagaaatggagttctacttttatctcaactgattacaaaaggtattaatgaaagtccatttgtattaggttcacagattttcaatgattatcaccagtgagatcacagatctgtgggaaataggcaaactttggggggaaaaagtgttgaaagaatttcctaaccacttcaatttatgagatgattaaacctttaaaagttaattatttttgaacattaagaagaatcaagtgactgtaatttgctgtcacagggtcatttgttggactttgaagtgtacagaatgggatgaagggagtgggttgatatttacactgatgtcttaagggcattatgaggatgcctgatgcttggcattagtactaacctacctttagtacattctaaattacctttttctttcattttacaactttctgaagtgtaacaagggagggaaaaatggcagtactttctctgaactctaaattttccttctccaaaataagatccttgaccccaaataa

SEQ ID NO: 36061 - DNA, 1060 bp, Homo sapiens
gactaatatcaggaaaaatcctaagagaaccttagaagaggaatgggcgaggagatgaatgctagtttacctctggaaatgtcctgcccaccccattttttttagagacagagtctcacccaggctggagtgcagtgacaagaacatagctcactgcagcttctaactgctgagctcaagtgatcctcctgcctcagcctcctgagtagcttgcgtatacagacatgcaccaccacatgcagctaatttgtttcattttttttgtagaaacaaggtcttgctgtgttgtccaggctggtctcaaactcctgggcttaagcattcctcctaccttggcctcccaaagtgctgggattataggcatgagccactgcacccagctcagaaatgttcactttcattctgagggtagtttttctttctttcttctgggtaacactaagaccattggtgaaaaggactttctataaacttcagaacttggtgaaggtccctttgaatgaggaaatttgggagattgtatatgcagcagctgggctttgctctctgtcaggaccgtgtttgcgttctggttcaaccacttaataacctgggcaggttaatcactttccctgggccttagctttcttgtctacaaaacaaatatagtaatgactcatgcagttatggagagtaagtttggcagatggttaaaaacaattctgtatgctcttgggtaaaacgtttccagttaatacatttatacatatattatcagatatggtcgacttactgataacctaccattttgcataaaattacacagctttacttaagaggcacattttaaaaatatgactttttcagattcttattttaggtctaaggatggttattcttaaaaatctagaaattacagatagtaaagagttgaaaataaaaactgcttatattttgtcacctagaaatagcagttgacatcttagtttatcttttaggtctttgagtcttgagtatcttgaaagttgttgtactcttaaacaaaatgagataatgtatctactgttctgtgaatgttttc

SEQ ID NO: 36062 - DNA, 1046 bp, Homo sapiens
tcttctgttttgaaagtgactacattaaactttgctggagatttacctatacctacagccacacacaaacatgcacacttaaagacagctttctattaagttattaatagcatatatctttggctatcataatacaggtatttttataaaactttcatacttagactaaatcttagtcttttgatttttattcagtttatttgaactgtggtttgcttcattaatactagtaatgttttttctttaaagatatcctagctctacttctaactgatgtgctgctctttttacaagaaaaagaccagaaatacatctttgcagccgttgtaagtatatgactgtgtgatgtatttaaaaaataggtttaaccacacattttcttgaaaaatacctaaaattcctagtgaaatataatagtcacagggaagtatatgcttctgttatgtttccattattacttgtgattgcagtgtttagagacaagcatctcattaggttaaattagcatagtaagtgttgcgtcatcacaaccagggctggtactcagctggttcagcagtgtagccaactgtgagaatattgcagtccttcagtagtggttggtgaacaggcattgccctgagcctcccaaatgtccccacgccatctagctatcttggtctttcctccagactcctctcttccccgccccttcggcccccaaaccccttcccttagatccagcaactaaaatgtgaatgctgggcacagccaatctcttccagcacctggctttctccatgcccattggccctgctctcccacttactaaccccgtgactgccatcgtgtgccttctgccagacaagggataccatcctgatgcctaatgttgacagaagattctttcttatttttactatagtagcttctaaagacagtgtatgaaactatttttgtagtgtgttagagtaatctaattgctagcatatagataataagaaggcttgaagaagtctctatgttcccaatcaatttgaactgtattacaaatttcatgaaaacct

SEQ ID NO: 36063 - DNA, 1026 bp, Homo sapiens
atattttcttaaaaatattttgtttctccaatgttgcctaataataaacccatgttatctgtaaatattttttaagatagaactttaaagaactttactttccagttttggaagttatttcatgaacaaaattcttggatgttcaaacattaaatccaaattgatattttatttgtagtggaagagatggttggcttaagaactttttctgtactcctctatgggacaccagccaagactacagaatatttgaatttccttaaacaatagtctctgtgggacaattgctatgtaatcggccctatgagatgctcaacagcattactctgaaaggcaaaaacaaagaaacaacaataaaaaaacccaacattttattcttgtggctttttttctcctagctttaacattttagaactatatattgaatgcatctatatgttatttgcctttttcattaacagaggaaacatcttatggtataaaaatctgaaatcctaatctcccttttcagttgtatttttctgtatgcctcaatatttgcaggtttcccaaaagttctcttcagttcagttaaagcattatgattttgttatgcataggctaaaatgtaagtcaagccaaattttatgttaataatatagatactgggaaaaaagtaacttgattaagtttgagttctctttccttttactacatattagaatttggtgccaaggaaactattttcaaaattcaaagcattgtatttagaatacctcatcttgataatttttttttaaaagacagctgtgttaaactttgacaagttttttatgtaagggaagaaaatagaaaatttccaaatgaaaacctatgccatacttagtatttaaataagtcttaagaagtgagaggatgataatttctcatgttttaaaatatttcataattcagaaattgacaccttacttgtgtaatctatatggaaagaagctttgcccaaagaactttaggcaattttcctggaaattgaaactggtattagac

SEQ ID NO: 36064 - DNA, 1051 bp, Homo sapiens
aagatcatgccactgtattccagcctgggcaatggagtgagaccctgtctcaaaaaaaaaaaaaaaaaaaaagttttaaaggaagcagacatattggaagcaattccaaatgtagataggtaatatggattgtatatgatatctgcagtaaataatttttaaatatgtttgcttgcaggatgccatggcttttaataagtttaatgttcttcactggcacatagttgatgaccagtctttcccatatcagagcatcacttttcctgagttaagcaataaagtgagtaaattgtattgtactctgtctacaaaaacattgggtatagtttcattacaagtttgtagcttaaatgtttgttcttatggatagaatcaaagtgtaaaaatcagatgtttatggtttttaatttttttggctgtgacttagcattttacatccataaaactttttttgttattgttataacggttactgtaattgttactgtgaatataaacaatcttggggaagtgtaaatcgaaatttaacaaggtagaagccctgaataattctcaaattacatatggttaagataatatatttatcaagttgtccaacagtgtatttgttttaaacataattgtttggaaatccataaatgactatttttctctctgagaaactacatgaagtagggaattttagaggtgagagtgttttcttagaaaataatggtagtctcagttaacagtgttcaaattgactgtatcatggaccaatggatctgggagggaccctcagtgtcccctagtttaatacccctgtaatacaaagaaggtacctgacatccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgt

SEQ ID NO: 36065 - DNA, 1050 bp, Homo sapiens
aacacgtgctgtgaaccgtgggtcagggctggggataaagtttgcaaccatttttttggggggtgggggaagaggaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggtatgggatttacctgataacatttaagaattaaggtgccttagctttccttctctgtctaaacacaaaagtgctaaacataaatttaaactgcttgcggggggatgtgtgatttaaattttaggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacagacgtggaatagctgcacaacctctttatgctggatattgtaaccatgagaacatgtaaaaaatggaggggaaaaaggccacagcaatctgtactacaatcaactttattttgaaatc

SEQ ID NO: 36066 - DNA, 1049 bp, Homo sapiens
cagggtgaaaaaaaaaaaaacttttcagaggctagctgtggtggcctgtaatcccagcactttgggaggctgaggtgggtggatacgttgagagcccaggagtccaagaccagcaggcaacatggcgaaaccccatctctaccaaaaaaaaaaaaaaaaaaaataagctaggcatggtggtgcgtgcctgtagtcccagctactcaggagcctgaggtgggaggatgtcttgagcccaagaagtccaagctgcagtgagccaagatcacgccactgcactctggcgtgggcaactgggcaagaccctgtctcaaaagaaaaagaaattcttaagtatttgtgtgggtgttttccccacatatttatactgtaaccatcagctttttactctgtaaaacatattttgttagcttctttaagatgacattattcaaccatagttttttggagatggttgaaaaagataagcgaaaacgaccactactcatcactgttaacattttggacgtaaacattcttatgttgtgtttgacttactagggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggtaagtgaatttttgaatacagggctgctgtgttctgcagtactaatagaaatactattcaagttgatgtattaataaaatatacagcaaatttttttaatgcagtagagctaaaacactgtaaatcagatgtaaatatttagtaaaaaatactttatagaaaaagttgttataaatacaattgttttaaaatttagcttactggttttagttacataaggtgtaatacattctgctagatttatttttatcctttttagccaggcacagcagctcacgcatgtaaatcccagcactttgggaggctgaggcgggt

SEQ ID NO: 36067 - DNA, 1048 bp, Homo sapiens
atttcttatttattgaaagtggtaattagaaatattttaggcatggctgggcgcagtggctcacacctataatcacagcactttgggaggccaaggcaggcggatcatttgagctcaggagttcgagcccagcctgggcaacatggcaaaaccacatctctacaaaatacaaaaacaaaaaaattagccaggcagtggcgtgtgcctgtggtcccagctacccggaagactgagtgaggagaatcgcttgagcccaggaggcagaggttgcagtgagccagatcacgccaccacactgcagcctggggaataagagtgaaaccctgtattaagacaaaaagaaaaaaaaggcaaaagttatattctttaaaattaatttttattagctaacaaccctcccttttcccttttttggttttgttttccttaggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttt

SEQ ID NO: 36068 - DNA, 1120 bp, Homo sapiens
agtggggtcactactttagttagttgcatagcaagcttggggctttttttttttcatggtaaggggaagctatgagagataatgtctggctgtccagttgctagggataagaaatttaagttctattgatatgcagaggatacattactttaaaaattttatttcagtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaagtaagttaattgaaatctactttgtgatatattaatcataacactctatgctaatgtaagtttagattgtgtcctttacatttctgaataagattttaatttgctttcttttatttagaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaaggtaacttgttattctcttcgctttcaatccttcattgctttgtcaaaaagtagtctgttttcaaaattatgtgccgtgttgtgagatttcttttgatttcttgaacagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagaggtgaggatgataacataaactccaatgtggcatttttcattacaaaggagctttttcaaggaagaaaaatctagtatctgctgaacactacagctaagttctgggcacggtgtaacatgactaacagatactatcttct

SEQ ID NO: 36069 - DNA, 1038 bp, Homo sapiens
aacacagagacaagtttcaaagatagaagaaagtttgtttttgttttgttttgtaagcttgatacccatgaggaagtttgcttttctttctgacatttgaacaggaccttctgcctacatgaccatatgaatctactcatgctttcatgcaaataatcatgttccatccatgtctgcttaatatggttctttcttttaaatatatgttaatacgtttattggtaaaatgcaattttttgccagctttattgaggtatacttgacaaaattttattttattattattattattattattattattattgttttggagacagagtgtcactctgtcacccaggctggagtacagtggcaccatcttggctcacagcaacctccacctcccaggttcaagcgattcttgtgtatcagcctcccgagtagctgggattacaggcatgcgccaccatgtctggctaatttttgtgtttttagcagagatgggatttcactatgttggccaggctggtctcaaactcctggcctcaagtggtctgcctgccttggcctcccaaagtgctgggattacaggtatgagccactgcatgcccggcctgcattcttcaatcatatgctttttagctaaacttagtcattgttctttaaatacagttcccaactctgggttcctattcttgtcatctgacatgtctccccctctccaggtgttcacacctttagggcaaatgctagcatctctatgaaacctacctcaattccgccaaacagaagtaacctttcttttctgaagcatccattatatagagactgtgcatttttaatggcagtcgtaccttgttgcttatatcacatttacatgaatatctccattattagacatcgggctcttagatggctaagtccatgtcttgagagggccttggatttcataggtgctcagtaaacttactaagagaatgaatgaatttgcattgataatacataaaccagctaatgtttatcttactattcttttgaaaaattaggctaatatta

SEQ ID NO: 36070 - DNA, 2069 bp, Homo sapiens
tactttgtcattttctaccataggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataagtgtaagcagtaaccttttttctttggattaaccctagccctgaggtctggaagcttgtaaagtctggtcatagtagtaacctgtaattcatgctaggactcacatgaccatttattctcaaattctacaacattgattgatagcagtattctattacattaaaatgagctctcttagagggtttgattagttcagatttatcatctcaactagacatcttttggatag

SEQ ID NO: 36071 - DNA, 1114 bp, Homo sapiens
taaaagtaggagggccttgtgccagctgctaagcatacaaggtgtgtatgtgtgtgcgcgccagctaactaagcatacggggtgtgtgtgtgtgtgtgtgtgtgtgtgtctgtgtgtgtgtgtgttggaaggaaagcatcgggaagtaatccaaactagaagggctatggtcatctaccctgtgttgattatggaagtcctttgctttcatgtcacttgcaaatttgaagtgggctggagtggaggtgggggggttgcagttggggcaattctgtctccactctaaaatcagctgggattgtactcagtagaatccttggacacaataaagcaaatagagtattagccctgcgtgatgtgtgatgttctcctgtagccctgaagctcacgaaggaattaacagaggagcctctaccttcctgcccatttcactgtctagacttgggctataacctcaaagggctcttacaatgaaatcaagctttggtgcacttcctcagtcctttctgatctaagacataacctgtgagctctcgttcttaaaactccatcctctaataacaaaaggtactcagatctgtatggagagctcgcctacctcaggccaatcctctttcaacacacctggatgcttttacccagtggtcccaaacctttttttggcactagtgatcggtttcatggaagacaatttttctacagatggggtggggttgggaggatgattttgggatgaaacagttccacctcaggtcaggcattagattctcatgagtgcaactaaatccctcacatgcgcagttcacaatatggttcttgctcctatgagaatttaatgctgctgctgatctgacaggaggcagagctcagcctaatgctcgctctcctgctgctcacctcctgctgtgcagcctgcttcctaacaggacatggaccagtaccttattcaactgtacaacagttaaataactgaagcttgctggtatagccaagagaatggtaattttaaatggaaagttattgggggaaaagccatctttaacttgctcaggacagcatttaactatgccagtagaactcaaaccttgaacaccccatcagaaaaagttctgga

SEQ ID NO: 36072 - DNA, 1083 bp, Homo sapiens
tctcttcctgttactgtgagaaattcttttattaatattttaaaggcatactatataaagcagtgtggtggtatattaggtatcagtagaatcctcttgatagttatttagtaaacgtgttttgcttcctgtttttttctaacctttttattgtttcacttctactataatttcacatccttttcttcttagtcaaataagttgaaaaaatatatttttatagaacatgttgctatggtgatagtttatgaaaatatactttatccctgtttaagatctttattaagatcttgctatatgataatctgactggggtgctataaaagtaagatataaaccacttcttctgtagattcattgttttctagcatttttctgtctaggtattctgacaataattatgtgtagagagtgaataaatatttaaaattgtgtgtgacataggaggttttcagtaaataataactgatgaatgaaataagtttaacttggttgatgattgaagagaagttgtgggaactgcaattaacaaggcccaagaaaaaaatcactaacatgattaaaattggtcagacaccaaagaaccaaataacatcatagccttttgtaagtagcaattatcatttgccaaaggcctacaaaatgtcaaacattgttttaggttcatttgatttattcgctcttcacaaaaatcctgcaaggtagacattattcttactttacatatgaggaaattaacattcaaagaagttaattgcccagatcatcgctagtgaatagtctagtccagactttggaccttaggcgcttgcaatacataacttttaatacatatagaattgattttagattttagaaaagtcactcaggcataatggcacatatctgtagtcctagctgctcagggtgctgaggtggcaggctagcttgaccccagaggtttgaggctgtagtgagctgtgatcatgccagtgcactccagtgtaggtgacaaagtgagaccctgtctcaaaaaaaaaaaaattccaaaaaactattatcccaaattttttaaatgattaaacatttgagaatctgtcagag

SEQ ID NO: 36073 - DNA, 1034 bp, Homo sapiens
acaatatctgaaatcaaaatgatgttactagatggacttaatagcaaaatggaaatgacagaggaattggtctgtcagttcgaagatagagcaatacaaaataaccaatatgaagaagagtaagggaaaaaattaaaaacaacaacaacaacagaaaaggaaagtcaggtacctgtggaacaacagcaaaggagtaataacaggagtaacaggtaattgaacctccaaagggagatgagagagattataggaagaggaagaaacaatagtaatagccacaactttctcaaaataggaaaacatacatagaggaacaacaatttgagtgatcatggccttagcagaaataatggagtctagaaaacaatggagcaacatctttaaagtactgaaagaaaaaagctgtcaattcaattctatatctgatgaagatatcttttgagaatgaagataaaataaaactggcatcttaggtgtagttgtgtatttggcatactgattaagaatgcgggctccggagacagaatctagatttgagtttcagcctgagtacctcttgtgatcatgggtgaattatataaattctctaacctcaatttccttatgtgttaaagacacttaaatgaaatatctaaactaatgagtagcaatgagaggatgcttcttaagcacttagtatctgcttggcatatggtaaattgttggaaaacattagttaccatttatatatgcatgtttttagctttcatagtaaatataaccaacctttatagaatttcgtattttatatttttatctgtttcatttttgttcaactgtagagaggttggctgtatcttgaaaagggaagagtgagactccgtctcttaaaaaaaagaaaaaagaaaagggaagaaaccactgacagtattgtaaaagagaaatcacttttactactgctttgacttcagcaaaaacaagatttaggaagctcttattttcagaaaaggaaatgagaggggaaatttttctctcttagaaaataaaaaacctca

SEQ ID NO: 36074 - DNA, 1026 bp, Homo sapiens
ttcagctgagttcacacagaagcaggactgctgggctagaagctctagcaagcattgtctgcctggctacctgtggcaagggtagatggagtggccagccaaattctggctgaagcaggaccactgggctggaggctgttgctgagccccatccagcaaggagtagtggagaaatcttactgctttcaggcactgcagtggcggcctctattgaggctataacactggtgctgatctgctccggggcgcaaagcttgtagaggtgcccttgggcttcagaattgcctccaccaaacatctcagtggctctgcctcagtctagaagcatgggggtggggggcacagggtggtcagggggaatctcccattcccagtcttgcacaggtttctgtggaaagtgtgaatccccctgggggctctcactcaccgtttgcggtgttggttaggttctcctggctctgtgctcagcccagacaagctggtgcccaccttcattcctccgtgctctctgtgtttccctgctgccttgatagatctcaacgttgtttctcagatgatcagcttgcagggtcagtgttcagtagcccttttgcttattctctgtgagagcaatgcgcatgagctgcttctagtctgccatcttggcccccctaacctaacccatttttagatgttacattccatcacttctacttctgctataatctatttgttagaagcaggtcacttaattacacattatggcattagtttgttgtgccttttgtgcttttcctagcatctgtgaagtattattgaaagtattttagtagtgttaggaaatgtgtattttataataattattttagtagtgttagaaaatgtatattttatttgcagttcaaattttgttttttttatttttttatttttatttatttattttttttgagacggagtcttgctctgtcgcccaggttggagtgcactggcgcaatctcggctcactgcaagctctgcctcccgggttcatgccattctcctgcc

SEQ ID NO: 36075 - DNA, 1027 bp, Homo sapiens
tctctgtcacccagactggaatgcagtggcactatcatggtttactgcagcctagacctactaggcttcagagatactcccacttcagcctcccacgtttaattttttttttatagagacaggcgtcttactctcttgcccaggctggtctcaaacccctgggctcaagcaatcctcctgccttggctccccaaagggctgggattataggcataagccaccacaccctacttgcataaatatttctaaggaatttggagagtcaaataaatgaagtttactatgagctttcccctttttgtaggttacccatttattcttttaaattagtgatagaatacatatgaagaaattatagaagagctgtaaagtagcatcagtagaacagagatctaaggaaatatttgagatttttatctaaaatttcatttgaacagggttatgttgctaaggagttttaaacccctgccatacactattagagctgtaagaaaactaaaaagtcaggagcagtggatcaagaaacaatatcaaggttagaactcagaagaaacttaggagcagtttggcaaaggggacaattgaaaggatcatttttccaggacaggaaaataataatagcttatacaactctttttgattttattagatattttgcttccaatagtgtggagcgtagtgtgaagataaatagcacagtatctcaatttcttatttgtagtgtagccctatcctattatcctggcttctgttgtaatttttttttttttttaaagacacaggcttcatcaccctgtctcttaaaaactcttctctgttgtccaggctggagtgcagtggcataaccgtggctgactgcggcttcgaactcctgggcttaagcaatcctcctgcctcagcctcccgagtagctgggactacaggcacatgtcaacacacctggctatttttttgtgtagacagggtctcactatgttgcccaggctggtcttgagttcctaacctgaaatgatccttccatcttggc

SEQ ID NO: 36076 - DNA, 1046 bp, Homo sapiens
tatgcaactcatcatccaaatagaaacttaaaaacttggaggctcggcgcagtggctcatgcctataatcccagcactttaggagacagaggcgggcagattacctgaggtcaggagtttgagatcagcctgaacaacatggagaaaccccgtctctacaaaaaatacaaaattagccaggcgtggtggtgcatgcctgtaatcccagctgcccagctactcgggaggctgaggcaggagaatcgcttgaacctgggaggcggaggttgccgtgagccgatatcgcaccattgcactccagcctgggcaacaagactgaaactctgtcttctgtctcaaaaaaaaaccaaaaaacaaaaacaaaaacttggggcttggggaattgacctttgaattgacactgtaggtaatatgtttatatcagaatattattcatcctgtcgaaagaagataatttccacttattgttctataagaatgaatttaatgtctttaggatgaagtagagtatagatttttaaatttccctctgtcccattcttcttcactagaaccaattaaatgaataaaaaaaggagaaaggcagtagaagagaatacatgcatggttctcacaaggcaggccttctgtctctggtaaaaaacttgagttttagtgtatatactcttggtttaggatctgtggaatttcattatttctgttctttctctcagtgacacatgtaaatgagaaaatcattcaaatccagtctaaaataatttttaaagttttttcctcttgttttgcaaaaatattaaaagctaaagctaaaaattcaaagttgcacctatactttcatttttgtcatacaaaaattgtggccatatggtttcagtgtatgttttcatgtatctgtatgtaaaataattgaagaacatggaaaaataatctgttaaagtcttgaattgtgattttttattttcttgaaatttcaaaaagtatttttgcaataaatgaaaatgaaaaaggaaattttaaagtagatcatataagatgtattggtttga

SEQ ID NO: 36077 - DNA, 1029 bp, Homo sapiens
cgttttaaaacttttttattgatgcataacggatgtacatggtcctcctgccccaccccaccccccacccccacaacatgttttttggagttttttctggtttttgtttgtttgtgttttggagacaaagtctcgctctgtcccccaggctggagtgcggtagcgcaatctcggctcactgcaacctctgcctcccgggttcaagcaattctcctgcctcagcctccctagtagctgggactacaggcgcatgccgtcatgcctggctaatttttttgtattttagtagagacagggtttcaccatgttgcccaggctggtgtcgaacccctgagctcagtcaatctgcccgcctcggcctcccaaagtgctaggattacgggcatgagccaccacgcctggccacagatggttttaaaagcagtgtttatctttatgctttttcagataagtttataccatggatagcacaaaggagaagtgtgacagttacaaagatgatcttctgcttaggatgggacttaatgataataaagcaggaatggaaggattagataaagagaaaattaacaaaattataatggaagccacgaaggtatgtttcttgtttcttttgatgtgtgtaatttaatgaccttttaactttctgtttcaaagaaaatcatttgaatatcatttgtatttaatatttcaatattttaatatatattatttttaaactacaaaagggtatggaataatctcccttctattctgttgctcctaccatccaggtttctatttcacatgcatataataggcatttaaaaccaaaataatgtatatgttcctgttcacctttttttttaaccccagtgggagaaattgtttaggtatttggatttttttttttcagttaatataacttggagctctttctgtataggtaaataaagatcttcattctttgtatgcctgtgtgtgtggatataatgtaatttattgaaccatccaaaaagtttatggataaatatatgtcatttgtagtct

SEQ ID NO: 36078 - DNA, 1035 bp, Homo sapiens
caatagataactgatgatccaacccactaaggcctttgatacccactgtggatcctacctaggacatactgttcttttctgaatgcaaacctgtattcatctcagagagcttgtgctgtgctaagtactgctcacaacaatcctgtgatttagttaactactaataaattcatcttacaaataaagaaactgagatgtagaaagattaaataattttagggtcacctagctagtaagtagtagagctaagttttaaatttaatcttctgtttcctgagtatgtgctcttagccaccaggttatactacagtgatgctttccttcagacatttttcttatgctttgttttgttttcctccataggggtccagattttatggaaatgagctcaagaaagaaaagcaagtcaaccaacgaattgaaaatatgatgcaacaaaaagctcaaatcaccagccaacagctaagaaaagcacaattacaggtattaattaaattgttaaataaagtggaagctggtagaatagtaattgacagttaaaatgtattgtcaagtcataactgaaaacaagatgaaatgtaaatgttcattatattgtaaagcatacatattcagcaaatgaacatactttactttgctaagtgttgctctgctcatttacataaagactccacacatagacattgtcacctctattatacagaagagtaaatgaagtcttaattaagttgagtaacttgcccagcttgataggacaggtagttagcagaactaggatttaatccaaagcctatgttctttttattgtatacatcgcagctagaaaaggccacgggataaatgtggaatgttttctgcaatgctgattttgcaaaaaaaatttgaggaatatgttaactaattaaattggagagtaacttaaaacataatcatgttatagtaaaataaaaagtcacactatagattagaatgccaaatgtacatgaacttttaagacaaaacacaagacttctaaaaccttggaaggtttttgcc

SEQ ID NO: 36079 - DNA, 1049 bp, Homo sapiens
cggtgtttcaccatgttagccaggatggtctccatatcctgacctcatgatccgcccaccttggcctcccaaagtgctgggattacaggcctgagccaccgcgcccgactcataaatttcatatagctatctttttctagcacaaaatatatttttattggttttgcatgtaataacttgagtattagtttttccttgggagacttcaatcctgtccaagattacattgcaggagagaacccagacggccacaaggtaagagacaaaagaaatactaactagcaacatagcaatccagaacaatctggtaaaaggaaaaacaaatttacatatgttgataacccatgaggccatcactgtctcttaacataataactgttattcatcatgaggaccctgaactatcttgtaaaagccatattgtgattaggtaaatcttttctttctacaccaaagcatgagaatgaataatgcattttaggaagatctatataacaattaaaatgaactgtttaatgaatatatttgaatatagctatttcaaattatcttaattaggactcctagaaattgtgaaacatctttttgaaaaatagtaatttgttttgtgaataacataaaaaggatacaccatctaattatcattattttaaatatactgtaaccagaatctttgattttttgctttatgtggataatctacgcaaaagacattttcaaagagtaaacatccaccctaaattatattctgtatcttttcttagagatagatatagaaccactataaaaacaatctgggctgggcatgatggctcacgcctgtaatcccagcactttgggaggccgaagctcgtggactacctgaggtcaggagttcgagaccagcctgaccaatatggtgaaacccccatctctactaaaaatacaaaaattagccaggcatggtgttgcgtgcctctaatcccagctactcgggaggctgagacaggagaatcgcttgaacccaggaggcggaggttgcagtgagccaagatcacgccattgcactc

SEQ ID NO: 36080 - DNA, 1031 bp, Homo sapiens
cgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtaagtgtgtaattgttttaaactgcatgattttctaggaatatgtattattaaaattaatgagattgttgttaaatctgaaacatatactattaaatgggtagtttgtgtatgccgccatttagggaaatgttggttacattgccataggttagaattaactcaagcctgtagattgtgaatttggggaaaactttggtttgatcttgatttagcacagaatgaactcaaaggtttaaggagctgagtgatctaatcaaacaaattccttcagagaacatctgtgaaggcacagtggtaaattaa

SEQ ID NO: 36081 - DNA, 1048 bp, Homo sapiens
atcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcattt

SEQ ID NO: 36082 - DNA, 1035 bp, Homo sapiens
atgctaatattttatatcattctgctatgctgctgctctgttattttctgggtggagatactgcaatgtaggtgatcattaatacatatataggtcaggtaccaagaattagctctctgttacaaccagatgctgtttggtcattagccaaatatgggaaattattgaacttctcctttccaacaggccttgctggtatcaaagagcctgagagaggcaagaaataaatttcagtttgaggcaagtgatagaagacaaaccaataagttaattttggagagaactgagattagagttaactattcattgatttgaaaaatattcactgggtgcctactatatgcaaggcactgggtatagagccatgaataaaactgaagagctgtaaaatcagaacaacagatgacttatgaagcattccaagtcatggagacctgagaactctttggggaagaaatgaaaattacctggaagtagtcattttatataccagctcaagcttgcgtctttccttttcctctttctttcttactttcaaaaaatgttcctaaaataggactctttcatctgaggtatcaatgaagcctgttagaggcatcacaggagaagaatcagttcctcccagtatgagattatagggaggaagaaaggaggaatgtgacctcttccctttgtggtccttggccactagatcctagggatttttaaagggactaagcaactaaagcaagagaagtaaacacaagtggaattccaaaatctaattacaaaaatatatacaaaacaaaacctttaattgctttgtctcaagatctgtaacaaggaataagaagacagcaaaaacaaagaaaaccgttgttcctattgtgggttattttgctcaagggaggaagtgggtttcaaggtaccatgcattggctgcgcgcggtggctcacgcctgtaaccctagaattttgggaggccgaggtaggtggataacctgaggtcacgttatccccatctctgccgaaaatacaaaaaattagccaggcatg

SEQ ID NO: 36083 - DNA, 1076 bp, Homo sapiens
ccccgctcccctcgcgcgggaggattgctgtgtggagaggacgcggcactaggctccggggaatccggcgggagcccgcgtgacttgaacgagatggtgtcgattacccagccaggggctgccctcggaaataggttgctttggccgatcgtgagtggatggagccagattaacaccaaccacgtggcttcatgtgcagagttcagagtcctaaacatgtgccaggaagcatttcctttaaaacaaacagaaagttggcctgctgtctctccaaggtggccctgtcagtgaacccaaggccgaagaccacaggttaatctttgcccaggctggccttggtggcagaggtaccaggtttgggttaaggtggtgataccttcagcagggtgttttgtttgtgtgtgtgtgtggttttggatggtgcgtaaggccactgacttgcttaactgaaaaagggctcctcaacttgtgtaggttctttcccctcctccccgctggcgtgtcaaagatgggaggttatctttcctgtgttacccttgcagtgagggggaggcctgaggactacagcctctgtactctaatgcattcagcagttgactgagacccagctttttgccttttggtaaaccacacagacagcagagcctcttgggttcaagagggaacgctgtgctcattcagtgtttgcagtgccaacctcaggtgggacccagctttttgccttttggtaaaccacagatacagcagagcccgttgggttcaaggaggaatgctgtgctcattcagtgtttgcagtgccaacctcaggttggtggaagtactttaatgtgaccagctctcagaatatatggtggcttcactgtgtcaaatgataagataaccacaaacttctgcaaactaggtgaatctacatgaacaaatgatttcttgctatcacatgattgatgtcggccctcatgagcaataaatagtgcaaaatttccgtgaatgtggtacatgaatgcagcatttctgtcagtccctgcatgtgcatctgtgatgctgcttgattttcacggaataaatctgtgttttaa

SEQ ID NO: 36084 - DNA, 1020 bp, Homo sapiens
ggactaaaaaaattcacagccacgtaaacagaaaaagcacataagccatttcatgctacaccatggtgctaattcaatgaaagattagcttgagtagaagtcaggaaagctatatcaagaatgagttaattgtaaatgggggaaaaagcatgaacagtgtatattgtgaagaattaatgaaaataattgcgttcagtagcaaaattcaagttaacctaaatgcctagcaattggggagtagttcaaataaattataaataaaatatttatattaggaatatgatgcagactttaaaaagaatgaggtagctctatatgtaattatataagaatatgtccaagatctgttaagtgaaaagattgtttacagaaaaacatgtatgcaatgattcatgagtattttatcttaacgtgtacatatatatgtaaaaattcaggaaatagtcttaaaaattgcattaaattgttagtggatttctactgtagatgagagtaggacttgggtgggtaataggaaggagaacccacttctcactctatagttctatgctgtttaaatttttagatgtattacgttttcctatattgctcttatgatatgaattgctatgtgagattttaacttttaaaatacattaaatttaatttataaatataaaaatataaaatgtttcatatttttataaaatgtaaagtttaatttagttaatttggtaaacatttttcttcctgggactgttactgaactttactttcctagtattttattatatgaattggtacagtaggtgtggcatgggcacagatgggcactagtctgtttggcatgctttgtttggcatgctttgtagttgcgagagaaatttaagaatgccagtcttggccgggcacggtggctcatgcctgtaatcccaacattttgggaggccaagccgggcggatcatgaggtcaagagattgagaccatcctggccaacatggtgaaaccccagctctactaaaaatataaaaattagccaa

SEQ ID NO: 36085 - DNA, 1048 bp, Homo sapiens
ttttcaattaaaataaaatagagatgagatctcactatgttgcttaggctggtcttgaactcctggcctcaggcagtcctcccaccttggcctcccaaagtgctggaattacaggcatcagctactgtgccttaaagtattattaagaatttgtacttctctatgatgtagactttattctgttctcttcacccaagaaaattttggtgcatctttattcttggttaggcctccataccaccttcaattcatcaattatctttttggttttgccactattatgactggtttcaaagaatgcttggctttttgttgaaacatcaaaaggtatgagtagcaaacagcactgagatctcttccttcctgtgtgaacctccccaccggaagctgcctcatgctgtgatgcttaaaagtcataaaacggtatcattattcaaggcatagagtgactttagggaagctggtgggggagaacatttgtacaaggttgtcacagaatgatttctttgtgtcttccatttttagggtgatatagaatgtagagcgatcttccattgccttctcagtctgaacacctttgtttttctttaacagagtcaaatccccatttcatatatggggatactgaggctcagaaatttatctcacttatccatggtggagttagtggtagatttgggattaggataaaggtcttctgactgtttgacagtgctctttagttccatgagtctctatacaccatgttgagtagtaaaagtagaaagctcaaatgagtctctataaatcatgttgagtagtaaaagtagaaagctcaataaagaaaaaatataaacatgaatattaaacttatttggtagattcagttcaagtttgcttttggttaaatgctgcaaatggtttgggggaattagccattcatatgttcttgtccttgatctttcatttttgctgagaaacttgaacccattttggtgcaagaacaggaattcaggaattaacatttctagtcatttctgcactctgtactccgtcctacttggcttaa

SEQ ID NO: 36086 - DNA, 1029 bp, Homo sapiens
ctatctagaatatatgatgtttaatattttagtcacctgcatttatcataactgagcatttgatccatgccaaacactgttttaagcacaatagtgtttttttaatgtaatatataatagtgacatttttacacactttgattgctgtgtaaatgtttattggtatttctttctttcttttttttttttttgagatggaggcttgctctgtcacccaggctggagtgcagtggcacaatctcagctcgctgcaacctccgcctcccaggttcaagcagttttcctgcctcaacctcctgagtagctgggattacaggtgcccaccaccacgcccagctaatttttggatttttagtcgagacagggtttcaccatgttggccaggctggtctcaaactcctgaccttgtgatctgcccaccttggcttcccaaagtgctgggattacaggcgtgagccaccgcgtctattggtactccatattgtcagtttgaatggggggatgtggatgcggatcttacacttaggatcactgtaagaaaaaagtttatctttatagtattatttattaattgaagttggcttttatttgtacattggtatgcaaattcaagtttgtagatgttgcaaagtggatattggagtctagccattctaacacttcatcataaggcagcttccctcctccacttcaccacccctccaggcagatctgcatgcagtggtgctcaggcacatgtatgtgcttttttttatgcagcgaggttagagaatggggggcagggtcttttcctacatggggtaggggtgcattggccagacactgcatctgtctgttctccactctgtcctggcacagctcacctccagaacacagagcccaaagctgtcctgaagcagtgggtcagaaaacatgtttgaatactcagacacatggaatatgtccagtccttttcaaaattcaaaatggtagaaccatattgggaagccatgactggggacaaggaataagctttatcaggccctagtc

SEQ ID NO: 36087 - DNA, 1032 bp, Homo sapiens
acaggatgtgcagatcgtggattgcagatctgggctttgttcacagtgaaacaaacaatgctgcctgtgctgctctagtcacttaaccggacatctccctgatgctgtcaacttcagtcccttttaactggtctcctgctgcttcccttgtccccacttgctctgttctcaacatggcagccagggtgatccatttaaatcttaagtcagatcgcgtcacttctcttccccacactcacggtggctctcgtcgcacccagagtaaaagccaaagtcctcatgaagatccacagggccccgcccgcccctcaccacccctctggcctcatctcctgctcagcccagccactctgagcacactggcctccttgctgttcctctcacccctataaagctccccaaggcccctccttccctgtgtgtctccatgtctgatttctcacctctttgaagtctgctgaagtgtcactgaccaccctatttacaattgtaacctgtcccccagccctaaccctggcccttctgacccctctgaccctgtcctaccttttgttgtcatgactgattaccttctgccatgatgtgtcatttgctgttgtttcttgtcagatcctccacactgctccccccaccccataggtggctctttttttggaattaattaatttagtgattttttttctttttatttggtaggctctttaaggcaggaatcagcttctgttttgtttaacgatgtgtctcaaatgtctagaacagtgcctggtacaaagaagaagctcagtcaatatttgtcgaatgatttgtaatttatttgctcttactagtacggcctagttaacttttccccactaccaagtggattttgtttatgagaaagaaaggttgatcctgtcacagcctaaattccaaatatagttgccccttggtatcctcggggaattggctccaggagcccccacagatgctccagtccatgctataatgtgatgtagtatttgcatataacctatgcacatcttcccatatatg

SEQ ID NO: 36088 - DNA, 1050 bp, Homo sapiens
tgtactggccaccacctatggcccttgaagtggggagaggttggtgttttggtgattagactttgaaatattttatgattccatgtactcagcatatcctaagtttctggctcactgaaaaaacttagcaaggcattgttaagttatgggcttcttacagtttggaactcccggataaggaaaaaacaaacattctaactgtctcacaatagtaagagcaaaaagcctgtgcagtccccaccatggacattgtgattgtgcatgacatacatattcaaatttagaacggagagatgcttcagcattctcttggaccaattgtttttcagaatgcagggttgaataaacaagtatctacatatttccactcttctgaatgccacatatttgcataatgctggacttttcaatgtttttgtagttcttcttcattgaatgcatccaaattgtgggaatgtggcagatggtgttatatccatttgacagatgaggaaactgaggctcaataacttgacttgcctgaggtcatgtcacacttctgtagcagagacagaaacagagccaagccctcctcattccaaacctcaggcaggagctgtggtgaaaagcagggagtcggtttgcatcttggctctttcatatgccagcattgtgaccttgggctgttactgaacttcaaagcctcagttttctcctttgtgaaatagggagactcccttctcttagggtttttagggttaaatgaaaatttacaaccgtccctaaaccttgcaagcactcagtaaatggcagctactgatgtggtttatgttggttttggcatactgctatttgcacaactgggtgttagttgagcttacctggtgtatctccttaaggcccattggatctgagtatctggcattctaggcccataattcagaatcagtggaagagacaatgttgatacatctctgaggcttggttacctgggagctggcttgatgtctggggttctagatagtgcccccaacaggagagttgttacggggtgggatgaggggctttgcc

SEQ ID NO: 36089 - DNA, 1025 bp, Homo sapiens
cgtttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggagaaaacaaagatgggggaaagattcaggattttagagagttattacatcctgattcgggtgattatccgtactctccacctcggacacactgtgagctttatttacgtacattttgaggcagacaagattagctagatcccaggtgtccattaccctgtgaccttttaccaatacaggtaagaaatcttaaactcaagcagaaacctgtacacagctgatctctttaggagtctataaatctggggcatgtgctgtgagatgtgtgcaagccttgttgggtcactctctgttaggagaaggccccccagttaaggcaaaggacaacccaacctattcccaaattgacctgtgtagcagaatcagctttggtcttaataatgcaaggaatcaaagagcctttggtgttgaatgaagtatgctataccttagccagaagcctcacttctgacctgtgcttgatatcctgtgtattgtgacttgattatccatacatttgacttttcaagactccctgaggctgggataattagaatagcctggtaaagccatttaagagttttttaaataacaatttagggactgtagtagggttcctgttgccactgttctccaacagcacccagcatttgagaatcagttagtaccgatccgatccagtgatatataagcaaaaattctgattgtgggaaaacagaagagaaggcagtgttggctgttcaagcca

SEQ ID NO: 36090 - DNA, 1078 bp, Homo sapiens
atgtatatttttctgctattgtgaataacatctttattctattgtgttgtttattcttgacatgtagaaaacttatcaattttatattcattttataactagtcaccaggatgaactcttagttctaataaatttttagttgatcctcttgagtcataactaccattgacacttctgatttttttttaaatctttaattttgtcaaggaatagattcacatagccttaataatatagtaagctttaaggacttaaaaattatttgggcttgcctctgcttctggggaaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctggagaggctggccacccagaaatgccaatgggtacaggctctgatatggtttggctctgtgtccccacccgaatctcatcttgaattgaacttccataattcttgcatgttgtgggagggacccagtgggagataatttgaatcatgggggcggtttcccccatactgttcttgtggtagtgaataagtctcatgagatggtttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaactgattaatacaggctctagtgaaagcctgctctctgtagccaaaggaccaagaaagaaacaggctagcaagacagaaataatttcagacagtaactgctctactctagccaaacaccacacacacacacacacacacacacacaaacgaaaaaaactgtaatgcctccacctaggcagcaaagcctgaatggcgagcctggacttccaccctcctg

SEQ ID NO: 36091 - DNA, 1065 bp, Homo sapiens
cccatatcccatacccgccacgttcatgtttaattaaaaacagctaccctctgtggagtactgactacagctgacatccttcttagggacgttacaatactatcttatttatttctcacaacagccctttgagtagatgtcatcctcattttactggttataaaacagagacccagaatggttaagtcacaagttgagaaagaggtggaattgggactgggtgcggtggctcatgcctgtaatcccagcactttgggaggccaaagcagggggatcacttgaggccaggagtttgagaccagcctgaccaacatggtgaaaccctgtctctactaaaaatacaaaattagctgggtatggtggtgcacacctgtagtcacagctacttgggaggctgaggcaccagaattgcctgaacctggaaggcagaggttgcagggaactgagattgtgccactgcactccagtctgagcaacagagtgagactctctctcaaaaaaaaaaagaggtggaattgggagttgaccacaggcctgtctctccgaagtgcaggctttctctaacaccccctatagaaaggaagccatctagactcccagcacctcttacagtagagaagtaaccccactgtgctccctagtacagtatggatttacctatttttgataattcatcaaaatatagaagcaaagtctgtgccctatcgccttggtagctcaggcccagcacagggaggtatttagtgagcatttatgcacggactgtggtattctctcatttactttcgctaacagatgataaggcaggctctgaaaagatccctgctcatgaatacactaattaatcagatgttacaagagatattgctagtaaacctaaacagaaagacagaaaactgagcagtggttctaccgtaagcagaccagaaagctctataaagcctgaaagtcagatttcttatgagtcagcaagtaattttctgccctactatctatctatctatctatatctaataatttttagtggctttgcctttatttttatagaacataccagcatagcag

SEQ ID NO: 36092 - DNA, 1033 bp, Homo sapiens
cgtcaccttccctgttctcttctgctacagttacttaattataggactactgtttaatgaaaaaatgtattaaagcttgtaagtggcattaacatattcaggtggatagttaattcccagtggagaataccaaatgagtattagataatccagtagggatgagaatttgtaaattttgaatttttgaattctttagaactgactttaaaatgttaacataaaagcattcttatttgttagaaataaaggaccttgttcacaaagtctcattatttagttcgatttttggaggagatatttggacatttagtaagagagattaggaataaaaatgccttttaaatgtataaagtaaaataataattttagcttttctgaaagggaaacttgctgctcttgacatttctctaaaacaattatttgtaacggtaggagactggtatatatattattagattgttacatgatttctttttcctaaagccttgttttctctcaggtggaagaactcagtaaaatactccaacgtgggagaaatgaagataataaaaagtctgatgtagaagtacaaacagagaaccatgctccttggtcaatctcaggtatttagcttatagtgaggatatgctaacactgttacattcaaatcatgctaatgttgcgttttcttttaatttaaaataaacaaagatcaaggtaaatgagaattgttaatactgttgacgtctctccatatgataatggtattttcggataatcaatttgttcttctggaggaaaaagtagaaatgtattgtcattcctgtgatttctataatgttgctaatgttttcagtggcacactcactgagtaatttttggcaggcagttagccatctacttccatatctgccttccttgtgaccaggggcatttgttttcttgttgatgtgttctaattagaattatgtatagtatcagtctctcacccttgtgggaatggtgagcccaccaccatggccttatgaatggcattatgttataaggcaaaata

SEQ ID NO: 36093 - DNA, 1049 bp, Homo sapiens
tagctgggattacaggcatgcaccaacacgtctggctaatttttttgtaatcttagtagagacggggcttctccatgtggtcaggctcgtctcgaactcctgacctcagctgatcctcctgcctctgcctcccaaagtgctgagattacaggcatgagccaccgcacccggccaggaaaatattaaaaaaaaaaaaaaaatccattgctgacaactgtggagtgagataacatatttattaggattaatagtttaaatggcctgcaagacaatggttaagaaagcgatagttacatttaatttaaaaaagtattatgtaggctttcagatggtacttgtaaagactaaggggaaccccaaaaatgcttatgatgatgcaatgttaaattgaaagaaggaaaatataaaaagttaacagtgttctttatttctactctctaaacaggtaagtttggtggtttataggttataaaggaggcttgtttgttttattgatattttatgaactgtggcaactatttgatatcttactcttgaaattttatctcatggtttcctgtcctgtcctttcctgtcctatctctgtcctgtcttgtccttctgtcctgtcctgttctgtccttctgtcctgtcctgttcttttttgagacagggtcttgctctgtcacccaggttgagtgcagtggtgccatcatggctcactgcatcctcgacctcctgagctcaagtgatctgcctacctcagcctcccaaagtgctgggattataggcgtgagccactgtgccagccagtttttcttttcttaaccaaagaaaaattacttgatactaaattgtaaagttcacataaggaattaggattctgttagattttttctgttctcctatttgatttgcttctgttctatttttttgtgaacaatacttaggaatagaagagtatgtgactaaaatactaaaaatcagttttctgtttgctttcaagatctctgttttaatggcttgtgcttgttactagtggtttgattgtttgaaaggctaggttgtag

SEQ ID NO: 36094 - DNA, 1689 bp, Homo sapiens
gtttgaacttggtgtgaatgaccatcttagtgattcttactgcaatgacaatagggagttaaatgacataagtttctttttcatgggaaaggatataaaaatgtatctgcatgtggtcagtgtagaatattcccagccagaggtgcagttttctggatccctcccacagacattgtgtggaagcacacctattaaccgataaggggcgaaatttcaccagaatagagaagcatcctctttgcccttttcacaggggtggggatgaggttaggggtggggttataccttctttgctcacccagctgcttctatatatcttagcctggatatgcctaaacttaagccaaaacaaaaactcatagacaggtagtttatttgcaaaatgatactagggatcaggagtaaggaatgagagtaaagcaggggaggaagaaaagccactgcaagcatgcactgtcaacagaggaaggaccaacaagcacatgaaaggtctcagtgttactagtcaccagaattcaaatgaaaaccaccacgagatacctactagatgcctattagaatggctacattaaaaagactgcagcaacaaatgttggtgagggtgtggaacagtcagagctctcatcaattgttggtaggggtgtaaattggtacaactttggaaaggtctggcactttcttaaaaaactaaacacacactttctatgacccagcaatttcattcctagatatttgcccagcagaaatgaaaatatctgtatataaacagacttgtttaagaatgttcatggcctggcgtggtggctcacgcctgtaatcccagcactttgggaggctgaggcgggcggatcacgaggtcaggagatcgagaccatcctggctaacatggtgaaaccccgtctctactaaaaatacaaaaaattagctgggcgtggtgcaggcgcctgtagtctcagctacttgggaggctgaggcaggagaatggcatgaacccaggaggtggagcttgcagtgagcagagatcgcgccactgcactccagcctgggtgacagagcaagactctgtctcaaaaaaaaaaaaaaaaaaaaagagtgttcacagcaagcagcattatgtgttatagtcagaaactggaaacaggccaggcacggtggctcatgcctgtaatcctagcactttgagaacctcagataggaagatcgcttgaggccaggagttcgagaccagcctggggaacatagcaagaccctgttttcacaaaaaataaagacattagccaggcatggtggcacacatctgtagtcctagctacttaggaggctgaggtgggaggatcacttgagcccaggagttcaaggctgcagtgacctataatcacccaccctgggtgatacagtaagaccttgtttctaaacaaaacaaaacaaaacaaaaactggaaacagcccattaacagaagaatggataaaaaaactgtggtatgttcatgcaatggaatattgcccagccataaaaaggaatagagtattgatataataatatgggtaaatattaaagcatgctgggtgaaaaaagccttacgcaaaataatatggtattttcctatttaaagttctagaataggcagaactaatctgcaatgaagaaaaatcaaaatagtgatctgtgcagatgtgggcgtacaagta

SEQ ID NO: 36095 - DNA, 2007 bp, Homo sapiens
tataaaattgtgcagctgcaatggaaagcagtttggtggttcttcaaaaagttaaacagagaattaccatatgatttagcaattccactcctaagtatatgcccccaaagaattaaaagcagagactcaaatagatacttgtacaccaacgtccacggaagtgttaatttgcaaaagccaaaaggcataaacaattcaaatgtcaaaacagacgaatggatgtatacacatacaatggaatattattcatctttttaaagacaagaaatttgggtatctcctacatcatcctttcaaggatgaaccttgaaaacattatgctaactaaactaaccacaaaaggaaaaatattgtatgattccattaatatgaagtacttacaacaaacaaattcatggagacagaaagtaaaatagaggtttccagggtctgggggaatagtagattgggaagttattgtttaatgagaacagagtttcagtttagggtgataaaaaaaattctggagatggatggtgggaatggttgcatgacagtgagaatatacttagtgccactcaactgtacacttaaaatggcaaattttatgttctgtatattttaccacaataaaattaaatctcttaaaagttagttacagccgggctcagtggctcacgcctgtaatcctagcactttgggaggctgaggtgggcggatcacgaggtcaggagatcgagaccatcctggctaacacggtgaaaccccgtctctactaaaactacaaaaaattagccaggtgtggtggtgggcacctttagtcccagctactcaggaggctgaggcagaagaatagcttgaactgggaggtggaggctgcagtgaactgagtttgtgccactacattccagcctgggcgacagagcaaggctctttctcaaaaaaaaaaaaaagttagttactactgttcaagaataaattgtgccttatttgccaatatacgtcatttgaggaggatgacaaaaattgaagagcttgatggaattcagttttgaaaagtgagatctatctgtgtttcctacaaactttattttttttgagacagggtctctttctgtcacccaggctggagtgcagtggcacaatcacagctcattgcagccttagtctcctgggctcaggtgattctcccacctcagcctcccgagtagctgggactacaggtgtgtgccaccatgcctggctcttttaaaatttgttgtcagggtctctccatgttacctaggtggtattgaactcctgagctcgagcaatcctatctgccttggcctccaaaaatgttgggattacaggcgtgagccacagcacccggccctacaaacttttaagaagataaatgcttgtagaaatttaattacattttgcttctatgaattcctgatgaaaactttctgaaatctgtcataaatacataatcaaaagaaaaaataaatatctttaatattttcacatccctgagctttctgactccttccttagtgctatggcaagctccagtccaggcaagttgcagcttctggactttatttattataggccactattttgtccaagcctcaagaaatcactcttgcagtgtattgctacaggtatccttgccaggacactgagttttctgatcaaggaagggtgctcccaggtcaataaattcaccattatccagctttctattccactcacccaccctagtgcaacatcctcaagatccactttcacaagcttatccaggttcctgcctgtatacattacccaggtgaatggtttggctctgtgtccccacccaaatctcatctcgaattgtaatccccatgtgctgagggtggggcctgtaatccccatgtgttgagggagggaggtgactggattatgggggaggtttcccccatgctgttctcgtgataatgagtgggttctcacgagatctgatgattttataagcatccagcatttcccctgcttacacttctc

SEQ ID NO: 36096 - DNA, 1076 bp, Homo sapiens
ctttgcttcctctttgccttccaccatgattgtaagtttcctgaggcctctgcagctatgcagaactgtgagtcagttaaacctctttcttttataaattacccagtcttaggtatttctttatagcagtgtgagaacagtctaataccccaggtccttcagtttctttagtaaactatttcctactgcagcagggatacatttccccacctgcttgagccaaaacctgactccagttatcatggagtcagttaattggagatggaaggagaccttgaggaagacagacatcactttgcaaagcaagattcaggtgaggtattttcagggtctcctggcaagatgaggctgatgtccccagcaaggagaagaaggctgactttgctctcctagaggatgaaaattaatctagtgactcaatattctcagacttgtctatcctatcccagctcttaagattttaagcttttcctatcagggttctaactttgaaataggagatctgtgaaggcttggcgttctgtctcctctatgactttgtcaactgttgtcttaatcttcaagacagtattccctgtgcctgcaggagatcaaattcttttaaccattgctctatttcaccgtgggcttgagttgatagttgtctaacatgaccctgtcattttcttattttgagactttcaaagcagttaacaaaagccagtgaattccccattcctttacaattataattgcctccatattgtccaaggaccatagttaccacttgacccagagcctctcccttccacctgtacctcatcccaatccaccacaggtgagaaccttaattgtgttgctgctggatctgcacttaccactcaagctgtgatgggaatgatgagaaaaacgttcttctcttacagtgaccgtcctggctacctgcaaagtatgcttagaattctagattcctttgaagtctgggtaaagatctcccaagggctggctgatggggacatggggattcttaatcctgttcacctacaacgtgccatccaaagggaacctcagaagtagtaattgcccacctttatggg

SEQ ID NO: 36097 - DNA, 1081 bp, Homo sapiens
tggaatgcagggagcccaagaattctgggacttgctgagttggaaaataaacttttgcatctccaatatagttggcaagtcagctatattgggccttctgtcctggaaggttccacagttcatcctcacagggttagatacctctcctggctttagatttgcctttccttgccacagagcttcagcaagccccactacctggggccgatctgtagtcatggaagcacacacagcataatattgaccagaggatcacttcatcgcaaaggaggcttgggaataggacaatgaccatgggatccactggtcatatcagatactgtatcacctagatggagccagcctcataaagcattggaatggttactaaaggcacagctggagctccagctggaggcaatgctctgaaagaacagggtaccatcctgcaggatgcactgtatacattaaactggggttctccatgtggtgctatgtcctcaacaggaagaatacatgggtctgagaaccaagaagtggaagcaggagtggacccacttatcatttccaatgacctcctggggaactttgtgcttcttgtctctacaactctgggctctatgagattagaggttttggtcctcaaatgaggtgcagcttggcaggagacacagcaagtgtcccattgaactatatactatggctgccaccagggcattttggactctttctatgaagagaccagcaggtgaaaagaagaaatcattgacttccatcagcagaaagaggtgaggctgcctgtacacaatgggacagggaggaaggaatgtgtatggatcccaggtgatccctgtggtcaagtttttctgtagtcttgcccaatctgtgatgtgactgccaacagctaagaccttctggaataaagataatgaagataataaagagggggaggggaatttagattggatagtgcaggtaggagaagatgactatgggttgcgatctcaagacaactggcggcactaggggctatagttcctcccattaacttctctcttctaagtatttcctcaagaagagggcccacaggagccatggggaa

SEQ ID NO: 36098 - DNA, 1034 bp, Homo sapiens
cttctgaatgtgtgaaccctgaaagagtccatctaaagctaagttctccccaggggtagagcccaatgctgggcatacagtagggactcaatggatatttatcaaatgaatgaatacaggtggaattcagatccgtttggcctctcttttctgtgactggggaccactgaacctgagtcactaagtgataactcacaacacaaattttcttcttgttccaagcagccaggacccaggttctaggtatctaaaaatgctgtgcctgacttgagttcgcaatgacattttttatcaactgaaaatgtttacttctgtgcaaccagccaaagctgggggtaagcagcccagtggggtgcgctgattctatcttagattacgctgtgcacaatggactctttgtaaagtccttatggcggggagtggccaggcaggcatctcctgcacccagctctggagactcacttgccacaaagctgaagaaggacggggcagttttaatatacctggcttagaaaagccacagactgttggacttacatgtgggtgtgtaagccccacacagaagcagctttttctccagcattgttaacaaagctcatttagaggaatgcaagtctggggcacggcctggatgggcagcatgacgcacacaccacataagctccagacgctcactgatccccttcacagaggctgagcctgcccacccaaccctgccctcgccctcaccctcacctccgcagccggacctgggatagcactgcttttcttgagaggactgagtcttagcattgaggatgggaaggggagtgtaagggctcttccaggagagaatctcctgcttatttgcatggaggaagaagggagcctttcccagtgcctacacgtctgagtcccaattgtgagagaaaatgaattgcttaaagttgcagttctcaaccagaggtgattcccctcccaggggatatttgcaacacttggagggatttttcatggtaatgacttgggaggggaataagggaggtggtgctatg

SEQ ID NO: 36099 - DNA, 1063 bp, Homo sapiens
cctcactgctgacgtcaagctagcctttcattttatttatacccatgacactgtgacacaggatctaattttccattgtattttttcctctgttgggaaccaagtgatgacaagtaaatttgtgcctgagcctggaaaatattttaaatttgaagacagggacgatacgagagtctaagtctatctccatcctgcccctctccccttgaattactaaattaactatggaacagggcaaaggagtaacactctgacagggcatggcagcctgagaagtcagagctggaagcatccagttgcctgctcttcacttgtgtcaggctgttccttcctggcacgggggctggagggaggccagggagcagcgaggctgcacggcagccctggcacagagcctcggctgccgtctggggatgaaactgggctctggcaccaggagcgtggttccagctccctgacccagaactgcctgtgcaggggctgctctgccacttgtgccctggtgggaccccactcctcctgcccctctgaggcagggcagattcaggagcagagctggatctggatggaatggcaagtcagggatgctggggcgaaggcaagtcatatcccttctgcagaagcagcctttagggatgtgcctgtgatggggaagagaatggcatgtgtgttcagcaagtgacagagtgggctttaccgcagctccttcctctgctgccagaccagtggcctcagctccatcaacagcctccctccattactccccatggcttcaggtccagacacagcatttctaacatgggtccctcctcccactctgaaatggaagctccacctcgtccctgcagacctgccatgttttcagtagggcctcttttcaccagctttgcaatcatgtttttcagcctctaactccagagaaatcttgacttccttgtactcagttcagaagacgtttgttattcaggattctgatgcagaggtctgataagagaggcctcaggccttctgagttagtaaaaccaacagagtctggggattcaaaaaatccaagaagcacaag

SEQ ID NO: 36100 - DNA, 1050 bp, Homo sapiens
gaacagtaaggggggaactgccccatgattcaattacctctcaccaggtccctcccacaacacatgggaattatggaagctacaattcaagatgagatttgggtagggacacagccaaaccatatcagggtggttatgggaagctgagaaaccagggtagttatgggaatctgagaaaccaaacctgtaagtcagggaaaccctcagaagctgtagccttcaggagtggacagggagggagccaaagcagtaagtcccttcatgacattgtcctccctttcatcaagctcctgctggtttccacatctggaaaccagagggaaaaggaatctgttgattggggttttccagggtgctgagcagggtggagagtgggtctggaggggcaaatgaaaaatatcctgagcatatcccaaaggctcttcgtaacaggcaataagagatgttcagtgtcactggagctacctcggtatagataaactaaaattgtgatgggcagtttgatgattgtctaaaataatggcattttaaaatggccacttaattcactgtttacagttcctgtttgatgactaatgatattaaaatatgtccagttatcttggttggagacctcgaacttattgctgtaaacatatccttctcttcagttcattctgtcccctgactgctgatacactttttttatcacttcctctgtcccctgcctgctgtccttctccctatcctgaactcaaagcccaagggtggaatgggggagaaagacctgagcctcataagagactcaggaccctgtcttatcagtttattccattttttttctcagtttttactttcccactttctataaccttctctccacagactcaaaaagtgaaaaaaaaaaggattttgctatgtgcttgtaaggttatattttcaataaagaatgtgtacatttagaacatatttaaaaatattaaaatgtgtccaggaatttatttttaaagataggtgttacctttaccctacagtggaagtcttggtagttatgttttagtagaaaacacc

SEQ ID NO: 36101 - DNA, 1028 bp, Homo sapiens
acttgtcccaacaccaaattcacgcaaggtgtatgccgatgagcctcctgtaaaatatccagagcttctaatttggggtaagatgaattaagcactccattctctctctccaacttaatgcaattataaaacctggcgagaatgcatggagcaattatttaagaaccttgaaaagtaaatagtaacaggtagattgggagggcagccagaaatggaagaactaccaaactggtggtgtgtttacaattttcccctcactggtatccctcagcctgtatccagtgctctccaagagacctccctgagtccttagttctggcagaaggcacaggaaaagaaaggtggccaaatatcagtagcaaacgtgcttaaagagaagttaacagttattagctcaacatatttcatctacatcagcatgttttaaagtatgtttcaaaggacaatagttgtgcagaatgttaggctcaaatgaacaaaaaagcaaaatagtggagatccagtgctgtttgggattaggctctttgtaaaccactaaaagaagctagatatatttctaatttggtaaaataataggtatgatttggagatccagtttattatggctaaaatttattagtgagactttaagacatcagctccttctgttagaagttttatatcaaaatgtcagtcaaatttctttttctttttttaatttatttatgtatttattttttgaggcggagtctccctctgtcgcccaggctggagtgcagtggcacagtcttggctcactgaaagctccatctcccgggttcacgccattctcctgcctcagcctgtagctgcgactacaggcacccacgacctcgcctggctaattttttgtatttttagtagagacagggtttcaccatattagccaggatggtcttgatctcctgaccttgtgatccgcctgtctcggcctccctaagagctgggattacaggtgtgagccactgcgcccggccaaatttctttttcttattagatttaacattcta

SEQ ID NO: 36102 - DNA, 1033 bp, Homo sapiens
gataaaaatattttgaaggactttgtagttaaatcactaaacttgtttcatcttgacataaaaatggatgctccactaggatgcacttgtagctttgtatgtctcctggccctatctctgcaccatcaccatttctaaagcattgcctgtcttacacaaaggccccaaggcccgtaagaaatagtaatgattttaaacaggattccaggagagtggagcccatgaatctgcattgttgcttacagaattacagcaagattgggaacatgagagttgtttttttgtttgtttgtttgtttgtttgttttattttattattattattatactttaagttttagggtacatgtgcacaatgtgcaggtttgttacatacgtatacatgtgccatgttggtgtgctgcacccattaactcgtcatttagcattaggtatatctcctaatgctatccctcccccctccccccaccccacaacagtccccggagtgtgatgttccccttcctgtgtccatgtgttcttgttgttcagttcccacctatgagtgagaacatgcggtatttggttttttgtccttgcgatagtttgctgagaatgatggtttccagtttcatccatgtccctacaaaggacatgaactcttcattttttatggctgcatagtattccatggtgtatatatgccacattttcttaatccagtctatcgttgttggacatttgggttggttccaagtctttgctattgtgaatagtgccacaataaacatacgtgtgcatgtgtctttacagcagcatgatttacaatcctttgggtatatacccagtaatggggtggctgggtcaaatggtatttctagttctagatccctgaggaatcgccacactgacttccacaatggttgaactagtttacagtcccaccaacagtgtaaaagtggaacatgagagttgtaactgaaaagcttgtgaggcagtcttctaagatcaggggctcccatgtatgcagtggagtaggccagaattgctccca

SEQ ID NO: 36103 - DNA, 1010 bp, Homo sapiens
ttcggcttactgcaacctctgcctcccaggttcaagcgattctcctgcctcagcctcccaagcagctgggattacaggcgcccgccaccatgcccagctaattttttgtatttttagtagagatggggtttcaccatgttggctaggctggttttgaactcctgacttcaggtgatctgcccacctcggcctcccaaagtgctgggattacaggcgagagccaccgcatctggcccaatcattaactttttaatcagcgttctggcagttgcactgctttggaaagagggtgtctatttcaataacaaaaactggcttgggagtggagctgggtgaagggctggcagcccagtgacgcagcaggttctggtgctggtcctctcccagtagagttgctcttggggctgtgcccctaggctactggtgtcagcacccacaccttgcaggatactgacttacttagacaaaagaagagtaagagaagtccacactcaacatgagcctgtcactttgacctgaacacagcagtgaaacactgaaggaacttgttcacaggctcagggactcaaagcctccagttggttttcattgtgccaggcctgctgagtggacccatggttgaggaggctgcctccccaagaggagcagaacaggcatccttgccctcctgagaaccccccacagagggccaggaacctcagatgagcagtcattagagggctctttgagttttctgctggctggtttggtgagaggcccaagcgccctgcatgagttctttacactgctgtgttggggtggggtaggagaatcaggcctacagaggagaagaagactggtgctttggagagtgttcatagcaccagcactaagagttaagcttggggaaaggagaagaaaggagaaagggaaattattatggtcttgcaaagtataatgtaaagaaagtttgcttttcttgtttgttttttgtaactgaaaaggctcccatggcccttgggtcactgcaa

SEQ ID NO: 36104 - DNA, 1090 bp, Homo sapiens
aagatgaggcctgaactatcttagagcctcagttcccctaaatgcagaatctgaggcagaaggcatatgtgttgttatacttcacttctctcattttataggtagggaaattcggacacagaagttaatttttctaagtttactcaggagtgacaggacttggaataaaattgtttcatggaattgcttcaataagggtaaggataatgtgagaaataatttctcatagcaattgcttaaaagtgctgctggcaatataaaatgaaacaaaaaaaggaccagacctctcaatgtcattttggctgtaagctaagaaactagaatttcttgttttctatattatttaggttcattacatttattattaattatctgcaggaaatttttaccaaattatattcacaaattatgtttgtttccaaagaaatctttctctagaatctatagagtgtactcgataatcaaacagatgcctacttaggaggtaagttggcttgggcatgattgctttagttaagtttctaatttactaaggactgatttgggtctataaacataagtgagtttcttttagatttgagtaagactgttacgacccttgccatgatatgaatttttcaaaatcatgatttattgaataattcctagtgattattaagcacgtatcacagttataaaagtttcgctaaatacacttgtcttagagtcttgttgagagatttttaatggcttttcctagctcctttttaaaaaaagtggggcatttagaaactgtagtactcttccaggtgagtgaatttgttagtatttattaaattcatatgattatagtaactctgagaattatggagtaggggaaaaattgaactcaggggagggcctctcagcttggggcatttcttgtttaatcaaattgtctagtgtaagtgtatagtcttgactgaaccaagcagagctattgaagagtattttaattacattttatagagcagcacaatatttattctttttcttctgaggaaatatagttttgaacataaatttctttattgcattttcttccaacaacttggtctttggatttagattt

SEQ ID NO: 36105 - DNA, 1056 bp, Homo sapiens
gatcatagcaaagattggaaataaaagtaaatgtaaaagtaaatgctgaatacttagtaggcgtcaatatcatttatcgttacttaattctttttcagttttgttgtcttctcccaggttagagactatggcttcctcaacactacagttgctaaagctaatttgaaacattaattatgtaataattcagagatatcagttctttaccttcctaaatctagtgtcattcttggtatattgtgtacatgctttaatgctttgtcatctaatactgcattaggagagtgaactcagttcacttgagaaaatgattttatcaaattgcctgttaacttctagccaggattaaatttctagaatctagaaggaaacaagtgcactttagtcactgtagttgaaagtagaaaattggaagaatgattttagtctctttggaactaagttataccttatttatttattggcttttaaaagtatttaaggtgaattttagcacactcaagataattagatgtgtgtatttgtaaagtgagagttggactcgtacttctgtggcactgagagaatgacgttgatagcgtgaatgttggctaagcaggattcatctttctgatcctacattctatctccctccttttttctttttgagttaattttgttttgtaattacgaaaacatttcatggttccaaagtagaggctataaaacaatgtaaaattaagtctagcttcgaagtctatcatttttattagtttttggattactcttccttttaaaaaacataaacacacattcatttttatctgccttttgcaccaaagcttaacatttgtttacactcctctgcaccttgcttttttcactcagcccatagcacttttatatctccttataccattttacaactgcataatgatactcagctgcatagtactttatcatgtagattgtcatggtttattcagtcatcttctatttatatatatttaggttgcttccagtcgattaattagtgtgatgcttccatgtggttacaaatagaattttgctgatatt

SEQ ID NO: 36106 - DNA, 1034 bp, Homo sapiens
ctgtaaagatatggtttttcctcctaagtcctgggtcttttcctggcagacactgcttttcttcttgggcttcagatcaagagacatcacgtttccttttcgggaagaagcccttaaggtagtgcgcctctggtttagctacatcattgcctgtgaggaggagagggccaacagaatttttgccaaacagtacatgtattaagactcgctttcctgtgtatactctgttttcaaatcaaatatgtaagatacaacagtgttttgaaaaatataaatggaaacatggagtagaatacatttgctcttaggaagtatttttttatttacaattttttgttggatgaattcataaattgaatgtaaatctttctttttctattttgttttctgattccacagtccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggtaaaatgtgtgtactttaaaatacactctttaaaacctgtgaagtaaataattcgtagtatacattaaagggaaaattgatgcattttcattaaaaaattcttgtattgttgtgtaacataccttcaggaaagttcaatatagcatgcctgtgtattcattggattttgtaagtcataaaattccatttttttctcccatttgataaaagaccaaacatgaaaattgatggaaaaataagaacagtcttagaagttaatatttataaaatattctcttccatatgttatacttcaaggaaaattttgctgtttgcccaccccacctcccaaatcaaaatcccaattggtgcttatggtttttttttttttaaattaacctaagtaaggtaaatatacatgcaatatttaaaatgagccatttgcacctagcaacttggattattttctttataaatccattttaggttttttca

SEQ ID NO: 36107 - DNA, 1238 bp, Homo sapiens
gcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgca

SEQ ID NO: 36108 - DNA, 1033 bp, Homo sapiens
ccctaacatagaattcatcccattgactgtcctttaccatcactgccttaattcaggctttcgtctcttgtgaataaaatcatagtggtttcccctaaacataggcatttggactgcctacctgtaggtgttcaatttttcaggatgtttggctagaaaaagctaaaaagctgctaatagcaatgtgttacttgattgacttttctttcccatgtggttttggtttcactacttcctctttttgtgtgcttttatctgtgtcctgtgtaccttagtaaaattggcagttcttgtctgcaagacttatcttgcacaactgttcagggtaaggagaggaagttgcaaggaagaagatagtagtagggggagcagtgggatggctctgccaaatgactcagctgctagtgagggcctctgaaataaagttattggttcttactgctttgaagagtaaagtttgctttgataccctacccttcattgtttgagagttgaaaaagattgtttgaaactactgaaataatatccacataaaatatccacgttagtaaggaccgttgtaagtggttgtttggttaagcaaaaactttaagggggtgtaggtgtaatttgaatgcagcatgttccagaaagatcagtgtggaaagtggacctagtagcagaattgctagataacaactaaggatgggaagcgggggaagcacatgggaggattccccagcttctgctaaaattcaaccagggtccattctctgtgtggattaacttttggggaatacaataacagctgaaaaagcaatggaaattttctaatttttcttgggttattcaaatcatgattatttggaaaactgtgtgtggtttttttaaactgatatgggtaactttgtcagcttttattagaaaccaaaacatgaatctaatttcaactgtcataggccctagatcaggggaagaaactgcctttttttggtatgaaataataaatgcttcatgggatacagagagttgagagttgagaagggcatttagt

SEQ ID NO: 36109 - DNA, 1048 bp, Homo sapiens
aatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggaggtgagtgagtgagctcctagtctgggctctactggtcgcttttggtttactggccaaaccaaaggctggagcctcggtgtcgggtgtgcgcagtaggacggttgtttttctggacaagcggaaaccaagaggggttcctgatctaccttgcccttcatccctctcggtggctgcttaattgactctctgaaggaccttcgtctttatttcctcccccatttatcaaaagtagtaagtgcgctctgtgtactactcagtactggtaatgcgcaattaaagccactaagaaaagtgttctgtaagcatgggctacctgagcatttttctacccctaaagctcttccagcaataactgcccagatgtcaactcttctttgtccttgtcacctttatttaaaatagtttgtcttacggagcaaagttgatctgttttgattcttctttgtgcagtgtggcaacctacgcaaattttaaattcatttttaaacgagtgacctaagtgaaaaagcacctagtgactatcggatgcaaatttatttttaaaaggttttttagaagtgttttgtttctttttttttggactacctcaggtctttacagatggct

SEQ ID NO: 36110 - DNA, 1029 bp, Homo sapiens
ggaaactagagaagtttttaaaattaatttattcttactattgcaagaatttaaaggacttagaagatgtgtccttttaatgtgaagttgtaagtaaaatttttataaattgataagtgtaaattcctcaaaggacagtgtttttaaaacgagaaattttcttttagtacttcaaaggaaaatttcttaaaacataaataaattcctcagtaagaggtttttacttggggatggtgaattccctgtaagaggggctatggatggattttaatggggcgtcctgccgagttttatatctgtgggcatgtgtgcattttagagagaaaggcaataatgtgagtcacaggaatgttttggtttcacagtgcgtttaaaagttatgtttatgctataatgtacattatacttcttaggggctaaatccaagtgaaaggtgaaatttgttactggtatgtttgaatttggacttttacaagagtttactattggaagcagtatttatacagtagacactgaatcagtccttaaatgaatgcaggtgccaccaagacctctttgaacagttttcagcagtagccttggttgttggtcagagctgaggtttgtattagtgtatgtgcgttggtggcccatactgcagcttaggtttgacctggattttataaataatggtttctgtataaggacagctattctcaagatgattaactgtggtgctttagatagtaaaccttaattatgatggtaggcttgattaagatctaatcatcagtgttcattttggaatttattatgtttataaagatgtgctcaattctaacttctcttctgttgaaaccacggtttggaagtagcatgtgttttcaaaattatccgtgtaagccacataataaatagcctgttgagtgagtggagtcagaaacacctaggttgaaaataggactaaccacttctgatgacctgcttagttatttaacctcttttaaaaaggaaggtgggggaaataaaggatgtcttaagatttgagta

SEQ ID NO: 36111 - DNA, 1066 bp, Homo sapiens
atttaactgaaggggcaaggggcaaggagctctaggaggaagttttgtttaacaggtgtcctcccaaggatacctttgggtccttagaaaataacttttctaattttcttgaaaacctaagattagttttaaaactcaagccctgctgaaaccccaactatatacattagagaaatgacagtactttaggagtcttgggacgccacctgtctttcactgggccagcaagccatgacccatgattacatataaataaatggtggaagcaggctgctatttatagggaaggatataatatgattccaatgaagagagctgctctgtctggcagttcttgactgcattgactggaagtattgaaaaataggatattacatgttgaggacatatgggagctgtagactttcaagacagaagatatgtcaacattgtagcttgatgccttgtctaaccatgttatactcccatgaaaatattgcaaactgctcttttactgtaaaatacagttaaagaataatgaaactaagtgaatttgtgggattcttaaagtattgatgaaagacttgaaagttggaaacatttacaatattttgatgctaatcattttcttcaatcctgtacccaaatgtacttttagacagttttttgcatcactgaaaaagatgtaagtatagaaaaatggatatatgcttctagtttagggcttctataaaacaaaaacatggagactggtagcaggatgtcacccttcttggtaattaatttgtgtaatggtttctctgcttgccacttaacatcacaagatgcccagtccaccagagatttctttcttttttctttttttccttttttttttttttgagacaggcttgctctgtcacccaggctggagtgcagtggtgtgatctcggctcactgcagcctccactgcccggcttctagcgattctcctgcctcagcctcctgagtaactgggattacaagcatgtgccaccacacccagctaacttttgtatttttagtagagatggggtttcaccatgttggccaggctggtctcgaactc

SEQ ID NO: 36112 - DNA, 1071 bp, Homo sapiens
tataggaaacggtttacacgaaagtctaatgcttagtaaattgtatcttttgaaatgaagttataaaatgcattccctgtattttaagattatttgccaatacttagattaaaatagtttgaccaattgaaattaaaattgtttttaaggtagtctagtattggaaaaacatgaaactttataggaaagaaggcagattaataaattagcagtgttaggtgagatggcttgggcttctctgcaagagtattaagtttaggtgctgcataatagctttgtaaagtactattctgtctgaggacaaaaagcatggtggaaataatagataaaaatgttaatgtttggatagagtaactgatattctgtcctcagttattgtacatatttgtgtacagtggtattgtgacttaattaataatcatataatgacttgatgtttttgtgttggcagaaaatagtatctaaactttgtattacatttactttattgaccctgtaagaagagcccaaagaagcctagtgtttgagggttcgcttactgttgaattgtggcatttgatcacttgtaaatgactcagggggattttactattgaaagatgttggcaccatttttttcccctcattcttttaacacttttgctattcctgaaacctggtagaaaaccattatctcgaagaaagtgttagttttcaagcgaagtataagataaagggcttctttgtatgtacatattcttggaagaagggaattattgcctttgacctaaaaggaagaggctgaggcacaaaatatatttgaagagtttacttgggccaaagtaaggacagctgccgagaagactcagacccaagtatccttgaatatgcacggtctttgttacaaacaggttttttgattttttttttcttttcaggcaggatgtgctctgtcacccaggctagtgtgcagtagcgtgatctcaactcactgcaacctccatctcccgggctcaagtgatcctgcagcctcaacttcctgactagctgggtcaacaggtgtgcgccactacgcctggctgatttttcactt

SEQ ID NO: 36113 - DNA, 1022 bp, Homo sapiens
tgtgtcagccctggttgtgagcttcatttcacgttccaatctgcaccaaccaggtaaacattgcaggctgggcgcggtggctcatgcctgtaatcccagcactttgggaggctgaggtgggtggatcacctgaggtcaggagttcgagaccagccaacatggtgaaaccctgtctctactaaaaatacaaaaaattagccaggcatggtggcacgcgcctgtaatcccagctactcgggaggctgaggcaggagaatcgcttgaacccagaaggtggaggttgcagtgagccaagatggcaccattgcactccagcctggacaacaagagtgaaactccgtctcaaaaaaaaaaaaaaaaaaacattgcagtgatttcagcaggtcttatagaacagttttaggggagaatgaaaagtaaataagatttcagaagagcacatttttgaggaatattaggagtattttatatattacttttaggtgtatagtgcagtacttttgagactcggaatttgcaaacctgcaagtttttgaaaatgctatgcaattcagacttaattgaaagtctgatttcattttaattcaccagtatgctaggcacattgttagacttaggatacaaagatgagcaaggcatagtccctgctcctcctagtcttttagagaaggcaaaccaggtgaacagatgagtgttctgccggccaaaaacagcaagagcagggagtgaggaaaggcttctctgaagagatgacacttgtactggcttttaacatctgaatagaaattggccagattgatggtgttggggtaattacaagcaggacagaatagtttttagcaaagacactgaagcagaaaacagcatggtttgtcagagcattctacattgtaagacatgctgcagggcggggaccaagttatgggaaattttacataccacattaacaagcctgagctttgtctgtagtataagttaagcaaaggggtagtatgaacagattcacattttagcaagataag

SEQ ID NO: 36114 - DNA, 1041 bp, Homo sapiens
acacggagcatccatgaagctcttagaagaattaaagaagcatccccagagtcagaggacgaagaggaggctttaccttgcacagactgggagaactaacaagtaaacggccttattgtctttagtagcattcagtaatacaggttttatatcggatgatgaggtttggggtattttttattgagcctgaggcatatcgtttgttttataacccaattttagcatggatcacaaatttatgaacttcaggttttacttaattctgtagtttctagaaacttaagataactttttaatgattattgctatgtaaatactatttttaaaaatgtcctcctcattaaaaatttctgctatacagctgtaattgcaagtaaagtgacagtctcattcttgccctaaaaaaacagaaaagggcctggcacagtggctcacacctgtagttctagcactttgggaggctgaagcaggcagatcacttgaggtcaggagttcaagactagcctggccaacatggtgaaacctcttctctactaaaaatataaaaattagccgggcgtggtggcgggcatctgtaatcccagctactcgagaggctgaggcaagagaatcacttgaacccaggaggcggaggttgcagtgagctgagatcgtgccactgccctgggcaacagagtgagactcagtcttaaaaaaaaaaaaaaaaaaaaaaaaggctttccaggttcagtggttcgcttctgtagtcccagttactcagaggttgaggcatgaggatctcttgagcccaggcgttcaaatccggcctgggcaatatagcaataccccgtctgtaaaaagaaatcaatacgtcaattttttttttaatgcaaagccttttctgacaaagtatttcagtaacaaactgttatgcacactgaattttgatgtcatgttagctgacctcaaaggagttttctaagatcattctggaaaaattgttgcattgtctgattatttaactttctaaacccttaaaaaaaactacttattgtcacagtt

SEQ ID NO: 36115 - DNA, 1042 bp, Homo sapiens
catgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataa

SEQ ID NO: 36116 - DNA, 1060 bp, Homo sapiens
gaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattat

SEQ ID NO: 36117 - DNA, 1050 bp, Homo sapiens
gccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtacgtagctggattaattaaaaaatttaaaaggcatttatcttttaagccttaattaaatggcatgaaattgcttcagcttttcactttataggaaaatgcacaggttaagactgttgtgtgcgtttcttttcttgttcagcctttgtagaaaagctcttcgtctctcaaggtgagaacacgaaaggcttatatgtctcaaaacttatggattctctaaattacttgtcttatctctttcaactctttgtttaaagtagcagatatttttcattagggtgaacagagaagaaacaaagggaaactgtaaaacacaagctaaataacacatgtgcagtgtatgattttgtgaagaaagagattgtaactgattactaaatctgtgtttttatattacaggtaacatagtaacttttgtaaatatcttcatattgtatggttcagtaccaccaggcttctaacacgtactgattaacagccataaggctattaatttatactgattaatagccagtaatagtgacgttactttgttggtgtgaatagccctaattatgtctgttctggaaatgtcctgtaacaggttccatgtgaaataggccgtttatgagttgtttaagaaatgcccatttggagccatgtgactagattatttttttgaacacttgggtgtaatttaat

SEQ ID NO: 36118 - DNA, 1947 bp, Homo sapiens
tgccttttttatattacctattgagtgtttttttctttggtaatttatttttaactagctacttttctgtatttctaaaattatttctactctgttaacagaacttatctctatggtcaaatacatcagataatccaccagttgatttttcttttcttagatatcttcttgaagccctgcatcctcccattctaatttgaactgttagcttcccatcactgtcatctcgggtaatttactttgtttctgccctacatcagatctccctttttctagattccaggttttctttttcttttttgataacttaaatgtctaagaatgtttctagttgcctttgcattgatagtacagctaggtatagaattacagcctgagagcatttccgtcagagatttgaagtcatgagtccatgtcctgtgctattgagaagtccaaagccattttgatttcttgccgtttgtttataacattttccctctttgaatattttataaacttcctttttttgtgtgatattctgaaacttcaatataatataccttgacatgtaacttttttactgtgctttgtaccctttagatcctttcagtctggggattggtgtctttcagtctttggcattttttttgttttatttattaggtaatgtcctgtattttttctgttctttctggaccttctgttacaatgttagatcacatagtttaatactttttgttttctcttctgttgtcttgcctccttcctgcccctaccaccttttccttttcgttctttctaatacatttcctcaaagttatcttttaaatttctgctgggtagttttgctttcaattttataatttcccagagcctgtttattttatttttgtgagatagggtcttgccttgtgtcccagggtggagtgcagtggcatgaacatggttcactacagccttgacctcctggactcaagcaatcctcccacctcagcctcctgtgtagctgggaccataggcaaacactactgtgcctggctaatttttttgattttttttttttatagagacagggtctcactttgttgtccaggctagtcttgaactcctgagctcaagtagtcttcccaccccggcctcccagagtgctgggattgtaggtgtgagccaccacatccggcccctttctttttaaatagcatattcttgttttatatatgcaatgtcttttcattaatctgagttttttttttgagtgttcatttgttcctgacatcgtttctgtttattcccaggttttatttttcttctggtgatccatggatgcctattttaagtgagaatatcaggagtctaattagaaactctaaaagtatgtgggtagggcctgtcaactagttggcttcatgttaagttgattagttagctaccttgacattttcttgatggactcccaagtattattatgttctcttgttactacgttacatagtttctctctcattttgttttttcataagagttttctaattgcttgctttgagaaagtgggctgaggggtcctatttttctttgtagactttacctgatcctcattttcagtttattactttatcctatcctttgcaagactacagccttgatatattggtcactgcaaagaataaatatctactctcctccctggatcagtgaaggattctgattgctttgtacaatttttccctattcctgtggaacatagccctcttttattggaagtcttttatataaattatgtagactttgaggggaatctcagaatcttataaattgttaagacaatataaaatccattccttatttgatcagacctgtaagatccaaattctaggaatcaggatgtcatgtgatggtttatacctttgtataaattagtttgagaataaatgtaataatctgtgggattttattaatgtcaggtga

SEQ ID NO: 36119 - DNA, 1095 bp, Homo sapiens
ttaaagaatatttttggagtgccattatgcatggtcagcttgttattacatatatgatctaaatcgtatatgatttttagccaaggatatttcatattatacattcctcctctctatttttttaagaactataacaacagtgagccatctcctggaatatttctctaaattaaagcaccagaaatgttgtttcaacatatatgtgcatttctctttttgtctcatctgaactctcaatgtttgttctagggtaaagtaatatgatttgataatgtgaatccccaagttaatgggtagataatgacgaaaattctttcacataaaaactcattaaatctccattatagtagtccttgggaaagaaaaagtgtttccatgcatgtaaaaaatggagaggaacaagaatatggaatttcatattttccagtcattgtaaattttttaacatgtgactgtttctacattaacaaggtcattcagatgaaagaactttataaatataataacatttcacttgggcattgtgaaggaattttttttttggagacagagtcttgctctgttgcccaggctggagtgcagttgcgcgatctcggctcattgcaacctctgcctccagggttcaagcgattctcctgcctcagcctccggagtagctgagactacaggtgcatgccaccacacctggctaattttttgtattttagtagagacagggtttaaccgttgttgctcaggctggtcttgaactcctgagctccggcagtccgcccaccttggcctcccaaagtgctaggattacaggcgtgagctaccttgcccagccaagaaatttattttgctattcaacaaatactgagtacctacggtgaattctaggattatgttgatctgatctgcctgattctctacatcaggggttggcagaagggccagatagtaaatatttaggcacgtgggctatgtaggtcctctgttgcatattcttttttcttttctttttaacaatgactaaaagtagaaattatttagcttgctgcctatacttggcctaaatagttcgccaaccctgctctaggtcagtaaaacttaatc

SEQ ID NO: 36120 - DNA, 1031 bp, Homo sapiens
acagaaagctaattgttgacttaagccattttattttacgattttactttttgaatacactgactctaaacatattttaatccacatgttaagccatctcaaataatttcttttaaacttccatagaattttatagaaagttgaagttacactgtgtgatattggaaagacacttgtccatttgttgaacagacattcattatgtgccaggctttgagctggaaagtacaagtcaagtaacaagtcactgtctttgaataacttacatctgttctaggagagaaataaatgatttatttcagtggaccttctgcattctgaattattctgtaaaataaagaataattcatacctacttgaatttttaatagctatttgaatcaaaatattaaaaatggaagggcccttaaagatcatgtaattcacatgaatttttttttctttttcttttggttatttttaatagttaaggaaactggtgatcaatggatttagtaacttgcctggagtatagtttgttggtctcagaacctgtacttattactcaaaacttttaactcctaattttatttttctgaattcctgctcataagttctattttgaagcttgatatattcttttttttttttttgagacagagtctcgctctatcacgaggctggagtgcagtagcatgatcacaggtcactgcaacctccacctccctggtttaagcgattctcatgcctcagcctcctgattaactgggattacaggtgtgtgccacctcacctggctaatttttgtatttttagtagagacagggtttcgccatgttggccaggctggtcttgaactcctggcctcaagtgatacatccaccttggcctcccaaagtgctaggattacaggtgtgaaccaccaagcccagctgatatatattctgtaattttgatggtaaaacattgtaacagaaaattttcaggttttaaaaaatcccggtactactttttctgtagttaaaaaatgagaaaattgctcatttgggaaa

SEQ ID NO: 36121 - DNA, 1051 bp, Homo sapiens
cagagcttttaaattatttcccctgtatttaatttggctttttattcctgttgttttaaagtatatgatgctataattccagattatttgagagtgtataacttaatgggataacttgctcagaaatgtttttggtcacatagttttgtttatctggaaacttgtgagatttaaaaattttcggctggatatggtggttcctacctataatactggtgatttgggaggctgaggtgggggaattgcttgagcccaggagcttgaggctggagtaagctatgactgtgctactgcactccagcctaggccacagagcgagactccatctctttaaagaaaaaaaaaaagatttaaaaattttatttggggtaattggagccttagcagtatgttactgatctttccactggaatcttattttatattttcagtactcatcagatcacattgaaataacatactgagtatttgttcattcttatttctttagtgtgtcattttaaaaacacagatctatggcctttgggcccatactattttgcatcatgggatggatgagcattaatttagttattaggaaggaagtttttttgttcttcagctaaagtttatttatttatttattttttcttaaatagttgtgtggagtttgacttgaatgtaaacaatattgttggaataagaaacacattccttctcagaacttatgcataccgtaagtttgttgtttgtttattaaaaattagcctttttttctttattcatttttaaagatgtttggcataaatagtgacatctctttagttgtgtttaagtatagtgtatcttattttatttgtatatgttgctacactaaaatcatatactgtcagttataggtgaatcaagtggcattttaataattgataatttttaaaaggtaactaaggtaagttttagacataagacacaaagtgaacagacacagtgtttaatatacacggagacagtgttctttgttttggtatggagctgggaaatgatgtaaactttcaaagaaactataacgtct

SEQ ID NO: 36122 - DNA, 1065 bp, Homo sapiens
aaactctgtctcaaaaaaaaaaagtaatgaaaaaggtaagatcatcaattggctagaaataataacattaatgaatattcatggaatgtttaccatattcctaggcatacagagctttctggtagacattttaaaattgtctttgcagagcctggccaacgtggcgaaaccctgtctctactaaaatacaaaaaactagctggatgtggtggtgcacacttgtcatcccagctagtggggtggctgaggcatgagaatcacttgaattcgggaggtggaggctgcagtgagcccaaatcgtgccactgtactccagcctgggtgacagagcgagaccctgtctcaaaaaaaaaaattaataaataagtaaataaagttgttcttgcgctttcaaaattaatgattcttagtgtgattgaagacctgctatttaaaatttaaatttttggtacatctatatggaaagtttatgggtataaatttgtggggtctctaccagcaagctgttatggaaactatgggcaaagtaaaattttgtagattagctgtattcaaggcattacctattaatcatgtattctgataatgagcttttgttttgtttttactttgcctttgagagagaaatttaaaagactgaacctgtagtccagaattctgaagttaaaatagttgttatagtcagatttttccagaatttacattgcttgaagtaagataaacattttaaaaactactaaactcattgagactaatatcaggatattgttaataaataacttctgcagtacactaattgcttctctgatgactagtgtttataaatcttttaaagttgtaacataaagaatttacttaatgataaccctgcctccaaaaatttccaaattactgagttctaaaagcttttttgtccattgaaagatcctcaaccagtggctagtatttgtttttgtctcctagcattctagttatggtaccagaatgagataaaggttttttattctaattctctataatcttctcttcatcctttgttttattatatttttagtatactagagt

SEQ ID NO: 36123 - DNA, 1034 bp, Homo sapiens
ctaaatcatacattaaaagtgaattaatatgctttgttattgagtttatgtagttgttatacatagtgtattcctaattcttaaatccttcctaattcttaaatttgaaaatgtattacttgtattttaccatactcatgacattatattttacagttatttcttatattgtgaatgttaggcactttacctttttatattgttcttttcatattaaaacaatgtaaaattactgttaattaatgagattggatttgtttaaaacgattggtgaaggatgacacaaatatggtgataacatgaggatataatttctttgtatgaaattttattaatagcagattgtgcccttagttttctgacttttgctgagcattctttaaaaatgtactaatgaggttaaagatttttctttcatttttatttgattttttttgttgttatttgcagtatatcagttttcctgaacgatttcaattttggtattgttagtggaaattaaataataaagggacaattatgaaagaactatttttatctcctagtgtcattgaactgtatttttaaaattgtagtttttgattgctacatccatcttaataatgtctattcagtatctgtagagcaatccttgtcttgcttattgtgtgtgtatgtctgatgttggacaaattatgtatgtccctttattgatagcctattattctaaaaccatgtgaggaacattgatttacatagggatatatgtagtttattaataaaaccttagtttgtcaacttaaatatattttaaatacaaacttagggataagaattaatttcatgaaatatttgaaaattgttgaattttagcataaacccttatggtcttatacctgggatgtagctgacaaattattgcattgtaaaatgagtcacgtgaatcacggaagctttaaactttttctttttatagccctacctgaacccatccttccatccctccaaaaaatttacccagtaagtgtttcttataaattattataatacatttt

SEQ ID NO: 36124 - DNA, 1034 bp, Homo sapiens
tggaacaaacaagtcagcttgtttgctattattaataataaccatccgggcgtggtggctcacgcctgtaatcccagcactttgggaggctaaggtgggtggatcacgaggtcaggagttaaagaccagcctggccaagatagtgaaaccccgtctctactaaaaatacaaaaattagctgggcatggtggcaggtgcctgtaatcccagctactcaggagggtgaggaggagaattgcttgaacctgggaggcggaggttgcagtgagcccagattgcgccactgtactccagcctcggcgacagagcgagactctgtctcaaaaaaaaaaaaaaaaaaaaaaatgtatatatatatatatatatatatatatatatatatataatagccatcgtttatttagtatccattatatatgtcagcatactgtacattttatacacaatttaaaaaatcctgaacaaataaacttgcaaggtattattcctctttcactaatgaagaaactgttttagaaatgttacatgattgatacaagtggtactaacaatttttccattatactctttcttgggggaaggcaaaattacagtagtattcactaacattttatctaatttctgttgcttattacattttatttgtatacatctgattgttcatatacagatatacctttaagggcagcagttacggcagaatttcagcttgtataaataagtttaagataagttaacaacaacgaaaaaacaactttgttactttacaaaggaaaccgcggagttcttttaaatttctagcttctctaatacaaaatagggtttatttttaaaataagagaaaacagttttggaatggaataaatttgttcagtatactatgctttttagtcattttcatattttcaaaatttataacattttaaatatttttaaaattggtatatttcagttcagttgtgatatgaaagggataaaaggctataaacatcattgtctctaaaaactgtattatagtatagaattactgctta

SEQ ID NO: 36125 - DNA, 1031 bp, Homo sapiens
agagcagaggagaaggcacctgtaggaagtggatcagggagtaggggacctgtgatcccttggcagtgttgagaaggggaagtctgtcaactcagcttttataacctttcccttactgttgtctgggatcctcatatccttgcccaaccacaatttacaaccaagagaatctgaaaactcatttacactaaaatgtgagcagctgaccattcactctggggttgcattgccatttgacaaaggtcaaggccttcagaaaaggatgtgatttgtctgcagtaaacttcagcctgttctgactacagacagtaaggtggacaccagggaaagaggtcagaataaatagagtggagggacacatgagggaatatggaaaatggaggcctggaaaaagcatccaatttattttttattggatgacaagggtaacaggaagtcagcaaaacttctggatttaggaaaaacacgtatcgacgaaaaagcatcaaactctgtaaaatatctgaagagattggttctgagccaaatatgagtgaccaatggcctgtgacacggcctgcaggagatcctgagaacatgtggccaaggtggttgggggacagcttaattttacacattttagggagacatgagacctcaatcaaatacatgtaagatgcacattggtttggtccagaaaggtgggaaaactgaagggcatgggggcttctaggttataggtaggtttaagttttttctgattggcaattggttgaaagagttaagttattctcttaagacttggaatcagtggaaaggaatgtctgcattatgataaggggatgttgagaccaaagttttatcatgcagatgaagcctccaggtagccagctggagagagaatagattgtaagtgtttcttattagactgaaagagttgttctatcagtaattccaaaagggaggggggtgtagtgtagtgaggcatgttccatctccccacctccaccatcacggcctgagtgagtttttcaggttagctttggaatgcc

SEQ ID NO: 36126 - DNA, 1032 bp, Homo sapiens
aagtcagaaaaaaaagagacaaggtccctgcacttgtgacacttactttctagttaattgaaacagccaataatcacaaacaagataatttcagataaaaataaatgctctaaaggaaatacaaaaatagttttggaggtgatttgtgttttgcaaaaggataatctatgttcttttaaaaaagtgtatttagtttagaagtcttgggaaacataatatgtttaataatttttatttgatttaagtctcccgaataacactgtttctctatttcagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttg

SEQ ID NO: 36127 - DNA, 1072 bp, Homo sapiens
tttttcagccacatatgactgtaaataaattttgcaaatttatgttcagtaggacttgaaacatgagcttacagatttttattagcatccctgtcaatcttaggttaaggtcatgggcttatataactgagctgtattttgatactcatgatacaattgactatatttcctgtggcttttagataaattgaaatttggtaactgaaataagcaggaaccctgatttagtagcaataaagacagttttaaagtaagtgacatgtgacctaattaaaaaggaagtaatcattaataattaataatcctcactactccataatgtatctgtcagcttttcattctatttgaaactaaattcttatccactacatttcagcatttagtgcatcttttattttagtgttatttattaattggctccctatgataatcctttttcttactttatataaatcttatacaattcaatttaaggttttcataaggagaactttgggaacacaaggaatttgaaaagttatgttaaatgcaaaaacaattgttcttagttttttgactaatagaagttgacattaatagttatattcttttatcatctaagattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggtatggcattttattttgaactgttcagactggggaatggataaattagttaaaggcatttatggttttggctgtgctagctatactaaagatttatttctgtgaagagattgctgatttctgaaaatagcttaataattattttgtctccttaaaactagcattttatgtgattagtgtctatgcagatttttgtattttaaaaatggaaatatatccttatatccattttttttttttttttttttttgagacagtgtctccaccccggctggagtgcagtggcacaatcttggttcactgcaacctctgctt

SEQ ID NO: 36128 - DNA, 1031 bp, Homo sapiens
ctcatgcctgtaatcccagcactttgggaggccgaggtgggtggatcacctgaggtcagaagtttgagatcagcctggtcaacatggtgaaaccctgtctctactaaaaatacaaaaattagccaggtgttgtggcacatgcctataatcccagctacttgggaggctgaggcaggagaattacttgaacccaggaagtggaggttgcaatgagtcgagattgcaccgctgcactccagcctgggcaacagagtgagaccttgtctcaaaaacaaaaaaaaaattatctctcactttcccctaagaactgattgagtgatatttatacataatgtttgtttgtaaaatgagagttgaaggtaataaattcaataatttggggttttttttgttgatagtaaccagttttcctttcttatgtatagcatatcctgctcctctaacaagcatcagaggccgaaaacctctttttggagaaataggacacactattatgaacttacttgttgtgagtaattgaactattttattaggtatttttatactgttactttaaaactgtatttagcaaagtttatacatttatattttcctactttaatttgccatatttggtataatgaccattcatttacaataaatcctaattattttaacattagtgctcagtttttgacgaattgctttttagaacgtactatctcctcatgtacgtgtacctgattctaagtgccttttgattcattctcctgcagttcttggatatttaggtaatgtaagaactctatacagacctcttaaagttgttgaaacttttgtaaatgtattagtaaagtcagtcagtcttgtgattttgagcaaattatggccttagttttctcatttataataggaagtgttggattagatgatatctaaagttcccttccacctatactttttgtaattttgtgtttccctgttaccatagaaaaatgtttcagtggactcacttttatttatccatgcctagtttgaagaccttttctatt

SEQ ID NO: 36129 - DNA, 1024 bp, Homo sapiens
cttcgttttggcttttctacaatgcttgttaatgaggtgttaataaagtctcttcactttggttggtccacatgaccaaattccccaacattatttgacttctattacctctgttctgttccccatgctgtaacactgtgctatgtttaagcctcatctagtctcactctgttattgtgtccccagttctagtccaaagacttcaaagtcttccatgcagttttctagtgcccccctcttaagtgtcctgactgcagattctaggcttcaccaaactctttatctcttgagttctcagccaatagggccattgtagacttagtgggtcaccttgaagaaattatccccaggcagagagctcagggcagagagtaagggctctctgcctgggaataatttcctcatggtgacccactaagcttacctgagttctctgcctggagataaccatgggcttaacctcttcagtttccctctagggatctcagtattgcactgcctattgtccagaacctgaaaacagttatctcatacattttgtctagtcttagggtggttgtcatgacagggctatctggtaccagttatttcatcatagccagaagcagaaattctctttgttttaaccttaaaaaaaaaattcttaactttgcaaaatacttgtcttatttcctagtggaaaacaaccattaagatgattagcaaatgatttaaaacttgtatcttacacagaacatattttgatagcaaattttatggcttagatatacacattggtatttggcaaaagaaatgtgaaacttagtctcatttctagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaagggtaggaatttttttattctaaaatataattgatttgaaggaaag

SEQ ID NO: 36130 - DNA, 1087 bp, Homo sapiens
ctcccaaagtgttgagattgtaggcatgagccaccacgcctggccccagtattattttaatttgtatttctcttaacaaggagtgatgatcatcttgcatgtaaaaacaatttgtttttctttgaactgaaagttctctttctgacatccaggtaactttccaacatccaatatagattttcaaatcagagaattcattagaatggttaagctaaacgtgggtgagttcatatgctgagggtttgcttttctccagccaggatatattttactcatagttcttactggaaaaggggttttgtttttatctcactattaaaagtcctcttttcaaggaagcactcactatttgttattggagtaagcactgtaaatttttttagccaattgtattaaaatgtaatttgcaccaatgttagagtctaatattaaatattattgcaacaacaaatttgaaatatttcaagtagatttttttaataccatggggtttttaatttaagtaatgtcggcagttattcaaagcctcatccctctaatttgtttatgtgttcatttagaggaaacgtaaagtatgacatagtggcaattttatctttatgatatatgaggaggaacaattataatttatgtagtagacagataaaagatacaggagaatgtagaatttttttataaatatatcaaatattttatttaacatgcttgaactgtattttaaaatatttcacttattttatattcacattccgagttaaacaagattgctcattttcttatcaagaattttttttttttctaggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgct

SEQ ID NO: 36131 - DNA, 1100 bp, Homo sapiens
tgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagta

SEQ ID NO: 36132 - DNA, 1050 bp, Homo sapiens
tgtagattttcaaacatgagcaatgaatatccataatttctaatttgaggagtgagaagataaaagtacgatttttattcccagaaagcttcagcaaatacttattaagcctttcattatgtatgtactttgctggtattagaaagaaattcagaatttgtatgtcaacagcttaagatctgtgtaacttagggaaagtcatttaacttcttgacatctgtttgctaatctaaaaaatagggagaatgtgtacggaccttgtatactgcctggcatgggataatcgctcactgagtgttacttttctttcctttttttttatcttcctcaaaaggatactgaacatggtgcctcctgtagttctgtgccctgttttcttagcattaactgaagttcttttatttggacaggtactgctcacatgatagaggctgatgtccttcttccaagtgatggatcagaacacagccagccaattatggcccatccccctgaaacaaacagtgataatactctacaggagtggctgactgaagttatgaaaagcaataaaggcatcaagctggatttcaaaaggtatttgtataaacacgttcaattttctgggaaaaaagtaatagctgtgcctgactacctattttttttaatgttatccaaactgaaaatggaattgtagactctaatatatttcaggactgaacctaaatgaacctaagacccactgagttatttactaaaattgttttttggagacccttaaaggcaaaagttagattaatttttataaaggaatttatcataagtgaccatcgtgacaacagaaaggtaaattaaaaatgctacatatgttaaaaagtaacccaggagagagagagctgggagaaattcattgagctagttaatgcataccctatttgatttatgttattatatttgtaaagggaattatttagaattctccaataaccaaagtgtttcttaaaaataatgcttggaggcagccgggcacagtggcttcagcctgtaattccagcactttgggaggctgag

SEQ ID NO: 36133 - DNA, 1059 bp, Homo sapiens
ttgaacttgggaagcagaggttgcaatgagccaagatcacaccacttcactccagcctgggcgaaagagcaagactcttatctcaaaaaaaaaaaaagaaaatcaaactgattgattaagtgaagttccatatgtttctttgtccttagtgttgtgttcattttcatttgaatttaatttctttcgaagtagctttcataatttgtttttctgattataaaactaatatatgttcattcagaagacaaaaaaaaaaggataaattcataagttgaattctgtaacccagagaaaatgactgttaaacattttggcacattatttccgtgtgtgtatatcacttttttccatttgtgaacttgcattcctgctgcaaaatcacttttctattctgtggtttttttttttttaactttacaattccccatttttaaaaactttattgcagaacatttcaaacatacacaaaattatacagaatagtgtcatgaactcctgtcactctattagccagcttcagcatttctcaggaccattctcatttttctacactccctccccttttctctctcccttgattattggctttgaagcaaatcctagggagcatcagtttatcctctaatatttcagtaggtacccttaaaaacaaaataagtacatgacattgtcatataagtgtatcataatttatccattccatttttattatattcatttttccagtattataaatactgttatgatgaatatccatatacagaaatactcatgtgcgtttctgatgatttccttaagataaattcctgaaaatggaattaactggatcagaaggtatgaatgtttataaagctcttgattgcttgctagaaatggtaatatcaatttatacttctaccagtatagtctaggagggttctttgaacctttgctcacattgagggtgatcatttaaataatctttgccagtcacatagatgaaaaattttgcatcaaatctcttcattttgatcttaatccttttctgaccatgtgttcaaacttgaataattaaaagtc

SEQ ID NO: 36134 - DNA, 1056 bp, Homo sapiens
acacattcatttttttgttttctgcttaattttataaaataacaatggcgaaattcaataaaatatcaaaatatttcataatgacattgtcaaaagtgaatttttgtttgtcaagcagcattcattgactggtgatattcctaaatgtttgttcatcacatgagatttaaaagcttgaatttggcatatcaaagataatttaggtgtcttatgtgggttttaccaaatttaatgcctgcttttgtcttattttaatttgaatttctctagttagcattgtaaataattttctctatgtttactgaccgtgtgtaatttttcaatctttgcacttttttttgtatcctttgatcattttcactttatttgcatattggactaagcgaagtcaaaagttaaatctgcatttctgtggagttcctacagctaatttatatctatggacagaatgaagtagaggaaattcaaaagttagcaggggtcaaacagtgtggactcttgtgactcagggtttgagttggaaaactagctcttccctttagtgactttgagtaagttatctactgtattgtccttcagtgtcctttatattgggggtattaagagtgcttacctcatggggttgttgtgaggattaaataagttaatataggtaaagcgcctgaaatagtacctgctgtagaaggctctctgtaagaggaagtttttttttttatattttaattaaattttctgtggctgggcgcagtggcttatgcttgtaatcccagcagtttgggaggccaagtcaggcggatcacaagatcaggagttcgagaccagcctgaccaacatggtgaaaccccatctctactaaaaatacaaaaattagccaggcatggctaaagttttttgtaggtacataatagatgtatatatttatgggttacatgagatactttcatacaggcatacaatgcataataattacatcagggtaaatggggtatccatctcctcaagcatttatcctttgtgttacaaacaacccaattatactcttttagttattttaaa

SEQ ID NO: 36135 - DNA, 2225 bp, Homo sapiens
ataaacaaataatatttactagttctcaaggaaactgacttttcaggtgaatcaggtgaacatcacaaatgacactcaattttgcgttcaaagaaatgagagcttcctgagcactggcatagccaaggaaggctgtatgaaggaggtggggtaggctggtacatttgcagaatagaaggctttgagttggtaatggggaggggggaagggtatgttgtgtgtgtatggaaatgatatgaggtctgaggcacacaggctggaaatattagagaagtgtgaagacagaagggagatttctctgattagagggaactttcatgttgagaattgagaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagcttagagaatgccaatagttgggaataggagcaagaatacaaacagaaggggaggaattaaagagctaggtggagaaccaggacaaggtagggatgtgtagttataatttgtcacacgtggtataaccaatgatgtgagctaattttttacattattgactctgttatagtttactgaaactgtatgacattcagaaagatacttggttaaaaactagccttagctcattgatatcatttgaaaaagacatgtggaagaatgtcctgtggtaccacagtgactttagctatctgacctttgaaataaatgcttgaacacataagtgcttcctcaaagatagatgtgtatgctgcagatttaaagaaaacattgaaatcttaatgttggggaataagaataacctctactatgtttactttcagtgttagaaataccttattattatgtctttttggccacagagagccttacatcatctgaggtttaaccaaaagtattatctaacatgattctttatgcggaggcatagtaccacctgaatgtcacttatggtgacacgtgtttgaaattaccatagtagcattttcattttgtgttcatctcttattaaattaatttatatagtagaaatcacttattactttatgttattgtactttgactttcaagtttttaatggaaaatatttagcagagttttggtgccaaaatgaagtgataactgtgagactatataattatcagaggaattgttatgcaaattaggtatctgtgttatgactgaagtccaacttctttctaatgtcatttgaattaaacattagtataaaggtttcaatttttttttttttaaagaatgagagtaaaagaaacaacaggtcttactcattaatttggttaagaggaagtgcttcacacatacgaaatgttattaagtggtcggtacttgatggtaccaatttcgtgattgcagtgttacagttctatcaaagtttaataagctcaattctgtgggttcatatgaagtcatttcaatataattcttagatatttagagccaagtaaatgtggaatggcataccaaacagtgggtagcatatagatatgaataacatggtgcctaaattaggtgggaaggtgggactgggtagaaagagggcattccaggaagtgtggtcacaggatgagaaaagggaattgggaacatcgagttgactggagtgttaggaaaatatgggtcaagagtagcctgcaacagaatgtagtgcagaagagctgttcagtgagtatttgctgaatgattatgtttaaggccagagaggaagactggagctgtttcattgaggatgctggctgggcactagtgggaggagcttatactttatttagatgtttctcaaatttggcctaccaaccttttaatttactactttgtgttagaattttcttatttaaatttgttaaattataattttaaaatttacaaagttaatacatgtttgttgtaaaagtgaaaaaagtctattttaaaggaaaaaataattcttgctaacctcctcacccatttcacttaaattagttttattataatgtgacttaaatatttataaactgaaaacttagtgctctaggttttatacctattttaacaggaataaagtccaagcaaaatttgagattaaagtaaatgtatgaa

SEQ ID NO: 36136 - DNA, 1022 bp, Homo sapiens
tggaggtgtgagagagcgtgcttttcttaggaagcagaaactagtttggctgggttactctgccagcatgagcaggcaacctgaggcaggacagacgtgttttggagagaaagggtgtataaagctggaaaccatcattctcagcaaactgtcgcaaggacaaaaaaccaaacaccgcatgttctcactcataggtgggaattgaacaatgagaacacttggacacaggaaggggaacctcacacaccggggggcctgttgtggggtggtgggggggacggatagcattaggagatatacctaatgtaaatgacaagttaatgggtgcagcataccaacatggcacatgtatacatatgtaacaaacctgcacgttgtgcacatgtaccctagaacttaaagtataataaaaatatacaaataaataaaaaataaaaagagaatcaagagtgaaacggtggagtgagaaagcggcattacacagggcctggataaagagtttcctgtgacagagactgagctgagatggctggtgatggggaccgtagcctagtgaccctttgtgtacccagcacctatcaaagtagctcacacataataggtgcttaataaatgcttggtaaatgaatgattaaataagtgatgtttagaataaagagaataatgggtatctcctatttgtttttcttaacaaaactgatttgggttttttaaacatagaagggttgttgtaaggctgggcgtggtggctcatacctgtaatcccagcactatgggaggacgagatgggtggatcacctgaggtcaggagttccagaccagcctggccaacatggtgaaaccccacctctactaaaggtacaaaaattagttgggtgtggtgtcagcacctgtaatcctagctacttgggaggctgaggcaggagaatggcttgaacccgggaggtggaggttgcagtgattcaagattgcaccactgcactccagcctgggcaacagagtacaacactgtctccaaaaaa

SEQ ID NO: 36137 - DNA, 1038 bp, Homo sapiens
gaatgaagttggacccttacttcatgtcatatttgagtttggaagataaaatggaccaaagacctgatatgagttaacactgttatactcttagaagaaaacataggtgtaaatctttgtaaccttgaatgaggcaatgatttcttaactatgacatcaaaaacacaagtgagaaaagcaaaaatagatacattggacttcatcaaagtaaaagcttttattcttcaaagaacaccatcaagaaagtgaaaagacaatccactgaatagaagaatttttgtaaatcatatatccagtaagggacttgtatctagaatatatatatatatataaactcttacaagtcaatggtaaaaagataactcagaaaatggacaaatgatccatacaggtttttctccaaaggatatatgcaaacaaccaagaagcacgtgaaaatatgctcaacatcattaagcatcaggtaaattcaaatcaatgccacagttagataacacttcatactcactaggatggctataactaggaaaaaaaaaggtgttggctgggatgcagacaacttgaaatcctcatacattgccaataggactataaaatggtacagccattttggaaaacagtctggtagtacctcatgacattcactgtgtgatccagcaattccactagatgttacttaagacaaggaaaatatgatgtccacataaaaacttatacaaatgttcataagagcattagtcacaatagccaaaaagtagaaacaactctaatgtccatcaactgaagaatggatacctaaaatgtgttatatgcatacaatagaagatttttcaaccataaaaaggaatgaagtacagatacatgttgcaacatgatgaaccttgaaaatattatggtagttgaaagacatcagtcacaaaaagtctcgttttgtctgattccatttatatgaaatgtccagaataggcaaatccatagagagaaagtagattagtggttgcctagggctcttgggttgttggggggaatggagagtga

SEQ ID NO: 36138 - DNA, 1044 bp, Homo sapiens
tcagttcatggggctgtgatttctattccaccttcctgcctttttgtaaactttactttgatgtttgtattgcacagggtttgtgtatttataaaagtttcaaaactctagtaaagtcagaatctaattcatttaaaaagtggccggtatgcagtgcaagaatgacttattttggaatttcaaaatatagtttactaacggaacttataactcacttggaagccattccttgttgctgttttagtgtttgtttacacaagaatgtacctaaagattagtttgaagggtgaagagtagaaatgatctggtaacaaaccaacttcaggaaagctgaatgctttaaaccaatgttttatagattagttggctggctctgtgtacacaccatcaaacatatgtctgttctttattattagattactctaaataagcttctactgtgtacaccacatagtgggtgatgtcctgggtacagattgtgccaattatgtgaaattcataaaatgagaaggaacactggatgttgtgggaagtggttagcataggctgtatggttttgtggaacgtgccctggaatatgtaccaataggtgtttttatggtgataatgatagaggatctcaagtgagctgattctggtataaaatagacatttcttcttcttctttttttttttgaaacaagatctcactgtgtcacccatgctggaatgcagtggtgcgaccacagctcactacagcttcagcctccagccttctgagtagttgggacaacaggcacgtgccaccatgcccagctatttttttttttttttttgcatttttttgtagagacaaggtgttgccatgttgcccaggctggtctccagctcctgggttcaagagatcctcccaccttggactcccagtgtgttgggattacgggtgtgagccactgtgcttagcctaaaataaacatttcttttgatggcaaaatgttaaattcaaatcctgtaaatagtgctagtcacaggaacccataataactttgctcaagaactgttttg

SEQ ID NO: 36139 - DNA, 1032 bp, Homo sapiens
aaattatttgtgaaatgactttaaaggaatatattaaatccagatagtaaatggtgaaatctattttttgtgtgtgtactgagagttaaaataaactttgaattttttaagttacagaatgatagattacagtatgacttttccaaagaaatcacaacgagtgtgatgcatacataaacataaatgcacagaagaaggttggaaagggtagacaccaagctggtctcagtagtaacatctgggaaggagagctgagagtagggcagggctcagaggtgcttgaatacacagctaaagctgtagataaaacagatatagaggtctttaaaaagcataaagaacatcaaggtcaaaaaatgattcttgtatcaaagtaaaagatacaaaagaccgtagaaagatgttttaattgaacagcgtatgaaaattttaggtcatttcatttccaagtccaacacatagtttatattaataattacatctagaaataattttatgtgatttactttattgtattcattaatgaaaataagtagcaataatctgaactgttatctttactaatgaaaatattggtttgatctcagacaacaatagaaaaatgaagaataaagcccagcatggtgacatgcacctatagtcccagcctcctcaagaagctgaggcaagaggatcacttgagcctaggagcttgaggctgtagtgtgctatgattgtgtctgtgaatagtcactgcactgcagcctgggcagcacactgagaccctatctcttaaaaaaaaaaaaagaaagaaaagaaaaaaaagatcttgtaaaggtaaactacaagggtgaagccatttataagactcttctaaagtatgtgcttcagtgcactattataataataaatgttttcccaattttgatcttatagttcaaatttaacttttatactcaaggttttattctggacatatgttcttaaaatctatgtttaaagttttgttttctgtcgtacaaacagagtactgaaatttttcatgctatctta

SEQ ID NO: 36140 - DNA, 1056 bp, Homo sapiens
gtttagatttcagacagagagatcaaaggtaaagatgtaaatttgttgtgagacatttttgtgtacgtgattgggtgtggatgagatcatcttgacagacagtatggtggagaagattaatgttctgagactgaaccttaaaactgccaagatttcatagttgagtaagaagttaaggttgaaaaccaacaaaggaggtgtagccagagaggcaggagagaaaaacaggacattacagtgtcatgggagcgaggggaaagagtgcttcaagaagaaaagtagtggtcaacagtgctgaaaggtcaggtgagttgaagcctgaaaagtcacctttggtcttagcaaaatagctgtcactaatgaccttagcaggagctgctttcgtggagtggtggggccacactgcagttaaaagagggctaaagagtgagttagaggtcaggaagtagagggggttagtacaggtgatactgcaaaggttggccaggaagaagacaggagagatccagtgagggacttgttttttgtttttaaatggtagacttgaacgtacttcaatgggatatccagtgggatatgttatttccaagaatttattattctaaaaataaataaattaattaattaatcacctttggaggatcctagaatgaatcctaatgatacttaaaatcaaaatatcattagtcacatggaggttgaaaactgaaaaataaagatccaagcaggtatcctatcttttcaaataggtaacggggaagtttctctttatagaaatgttccagccaataaaccaagcaggaatgacaagaattagagtatcaccctttttgcaacccctgatgtaataacagatttaagtaataatcagaaatggctgctaatgtcaccaaagcagagacaaccagacattaggtaaaagtttgtgacaacttatgatgtcttctggccaaaaaaaatcaaactgaatagtcgggcatggtggctcatgcttgtaatcccagcactttgggaggccaaggtgggtggatcacctgaggtcaggagttcaagacc

SEQ ID NO: 36141 - DNA, 1037 bp, Homo sapiens
gttttgcctgtaatcccagccacttgggaggctgaggcaggagaatcgcttgaacccaggaggtagaggttgcagtgagccatgatcgtgctgctgcactccagcctaggcaacagagcaagactccatctcaaaaaaaaaaaaaaaaaaaaaaagcttaatactgagtcacaaatgttcatgaccgtatttaagagaatgaaggctaaatgacacatccatctttttggtaggttgcattatcatttgaaatatttgttgcccctccctgagttcaccttcctgcagaaagatgataacttacctggctgttaaggtctagcacactcaatttgcttgctctatgcctagagcattgtgaggaaaagtgacatatgtcactttggaggagaaacattaagaacaagcacctggtttgctgcatcttttattcctctactataagaccagctacagccaaaataagacctgctctatgagtctgggtctatgtgtggagcagatttgcagctgacccataataggcgtatgatgtgagccggaaataaacctctgtttatttggggttgtttgttcctgcatcattactttagcttatcctgactgttgcattttccatccaaataacagcagcatcataaacatttatataatttgtataacagtttgcttaggcttcttatgtacctatttaccctttcccaaaatccaaatttactcagtttcatcttcttgacaacagaatcccaacttcattccagctgcaatatgcccaaccccagcatgtgtccaactacagttcaattattctaagccaatcacagcaactcagttctcccttgaaagtcattggcctaggggttagcatatgagtcagttctgaacaatgagccttaaggagaatctgcctaagatttcaggagtatctttcttttctgataagagcagcatgcaaagtcagaaagccttttttgtcctcttcccatcactttcagctttaaaagccataatagaagaatgtggtgctcgagctctga

SEQ ID NO: 36142 - DNA, 1098 bp, Homo sapiens
tctgcagctccaaggaggaccggtcggcctggcccacggccgtggcagtgccaagtgctgacgatacccaggccaaggcccaggagaaacttgcgttgctcaaagccctttcacataagactggggaccatgtccgaagtgaaaacagctgtctgttgttcccatttttcatcagcacttccggatccgccccacacgatataatttgattcaactggtaactcccgttgccagatgaaatgtctctgatggacacttgccacgctttggtaatgcagaagctgtcgtgtttgcgaagtgtgctttgggggcatcactcgataaattaagcttttgaagagttgaagatatttgtgccggaaactgtggagaagcaacagcctgacagtgcctatttctcctcggctgttatttcaaaatgcaagacgtaaaccacatcccaagttatttttttagtgcttaggtcctctgggggaggggagaatgccccaggcaattgatttgagacaatatattgcacacatttataattttgaatttggtgaggagtggaatataaatttggaactcaaattaatcgttaatgtagtttctgtttataatgtgccaatacatttgaagatatttgtgttgccattgcctaccataatgtactgcttaaaatctctttttacctcatcaagaacaagacaatgttttgtgcacattaatttttgcacagactactttaaaagtttaatgcatgccattctattttccattatttatttacaaggagaaaccacacatatgttaaagtttgggagtgtattttaggaaatgattccttttctcatttttggctttagatattcttttttctttaaataagggtggaatataatgctgacaacatcaggcccttgtaatgcctcctctattcctctgcacagactgtgtccccacattggcttcctgcctgccagcctctgtgcctttccttgtgctgtccccagcctgggggctgggaatgtccttatccatttcttttgtgcctgttgaagttctgcttgtcccaccaggctcagatcagatacctcgaaggagccttttataatt

SEQ ID NO: 36143 - DNA, 1029 bp, Homo sapiens
ggctttctctagcccattccttcaaactcttccagcatctgtccattacccagttccaaagccacttccacattttcaggtattcgttatagcagtaacctcacttctcagtactaattttctgtctttgttttgtgctacctgagactaggtgatttataatgaacagaaatgtatctctcacagttctagaggctggcatctggtgagggccttcttgctgcattataatatagtggaaagtatcacatgggtgggaaagagagtgaagtaggccaaactcattctattcccaagataaaggcattcattcattcatgagtgcagagtactcatgatgtagtcacctcttagaggtctcacctctcaacactgttgcattggagtttaagtttccaacatatgaactttaggggacatatcaaatcatagcatggagagaccaagataaatgagaaagagctggatcaagctcttagggaaggacactgacacaggcttcgaagacctgtcagtacagatattggacagagtgggatcatgtggacacagccagtggctgctggagagctttgtcatgtggcagcactgatcattcatggcctggggccagcagatggagggaacctgtgaataacagtatggccgaaatattaggctctttctcatattagagaattaagttgaaggcttcatgcctctgcttctcactggatttccccaaaacaagtgatttagtgttatatttttttcagttaatttatccagatggttcataggttagaaatatcattttagagttccagtactctaaaatagttaaatgctgagctctttccactctgggtaatggagaaagtccaagattgtatgtatctaggaggggcccatggcacttggtgaagcccgtagagccaacctttactccagagctgtcagctcctctgctccccaggcttcttagtcacattcaccacctaatgcatcccccttagctctcattttaccctgatccctcccttaatcctt

SEQ ID NO: 36144 - DNA, 1055 bp, Homo sapiens
aatagaaaaatggcggatataaatagaaccatatcaaattccattaagcattaattcatggaaaatgcaaatcaaaaggtaaatattgtcaaaccatataaaaaagaaatatctaaccatatgccatatatgaaacacattttcaattaaaagacacaaataaattgaaagtaaaggaatggaaaaagatattccacgtaaaaaaaattcatgagagactggagtggctctactgataaaatagactgtaagaccaaaaaaaaaaaaaaacttattaacagcaaagagcggtgttttataatgaaaacacaggcaattcttcaggaatatataataattataaatatatgcatctaacaacagagccctaaatacacgaagcaaaaactgacagaattgaaaggacaaatagacatttcagcaataataattgttaactttaataccccactctaaataattgatgaaataactatacaaaaaatgaaaaggatataaaagagcttgaacaacactatcaaccaacttgacctaatagacatatatagaatactccatctgatgaaagtgtatacatttggggtttttttagacagagtctgtctgtgatccaggctagagtgcagtggtgtgatcatagctcactgtaatcttgaactcctgggctcaagtgatcagcctcccaagtagctaggactactggactgactaattctttttttaatttttgtagagacagggtctcactatgttgcccaggctggtctcaaactcctggtctcaagcgatcctcccgctttggccttccaaagtgctgagattataagtgtaagttacagcacctggccagaatatacattatttaaggaagacatgaaaatatctccaagatacaccatacattaagccataaaataagtcttactagattttaaaagtctgaaattatgaaaggtatgtttcgagaacacagttagaaattaataatagaaataaacttgaaaagtctcaaatatttagaaattaaacaacaaattgttaaataactcatgggt

SEQ ID NO: 36145 - DNA, 1027 bp, Homo sapiens
gacttggggggttgccagggatgctggtcttaaaaggtgataatttaggccgggcgcggtggctcacgcctgtaatcccagcactttgggaggtcgaggcgggcagatctcctgagctcaggagttcgagaccaccctgggcaacatggtgaaaccccttctctactaaaatacaaaaaattagctgggcgtggtggcacgcgcctgtaatcccagctattcgggaggctgaggcccgagaatcgcttgagccctggcggcagaggttgcagtgagccaagatcgcccactgcactccaggttgggctacagagtgagactccgtctcaacaacgaccacaacaacaacaaaaaaggtggtggcttaatacagccatgctccccttaagaactggtatagttatgagaaatggttgggccgtttcgtggttgtgtgaacatcatagtgtacttgcacaaacctacacagctgggccgtatgggatagcctgttactcctagtctacagacctgtacagtataactactaaatactgtaggcagttgtaaaaggatggtgtgtatctaaacacagaaaagatactgtaaaaatatagtgtaaaagaaaacatggtacagctgaatagggcacttacgcatggagcttgcagggctgtcggtagctattaagtgagtcagtgagtggtatgtgagtgtgaaggcctacgatattatttagggtattactgtacactactgtagactttataaatgcggtatgcttagtctaagtttattaaaaataaggtaataaccttagcttactgtgcttttttaactttataaacttttaaattaattttaactccttgaccttttttttttttttttgagacggagtttattctctctgtctctcatttttgagacagagttttgctcttgtcacccaggctggagtgcagtggcgcaatctcagctcactgcaacgtccacctcttgagttcaagcgattctcctgcctcagcttcccaggtggtgcgcgcct

SEQ ID NO: 36146 - DNA, 1029 bp, Homo sapiens
gtgctgggattacaggcgtgagccaccatacccggcccactcttttgtaataacacttagcttaaaatgctaatgtgttgtatagctatataaaaatattttctttattcccttacattattctatagctttttcctgtaaaaattttttttgttgttataaactaagacacacacattgtgcctacaccgggtcaggagcatcaatatcactcttttcttcctccacatcttgtcctactggaaggttttcaggggcagtaacatgaatggagctgtcatctcctataataactgcttttttctggaatacttataattgtctagtattatgtacagtacatcattgtaagcattatgcttgtatatgactggcatcccaggtttgtttacaccagcattaccacagacatgagtaatgtgttacactacaagttatgagggctacaaagtcaataggaatttttcagctccattataatcatctgagaccagtatcatgtgtgcagtcgctgttgacctaaatgttatgtagcatgtgactagctgatgaatctttgattatggctgaatgttctcattcattgcaggaaaaaaatatcctccaaatcactaggtagtatgtaagtgaccaaaacttttttccattttatgttggagccaaatcattagtgttaggataaattacttctttatgtatgtgctctaaaatgaaaagttatttctgaatattaaagcatatgtattaagagtataaaaacaagatacagattttggtgtgaaatatatcttatgattcaagtcataatttaaatagaattgaagatgatgtgaaatcactgggctggaagtagcttataccttgattagtaagaggaagcccgggatcatcctgtgatggtaaacacttttatatgttttacttataactttgccaggaaatttcaacaaacttcatattaaaggacatgatttctgtatacttagtaatctgctatgcaaattgttgcattgaaatggcagacgaagc

SEQ ID NO: 36147 - DNA, 1032 bp, Homo sapiens
ttgctcactttcctttagtgatggagtcttccctccttgtgattattcatatcaaaatgagttcctttcccaaaccaataacaatctgagtggatgcatttgattactgtttttctaacattctgatttttctattcctttacagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgttactttctaaaccaggcccgcttcacgagttagagttgagctcccctgtagccaggactatgctgtagatatcagtatgatctgggtgtggccaaaaacaattttctttattctgtctatcaaatagtacttctaccactgtttggagaaaattgaagaaaagaataagatgattaaatgaattctctaaaagaacatattttaagagacagaacttagacataaccaagtagttgtatacctgattgtaacaatcatcttttataaaagcaaaattatgcataaatgtaaaacacccctaaacaaagggaacaaatgaatttttggttatattgttttcttggctcaaagtatcaatttattattataatagaaatttataagttgctagaaagtctatatttttaaagtacggaataaaaatatgttttctattaagcaatagaaatatttttgtgtataatttttctgaatacttgattctcgattgaaatatccattgttcgttaatatccatgtaacaatcccattggaaacaagattttttttgaatcctagatgagaataaacagggatttggtttttgttttagttttgacataaaggattccaagttactgaagttaaaattgaaatatctcagtttaacagcagctcttttttgcccttgattttcaagagagaacttctagccaaaattcagtttttgttacttaaccagaatgatggca

SEQ ID NO: 36148 - DNA, 1050 bp, Homo sapiens
cactggcccacaccagtccacgagagtcaataagccatggtcctgctctcttgcagaatttgcttagtgtactacaaagaatactcaggtcaagagatccgctttccacttcctgctctgcctccaactaattagtgtaagacaagtttcttagaagtgctttagtccttcaccctcttatctctaaaatgagaggcttgaattggataaacttgaaggttccctttgtttttaaatcctctcatgcttgtccaggatgttttcagactctttctggatcaggttgttatgtgggatggaatctggatcctgtaaagaccttgtcatcccttagaggatggaggcctaggccctgagcttatgatctagtgggagaaataaaactaacaaatgttaaaaaattaaagaagagttaaatgttcaagtgtaagctatgataagtacaaaaagaatgcagggaagctagagaggagtgttaattggaatggtcaggaaaacttcattgccaagggggaatttgagttgacatcgttttttcctgggctgggtggactgcagggctgacaagagtggtggttctcctgcttttgagtttgcttgtctctaaaaaagcatccttcaacagtgaagcacaaaacatatttttctgccttaaattaaaacaaagtagaagaaacatctagttctgtggaagtctttaaagggaaatcaaaatccaaaaaactctatatttaatttttcaaggctaatcttgactgagaagattgatactgaaaaaaaatcaccactaccaaatatagagcaaaaaacccagcgtacttccgtatcgataataaaaaaatggtattagaaattacctaaaatgtaagtaaattcctcaaattataagtattattgaaagtgacatatctctttatcttaactaattgggaaagagaccagataatttatttagattttataacataggtgcacacgaatttttgactcacctcttttaatgtcaaaggagatgtattttgcattgttattagaattttactaaatttt

SEQ ID NO: 36149 - DNA, 1050 bp, Homo sapiens
gaagctgtagtgtctagggttatatctctcctaatcagctgctcgttccttcagtgtaagatccatagcttatttatctttgcagcactttcccaggggatgattttgaatgaatgacatactggaaggtgtattataaagaacaatgaaattttactctgtagaaaggctttttgtgaacataaccaatgtgacattattgctctacaatgggcattttatgaaataatgaagaaaaaattcagaatatacatacatgcatctgctccaaggtatattaaaaatgaaattttaattgccgtttatcccaaaggaccaaaagtgtcttattggacacaagatctttttaaataaaagtcgatccaccttccatactggaacttttacatataagatgatgtagtttagtgttcttttaaaaaataataaacgaatgtttcaggaaacctgtgatagactgaatcaggtggaactgatttaatgttatggataattacataattagtgatgtaaaaaataaaccatactatctacttgatggactggagctgctgtgaaggaggtacataattatataatcagcatcctcctcctgtgctgattctaggtaatactttttctgacttgtctgagaagggatctcctgtcttatatttcttgatgttatttaagtgaagagagctgagtgttcagtaattctcaattcatgagctaggtctatgtgagagcatccactgaacccaatgactttcaaactttttaaatataaacccataataagaaatacattttacattaagacctagaacactccacacatgcatacctgaaaccaaggttcatgaaacaattcttactctttctgatctattctactcaatctaccctgcgctattttgttttttaaaaatgctggtcaaggcccagcaattgatttcagaacttactaatggctcatgagtcacattttgaaaatacaacctttgacccttagtggttgctaacatcagcagaagggatttggaaggtaacatatgggtctgccagggg

SEQ ID NO: 36150 - DNA, 1058 bp, Homo sapiens
gtaatgtttctttttttttttaactgaactaaaatggttagaaattcattcactttcatgaaatagaaaccatatcaggaaatatggaagactggtgttttagtaaatagagatatatttataatttttccagataattccaatcatggttgtcttagaaactatgtttgtaaactagataaacaactatagtagaaaattaaaaaatactggggggaaggttccaacatggccgaataggagcagctccattctgcagctcccagcgtgagcgacacagaagatgggtgatttctgcatttccaactgaggtaccgggttcatctcactggggcttgtcagacagtgggtgcagcccatggagcagggcgaggcatcgcctcacccgggaagcacaaggggttggggaattccctttcctagcaaagggaagctgtgacagatggtacctggaaaaatgggagactccaaccctaatactgtgcttttccaagggtcttagcaaacggcacaccaggagattatatcctgtgcctggctcgtagaatcccacccctacggagcctcactcactgctagcacagtagtctgagatcaaactgcaaggcagcagtgaggctgggggaggggcatccaccattgctgaggcttgcgtaggtaaacaaagtggccgggaagctcgaactgggtggagcccactgcagctcaaggaggcctgcctgcctctgtagactccacttctgggggaagggcatagctgaacaaaaggtagcagaaacttgtgcagacttaaacatgcctgtctgacagctttgaagagagtagtggtcctcccagcacagagtttgagatctgagaacggacagactgcctcctcaagtgggtccctgacccctgagtagcctaactgggagacacctcccagtaggggccaactgacccctcatacaactgggtgcccctctgacacgaagcttccagaggaaggatcaggcagcaacgtctgccgttctgcaatatttgctgttctgcagcctccactgccaggccaacagggt

SEQ ID NO: 36151 - DNA, 1049 bp, Homo sapiens
attcaggtttctttcactattagaattctcttcattctgtgttctgtaacatggtatcagaaacttttttatcttaattttttattttaaatactttaaaatactccttaaagtagatagaacagtataatgaacacccagggacccatctaacaatctcagccatcaccactccatgccagtcatgctccttctatacttccatccacttacccctctcctgtattattttcaaacaaatcccagacattagactctctttattaacatgatccctctgtcatctgtattattagcaccatgaggtcttaaaaattttatttagtttttaacaagcctcaaattgcctcactgtttctgtgctttccatttttttattgaaattttttgagataaccataggttcacatttagtaataagaaataacaatcccatctaccctttacccaatatcccccagtagtaacttcttctaaaactatagtataatatcagaaccaggatgttgacattgatataatccactgaccttattcagatttccccagttttacttgtactcattgtgtgtgtctgtgtgtgtgtatttggttctgtacagttttatcacatgtgtaggcttacatatccaccaccatggtcaagatacagaatagttccatcaccacaaagatatctcatgttgccgttttataactagctctctgccctccagtcccccaacactaatctgcggtttttgacttcaaaagtgttgtcacttcaaaaatgttatataagtggaatcatacggtatataacttttggagattgacttttatcacttagcataattccctggagattcatccaggttgttgtgtatctcaattgtttgttcctttttattcctaaatagtatggtatggatgtaccacagtctgtttaaccatgacctgttgaaggacacctcattgtttcaattttttggctattctgaataaagctgctatgaacattcatgcacaggtttttcaatgctctgggataaatcctcgagtgcagttgg

SEQ ID NO: 36152 - DNA, 1069 bp, Homo sapiens
ctcagtctccctggagtctttaggcatctcttttacacaacatccgataactgacttttaactgtttctattttaaataatacaaatcaattaaaacacacagctgtttaacaaaacttctcagtgttggtataggtctcagtgggtatttcctgatggctgataatgacatcaatttagtgcacctggtagtatctgtgtgaactggaagtggtttaattcttaaatgacgagaaaattaagaaggctttatggattgctgctgctgctgcttcagaatcactgccagcttcctttgcaggcttccttcatggtggagctttatttaaatgggactacagatatcatgtgattgttttctctgtaattcactgctaatttattgaatctgagtttctaagtattagctgtgggtattaataagtcatttagggggcaggtttatggcagcacaataaatgtatctaccttgcaggctttttgtagaaacgttcctatgttttagcagtattcagtgattctgccacactttattgtctcaggagtgtgagatatactctgtttgttatatccttactttggtatcttcgagtaataatgacagttctgtttgtctctgtctctactagcaattatttttagattatcagtctgtacatgcattgtgacttttaatgtttattaaatgttgatgctatgggtaccatacatggtcagggtactttccatattcatttttttttttttttttttcagacagagtcttgctctgtcacccaggctggagtgcagtgacatgatctcggctcactgcaaccctcgcctcccaggtcaagtgattcttatgcctcagcttcccaagtagctgcgattatagtcatgcgccaccatgcgtgtatttttagtagagaaaaggtttctccccattagcttggctggtcttgaattcttgaccttgagtgatccgccagccttggcctcccaaagtgctgggattacaggcgtgagccaccgcgcccagccaatattcgtttttttatccattcggaaatgtttactgtcattcata

SEQ ID NO: 36153 - DNA, 1034 bp, Homo sapiens
gcagctccatttatttaaaatactaagctttcttgattcagttacctttgcacctttgtcaaaatcaattgaccatatttgagtgggtctatttctggactctctgttctgtttcattgatctatttttctgttcttccaccaataccacattgccttgcttattgtagctttatattaaatcttgataaaccctgtctctaaagaatgagtcttccaactttgttctttttcaagaaggaacctttaactttctgtgtaaatttttgaatcagcttctgaatacccacgaaaaatactgctgagattttaactgggattgtgttggatctgtgggttgatttggaaagaattaacatcttaatgagtcttctaatgtgtgaataaggtataactctccattcttgtatgtcttctgtgctttctttcattagtatgttattgttttaagcatgcagatcctgtatacatttccttaaatttttatgtaaatatttcaatttgggatgctattatgtttaatatctgttaaattttcaaattctagttgtttattgctcgtatatagaaatacaattaatttttgtatattgtccataggttctgagaccttgctaaactcacttagtagttctaggagctttgttatagtttggggaggggttttctatattgacaattgaagacagttttgcttcttcctttctaacctttctccttttttcttgccacattgcactggctaagacttatagaatgatgttgaatagcaatgatatgagggccatgatggttaattttttgtgtcagttggccaggctatggtatctagatagttgttcaaacattattctagctgtttctctgaaggtatttttaaaattagattaatattcagatcagtagattttgagtaaagcatattgatgggtgggtctcatctgatcagctgaaggccttaacagaaaaaaaaactgacctcccctgagcaagaaggaattctgctagcgtcttttggactcttaaaaacaactc

SEQ ID NO: 36154 - DNA, 1034 bp, Homo sapiens
tccagtgtttggttgtttaccctccctgcacagttccacagtggggcagccattgggtcaaagccaggaaataaaagacgaaaaaccaggtgacttacccccaaagaggttatttgaattttggctagtctttccagtctgctactatcgttaacttttcagagtcatagggtagttgctttttaaattttgtttttttagttttaatcggtgggagagataggctgtggtgggtttactccatgttggctggcactagaagtcttgtgtccttatgtttaagtgctatatatattttttatctcatattgttgtacttaaaaattccactctagtttttgtctgtaagccaggggagtttaatctgtttacctttattatgatgactgatatgtttcaattttttccttttatcttatttgtgtttctgtttgttctgtctttttgatttcctcttatgacattctgctccaatcttaaggaaatgatgtgactcttgtgactgctttttaaatctctaaaatggagataaaaggatctaaccagtgtgttatcttaaaaatgaagtaagataaatatttaacacttttattgcggtcccaggtataatcaatttaatttaataatattcattgagcacctatgaggtactcaataacagaataggtaaaaattgctgcttttatggagcttatattctagtgggggagacaacaataaacaaaagaagtaaattatattgtatgatagaacatgaaaagagctatggaaataaataaaacatggaagaggatagggagaacaccataagggtaaaagtgacaattttaaactggcaattcagttatttttgcatgtgggaagtagtactgctttattttttgtatgttttatttgtgtagtgttttatataacaccttccaaagcactttaacctcatattttgcttttattcttatacattgattcaacaataggggccagacttatactagactctggggtacaatgaagagcaaaagcagacatgagtg

SEQ ID NO: 36155 - DNA, 1054 bp, Homo sapiens
tttttttccttgcctatgctggactcttaatttccatttaaattgtataagcagcttgtgaaatttcacaaaataataccgggactttggtattataataagttggatctagaggtcaattcgaggagagtggtcatttttacaaaattaactcttccaatctatgaatatggtacatcctccattgattagtttttaatgttttcttttaatattgttttatagtattctacttatagaactggcgcgtcttttgttgcattttcttagcttcttgttttgtctagggccaccagtacattgttgggtggaagtggatatgggtattcttatctcatttccttcagagggagaaccttcaatattttaagtgtgaggtttgcattagattttctgctagatattttttatccaattaaagaagttttatcctattcctagttgagtcagtgtgtttgagatgttgatgttttaaaaagatcaaatgctttattggcatcttttgagataatcaaatgatttttctgttatactcctttaattgattttcaaatgttaaatcaacttgtattctggggaaaaaatacaacttcgttgtaatatagtatccctttaatgtattgctggatttcatttgctaacattttgcttgggacattttcattcatattcataagagaaattagcctgcaattttttttcttataatgtccttgtcaattttagagatcaagcatatgttaccttcataaaatgagctgggaagggatcttttttttttcctttcctctgcaggagtttatgttttgctgatgttatttcttctttaaatgtttgggaaaattaatcagtgaagccatctgggtttggagttttcttcttggaaagatttttaataaaaaacttgatttcttccatagatattaatctgacttatttgaaggtcgtcttttttaaaaaaatttttcctggctacttttaatattaacttcatggtttttttctactgttatatattgctgtagactgaatgtttgtcttccaccaaaaatcg

SEQ ID NO: 36156 - DNA, 1046 bp, Homo sapiens
cctgcatattttctatgctcatttcccccatagggtcatctgcccccacattctgttcccaaatctctgcatggttgtttttttccttgtcgttctgatctttgattaagtttcaccttattttagtccatttaggctgtcataacaaaaataccatagactgggtggctcaagaaccaacacttatttctcccagttctgaaggctacaggatccaggatgagggcactggaagatccagtgtctggtgaggacccgtttcctatttcatagatgccatcttctcactgtatccccacatgataggaaaagagtgagagttacacctcttagggtgtaaccctaagagggatacacacattcagtccattgtattacctcttccttcaggccttccctttccaagtctaatgtcaccacaatccctccagaatcatgttaccctgttgtgtttcctttgtagggcttataattatctggattatcttatttattcgttctgtgtgtttattggctgtctcctgcactgaaatctaagttccatgggatcaggaacattgtttatctaagagatgcagtggtctctataactatagctagaagtattctggcagacacataaaaaagatgattgattaatatatgttgaattgctaaatattagtttaaggcaggtaagggaaaccagattcaagttggacaggaggacttggcataggcccaacacatcagggctttgagcccagggcccagttagggatgggaatgaaggttgggaagagagctgtagagaggaagctgatgccttgctggaagaatcaggcgactggtcagagtcacctggagatggcactcagggagaaacaaatgccaggtggtgctaaaaatgccagatacatgcaataacctatcactagtggataactcatccctcaccaccaccaccccaaatctccatacccagtgtcaccaatacaagaggaattgtcccttccagttcttgtgagtggatatgtgcataagcatacagacatgaatgtttggag

SEQ ID NO: 36157 - DNA, 1050 bp, Homo sapiens
ttcacaaatagggaggtctggcatgctgaacctgcattcccacatgggacagttggctggagcagagtagccagcatggccttggatgggtgcactcggcagtttctcacgggccccgtcatctgctggtgtatttagctggcattatccccttaggtcacctgctttgtcttcataggtatttgagtttgcagtgttggtataatggttaatccacaatacaaataatcaataaatgtatcatcaataatagtgtttttgttggtagaacttgtgcacagattacccactacatagaaacctcctagggctccccattgcttgccaaatgatgtccacgtccctaacttgggtatggtctgacctatatcttatatccaattactaccttataaaagaaacagagttacatttcaggcttttaacttataaaaacagccctgtaggcttgggagagacagaaggagagaaatgaggaaaaagaaaaacaaaaactcagagacggaaagagagagagagacaaacagaagtagaacaatttaaatagtgcaggccatctcctcccatccctggttctactcgtggaacatgtgcccactggcactggatacatgtaggcttgaaacaacatgttgacaaaatttgtgtaaagaaatatgcaaatgattttgagtctcttaccattgacaaagaggtgaataaaatgaattgtttaggttgtcaaactactgagctttgtgaacatccttgaagaaaaactgaagaataatgataggccaaagagaaacactggccaacagagagggaactgataaaatgcaactacagtttatattgtgtaaacaaaaatgggtgccctgctatactcgaccatactgctttatcaatgaatagtcctttctcaccaacttcttctgatgtttggattataaattgtttttaaaaatagaaaataaacctgtatattaattcaataacttggaatttgagacaaacctttattttaaaggagtaaaccagataaattattttagccttttcaaagtaact

SEQ ID NO: 36158 - DNA, 1285 bp, Homo sapiens
gccagaaaatagaaatctgaaaactgatggacaaataagcttccttcctattctaagacttgattctccttatgctgctgaccagtaagttgctgaaggctattctattaatagaagggtataggaagtacttaacaattattgtttctgcggcacttcatgtgcacaaaggtgtttgaagctactcctctggatttttacagggcttctctatggaagcattttcacatttttattcctaaatctggtagttctttacagtaatcctgtgatctcaagcccttgctttaacttttgtattgttagtagtgacatctagtggttctgttgcaagtatcttgcattctagaccattggagctgaaagtgattttagtgaccaccaggtctcattttgtaaattattaaaaataaactgaaaactcacatgtattcctacattcaaatcaactctatataataataaataaaacctatagctgtgtaatgctttcttggattactttgaagcttttcaaatacccagaagtcactgttggttataaccatgaggcagaaatttaacaaagcatgccctgataaattaaaaggaaatcatagttcagtatagctacagcctttggtgcattgttatttacaggtacatgccagaacctcaggctttcgcatggtgcctggtgtttggtagcactcactaaatctttgttgaatgtttgaatatgtgggtgatcacgaagccctggagaagaatcacagaagatgtgggacttgaaggacagagaatttgataagaggctagaaagctaagcttttaagttaggggccatggaaggccaaaaagggaaccatgagtaggacccaacagggcacctttcaaggttttaacagagaaagttgactatgtgtagttgttggaggactcatttggaagtggtaaattggatggattagaaggaagagaaactggatagaggccaagaagctaatgtagtggtgaagtgatgaatttctaagttaggaaggtgacagagtaaagagaaagaaatcagtgtcagagacattttgagaaccagaacttgatgtgaagagaatgagaagacacttgttatgacttggttatggcttacattctatactgggagtccctgtccaggcctggaccgtcttccttggtctctgttctgcaggtatcagggattgaacttgctttcttctttcaagaagtgccacccaccctatcctgtgagcagatttctttctcccgaccagcagcagagtgagatgta

SEQ ID NO: 36159 - DNA, 1076 bp, Homo sapiens
gaaaacagaaaaatcagaaaatattgagctacagaaagaagaaaatgaaaatcatcaataatctaaacaccatttgtaatcactactaatgttttaatctctatccttccagacatttttttttaatgcagtcacttttttttttaaatggaaataaaatgataatgacaagtaaattatgacttttttcatggctggaaaacagtccattccaaaagagttaagattggatttgaagcccagctctgacacttactctccaagtgagcttattcaagccctttgtgtcttagattcctcagctgtgaagttagaataaggacattatctattacatggtgttgaagtgaagattaaacacaatacacatacataacacagaagttattaagagagctattactattattttaaaccacaatttagcaaattcttcattgatgtccatttaagtttttctcaaattttttgaataataaacacataatcaagtgttgattctaaaaaaggaaaaacaaaacaaaacaaacccaaactttgtgtgttttttctttcgtaggaatttgcactgtccactttgggtgctgccctgtcatttgctctttttccatccatccagggaaggctctgcagcaaaagtgaagcctttccccaagcccgttctgccgcctgacaaaagagggcgccattgtactgttcatagacgatgccttgcgtcagtaaacgtgggaaaagttctttaggagtaatgctgtttttataaccattttcagattcatccttaccaattacaacaagttgtccatccagagttggtttagtttgcgccgagtcgagatcatttccaacaattcaatccaagcagtctttaacccaactggcgtatatgctccctctggttactcctaccgctgccaacgcgtgggcagcctgcagcaggaccaggccctcttgctgcccagcgacacggatgatgggtcgagcctgtgggaggtcacttttattgatttccaggtaataaactaaaacctatgctcaatgcacctgcgtttttggtaccaaaagagctcagtgtt

SEQ ID NO: 36160 - DNA, 1055 bp, Homo sapiens
tatatgtaccacattttctttattcagttcaccactgatagacacctaggttgattccacgtttttgctattgtgatagtgttgtgatgaatatacaagtacaggtgtctttttggtagaacaatttattttccattgggtatatgcccatttgctgggccaaatgatagttcaactcttagttctttgagaaatctccaaattgctttccacaatggctgaactatatatattaattttggaatagagatttaacattatacacaattgtagtagctggttcaatagtctctgtgaacctatcttcacgtcttacactagaatttgatgtctgcagtgcaggccttttggaagggagggaggggatgtaaagtgggggagggcaaggacatcctgtgcatagtaggatatttagcagcatccttgacctctaccactagatacccaatacctaggagcatcccctcctccagttgtgatgaacaaaaatgttctcaggcactgcaaatgtcctctgggagacaaaaaccactcccagttgggaaccactgacataagtcctttgcctgtggattcacagctgtgaggaccctaaagtggctatgtggcagtctcaacttccagttgaatggaattgttgttttgtctcttggtggaagcattcctctttctttgtaactaagaaatcaaaaccagccaagccaaaagttgcaagtatgggaagcaaaacctttgctagtgaatcatcagggtattagtgagagggttacttctatttccatcccttaagtctcagattcatgaagcctggttatgggagtcaggttgctataacttttggccagttctacttacaatctcatttcttctcctgctaaatattatagatcacttacaaacttacaatttagcaaggatcttttgtttgtaaaattaagacaacccctcccccacctcttccagctcacctatgtaaagaaaaattagtctcagggtatctcatggatctcaaggtctggatcccaagacccagctaggtcttcttgaatgactgg

SEQ ID NO: 36161 - DNA, 1101 bp, Homo sapiens
actgtcttttgagcagagaggtggcgcgaaagctcaccaacttcctgggtccagtattctcaggaggccatctcttctgctgaggatggcttcctgcaatgggctgtgggtttgttttatctctgacccaaaatagcatttgtattcagttctctcaatggagagagtggagagagcaaatttcatttcttcattatgcaaaaagacacatgtatttataatgaacaactccatttggctttttacttttaggtgggcatagacttcaattgatgccagatcctcctttttccttggagaatcatgcttgtactttcttaaattacatttatctacccttctgcattttctttactctgatattctttttggaaacttttttttttttcaaacctccaaaccacaaagtgaaacaacagggaacatgttcttacaactgggaagtcaacatgacagacatgtttggatgtctgttatatagcttgctgtagacccatctattaataaataactgaacgtggccgggcgcggtggctcacgcctgtaatcccagcactttgggaggctgagtcgggtggatcatgaggtcaagagatcgagacccttctggacaacatggtgaaaccccgtctctactaaaaatacaaaaattagctgggcatggtggtgcgtgcctggttcaagagattcttgaaccagggagttggaggttgcagtgagctgagatcgtgccactgcactccagtctggtgacagagcgagagactgtctcaaaaaaaaaaaaaaaaattgaacgtatatgaagactataagtaggaaacttacccaccaagaattaaaaaagaatgaaaaggctttctgaatccaagctttaacttattttcaaagcactaatgtaggccagtggacatttgtcacatgcaagatgtattaggcattgtgagaccagattatggagaatgtgggaagctaagactgacagttgccaggttagcatcttcatgttccctgaacagaggaagagatgttgaggttgtcatgacatcactcacagaaggctcttgcatcactttcctcgtctccctttcattactagtaaga

SEQ ID NO: 36162 - DNA, 1029 bp, Homo sapiens
acctggcgaaagaagtgcacagagctatagaagcaaagccaaaagatcctacacagcattctctacagttccgctccctacagagggagggaaagggaaaaaaatatagagaaagaaaaaaaggaaaagtcttacctgcatgaaaatgattatgaaaattagaagggcaagtatcttcagatgagaaggaacagtgcaagaattctgacaccatgaaaaatctgaatgtagtgacatcaccaaaggattgcactagctctccagcaatggtccctaaccaaaatggaaactcagaaataacagataaagaatctaaatcatggattggaagggagctcaatgagatccaagataaggttgaaaatcaacagaaaaaaacttctaaaggaagagataaacatcttaacaagaaatcaattagagcttctggaattaaaatactcacttaaagaatttcataatacagttgaaaattttgatagactggaccaagcagaagaaagaattttggaacttgaagactggtcctttgcaccaactcagtcagataaaattaaagaaaaaatatttttaaaaagtgatgtaagtctttgagaaatatgggattttgtaaagtgaccaaacatacaaactgttggcattcctgagagaaaaatacgcttaaatacatagttcacagaccctataaagcaaccacataatagaaactacaaagcaaccagctaataacttcatgataggatcaaaatcgcacatatcaatattaaccttgaatgtaaatggtctaaataacccacttaaaaggcagagtggcaagttgaataaaaaaacaagacccatctatctgctgtctccaagagactcatctcacacataatgacacccataggctcaaaatcaagggctgaagaatgacctaccacacaaatgaaaaacaaaaaagagcagaggccacgatttttatatcggataaaagagtctttaaaccaataacagtaaaaaaaggacaaacaagggtattatataata

SEQ ID NO: 36163 - DNA, 1055 bp, Homo sapiens
tacttagaagaagaagtttatcagatttctagatgacaaggtcagagagataataaacatgttgggtcacaggaacagaatcactattcaacgtaaccttaacaagccaatataaaacataaaattgaacctcagcaaacacatcagacaacatcaacaaaaattacaaacaaaggatagagtaaaagtgacttagtaataacatacatagaaaaacaactaaacaaggtttagttgatattaaactcaaataggaatttttagaatgatgtagctgccaaaaacataacaaaataccctcaacacaacccctatcactctcactatcactaaaaacaataattaaaactgaatgtgatatttccttgaaattatagaagtgcagtatttaggatgaagtaatagtctttgtctattttttaattgtttataatacaactagactaccagttgggactcagtgaactatgctttgagtggcagagattaactgtagagaattttgtggagattaatcaaactagtgagggtatcagaaatcatcttataagaactgttttgactgcaagcatatagtcttaagaagaggcctgtcgtgtgtaagaggatttatacttaatctgtatggaccctactggtattactaggaaaaatgggtagaattcaagggtgacagatctgaaataattttaaataaatccaaggacaagtatttgtggaaagccttctttgggacaggcatagacttttcaaatcctcagcagacatatccagaagtcagcaatagggcataggagatcagagttggaaacttttttcttgtaacttgttccagaatcagaactggctgttttgtttcccacacatctcatatgattgcagaatataagcttggttaactaccatttgatgggagactggaaataaaagtcttagttttgttttagagtagtcttaaaacaacagctccttatctggcaatgctgtcacatggcagaagctccctaagcatacctctttcatggtccaaccctgtttctttatctggtaacttt

SEQ ID NO: 36164 - DNA, 1072 bp, Homo sapiens
ttgtttagcatttcattacaaataagggtttcagtcatatttcaatttaagaaatgttacaacataaagtaagtatactttaaaggataaagtaagtatcctactctgtatcttactatattttagaagttttatttattttttagtggaaaatccattctaagtttcagacagccttcccaccattatttaattgacgtttctcaaatatatgaaaatgaggtaaaaccagtttgccaaaataaacatccagagttctttttaaaaacagcagtccaaaatcctatattattgccatgtgtccctgtggtttcagggactctgaattcaaagggctatttccagatgaaatatcagaattgtagcatttattgtgtattctgccaaagattttgtcaaaaatagtaatgactttcaggtctgtgggaatatgggttgcagatgtgttgtttgaatgcctgaaaaggaaatcatagtattctttattttggtgataaaagtatttgtgtacatgtgccattttgatactgaacactatataatttttgtgatctttttggaatgtgaggactaagtaatgtaagtggtgaagaaatcccattaaaagtatacgttttctagctaagccatatattaaattttataatttgaaaaacaaaaatatcagtgtttagttatactgttttttgtttgtggacccattttctttcttgcttcatatttttctgcctttatttaaaatgtttgcttcaataataaatattttaaagtcattatatcttaacttttttgttcagaaaaggaacaacttagcataagaacagagcagaagtaggcatggcatagtggctcatgcctgtaatcccagcactttggaaggccaatgtgggaggatcacttgaggccaggagttcaagaccagcctggacaatatagtgggacccttctctctaccaaaaagaaaaaagtaaattagctgggcatggtgggacatgcctgtagtcccagctacttaggaggctgaggtgggagaataactttagctggggagtttgaggctgcagtgagataa

SEQ ID NO: 36165 - DNA, 1026 bp, Homo sapiens
tttatgttttatgtaattattgacaattacataaaaaaatggtggtttaaaaatctactatctctgtttgttccatctttattttatttacttgttcctctctgttttattttgggttaagtattttttattattcttttatctttttagttatcttgttatctataactcatctttatgctatttttatgtttgctttagggtttatagcatacatctttaccttatcacagtctacattgaagtgatatactacttcacagatattatggcaccatactttcatttctgcttttatgagcttatgctattgtggtcatacattttacttctacatatcttatacacttcacagttattgttacattgattttttttacttttaacagttaacttacttttttaacttttcattttgaaataactttagagtcgaaaagtttcaacagtaatacacagaggtcctgtgtacccttcactcagctttcccgatgataacaatatataactgtagtacattattgaaagcaggaaattgactttggtacaatattattaactaaactacagactgtacacagattttatcagtttttatgtgcactgtttttattgttcttgttgttgtttcggcatatagttatgtgaatttggttccacatatggattcatgtaactaccaccatagtcagggtacagaactcttttattacctcaaagaaacctctttattcccttgtgttaccccctttatattcagactatccatccaatataatccctggtagccaccgatctgtttgtcactgtagttttgtcactttgagaatattagtggaattgtacaatatatatccttttgagattggctgcttttcactgaccctaatacttttgagatccaccaaatcgttgaatgtatcagtagatcattttctttattgttgagtagtctattcttacctcatggaatgccatggatgcaccacactttgtttattcatttattcactgaaaaaaaccttt

SEQ ID NO: 36166 - DNA, 1049 bp, Homo sapiens
aaaccaccgatgtaagtctaagagctcaagggccgaagaacctggagtctgatgtccaagggcaggaagcatccagcacaggagaaagatgaaagccagaagactcagcaagcagcttatcccacctttctcgcctgctttgttctagccgcactggcagcccattgagggtaggtcttcctctgccagtccactgactcagatgtcagtctctggcaacacccttaaagacacaccgagatacaatattttgccagctatctaggcattcttcaatcaagttgacacgtaatattaatcatcacagcatgtaaaacagtttaagaattgctaatgaatatccctgtgaaaaacaaatttttaaaatatagtacagtatttgatatagtcctttttgtctttatgcatatatttaaaatttcttaatttagttttattctttcccacccctttctgtttctcaatttcattttggattcatctcaattctagctggtattgattaattatttacttttgggtatgtgaacaattacaaaaaatcagaactacctaaaaaggtatattcagagatgtgccactgcactcttaccctactacactcttctcatttccagacattttacattacatttccatccaacccttttatgtagccaagctcattagtttctggtttatgtgtcccgtatttcttttgtacaaatgagtatgcacattttcttatattctttcttaaatgaagggtagtacgctataaacacaattcttttgcattttgcttttttacatagcaatgtattctggaaatcactccatatcagctcataaggaacttctccttttttgtgtgtacaagtacataatatgccatttagggatatgtcaactttcaacaaccctccaatgtatgggtatttgagttgtttccagtatttcattatgtaaacaacactgcaatgaataacctatgtatttttgtattgttgaaggtttatcttttcaggtgaattcctacatgtgtgattggtagatcaaaaagtaagtat

SEQ ID NO: 36167 - DNA, 1032 bp, Homo sapiens
gtaaagaatattgaagccaaaaactaagttgtcaattatcatactggaaaataaatagtaatgcggtcatcatttaaaagtcagctggatgcacagaaaggatcaatctgtaaagaaactttcatagtttaatatgtctgatgtcaatataaatcctacttatttctccagctttgacttggataaccacatcttctgtggctggctgtgcagtaggcaaatggaagtacccttgattctgacttttctctggaagtgaatccagagagaaaataagcagcttttctattcttcctcatctttaggcaccctagaggaggttgctgatgttaataatcaactatatcacttttgaagacttagtttaatatatgttgatcgtttccttactgtttgccttattgggggaacccattcttctccagaaaaggacagatcctctcttggatttatatatatatatattatgcagaaacgtttcttctagaacttctatatataaaagaattataggccaggcacggtggctcatgcctgtaatcccaacactttgggaggccaaggcaggtggatcatttgaaatcaggagttcaagaccagcctggccaacatagtgaaaccctgtctctactaaaaatgcaaaaaaaaaaaaaaagcaattagccaggcatggtggtgcacacctgtagtcctagctactcaggaggctgaggcagaagaatcgcttgaacctgggaggtggaggttgcaataagcttgagatcgcactactgcactccagcctgggtgacacagcaagacttcatctcaaaaaaaaaaaaaaaaaagaattctagctatcaacaacaatcaccgagtgatagacagcacagttatttacagcactatggagatctagggtttagttttagttctaccaatacctttgctcacgaatacaggcgttttatacgaacatctctaaatctcacttttttaatctgtgaaatttaaggagaaaattaggtaatctgcaaaattctatcagctcta

SEQ ID NO: 36168 - DNA, 1050 bp, Homo sapiens
atgttaatgcaaccaaaaggtttgttttcacacttttatctcctagctaagaagcctctgctctgatctcctcccttagactcaactttctgagtgttaaagccatgtgttctgtattagcttgccacaagctggtcgctccataaagactgtagaaaatgctggcttttgttctcaggccctgaaacaacagaattcttccttaatcattttcaggaaaacaacaatagcataaaccttatctctaaaagtagacagatgtacattcctttaagctacattgtcacaacaatgatttttcaagtacttcaggctctaaaatcagttttacattacgtgactgatataattaaggagcaaaatcagattggtatgctgtggggaaggcattggagaggttaaattagggaacgaatagaattatccagcctgacttccttatttgatattttcttgtgctttattaataaaactggcactggaaaacttttaaacaacatttttcgtctctctgtgggtaaaatttaaatcaaagcctgtctgtagccacaaagactattattaaagaattcatcctgatgtgttttaaattatttatttaattgaaaaatacacatgaaataacaaggtacttatgtttaaatagagtaaccaaaatctgcacaaaattcaaaaaatgtttaaaagtttatattcatttttatctctctaattcatttacatgtatgtaacttgtaaatataatggactcattattttgctttccttcccacctaagcatgtggctagattcttatttatttcctacttaagacgttattatattcagaattcatttagtgcgtagaaggttaaaagcatttagccatatagaagcctttcttaaaccacacataatgccaatagttttccaaaatttctaatttatttttcaaaaaattttttagtgtatatgtgtgtgtgtgtgtgtgtgtgtatttttttttttttttgaggtggagtttcgctcttgttgcccaggctggagtgcaatggtgccatctcagctca

SEQ ID NO: 36169 - DNA, 1075 bp, Homo sapiens
gtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgt

SEQ ID NO: 36170 - DNA, 1032 bp, Homo sapiens
tgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtc

SEQ ID NO: 36171 - DNA, 1035 bp, Homo sapiens
aacaaactaactgtgactcacgctgcagacattgcatttgtgtgcttaggtgtttatctatgatctgacctctcctaaggattttaggtggatgttgcacatttggctttggttctgatgcaatttcaccattgatgtaaatcatcggataattttaaaagacagagtggaaaagaagaaactaccgtaggtgaacattttagacagaaagaaaattcagattatggatagaatggcttgcaacagaatagaatgcagtcaggttggtaaatactggttcaccgaggtctgtcttcttgcaaagtgttctctttgtgttttcactcacaaaactgagagaacatatcccagacaatcttttattttttatttttatttttttatttttgccacatggagtacataattacgattttgggggacatattccaagttctcttttgttaagtggtgtagccgttaattcataatgtaagaatggatatatatcaccacctagtggtcgtattgtattttgtgtttcaaaaccacattcacagaactacacccagatacacacaagaataatactatctgtaaatcaagttcctgtagttttgaatagtttcttaattctagtataaattgcatgatactgtgatcctgaaagttaaatgtgaaatgagaggatttttcaaatgcagcatgaagctaacacatgtagtcaaatacttagtaaaatcctagcaactaaggcaaatattaggacctatctgtcctgtgttttcactttatacacaatagtagaacgctggagaaagttttctttggctagtttccttgggaggtgaacagagagggcttttgcagggttttttagatgtttttttttttttcactgtgaactaaattagcaatgtttggaggaaaacagagtaagtgaagagcagtgactgaaccgttcaagagaaaaactcccaaattatagtttgaagttcagtaagttctcccaacaattaaaataatgtattgtgaatggcttgactacacacatgt

SEQ ID NO: 36172 - DNA, 1005 bp, Homo sapiens
aagactttgagacacatatattttctactcacagtttaacagtctttttctgtaccaccaaaataatttcagctatatgaaacaacagaaattgttgagtctattccaattagattgtgatataataccgtcgttgctcttacgttactttttgactagcaagtagttaccttctccctccatttttacagcaatacgagaattggagacccaaccagccagacagcttcttttctgctggagaagactgtgttgtaatcatttggcatgagaatggccagtggaatgatgttccctgcaattaccatctcacctatacgtgcaagaaaggaacaggtaatgatcaccctgttaataatgtgtacttaatcttcatttcaattataaagataattcaggaatttgtgtctcaaattcattgtttgagacacaaactggatatgtccatgtatgtcatctctcgttgctctggaatatttcactcttccaaaacaattgaaaagtttgttttcaacaatgttctcaccttagatttcaggtccttaagataacaatgtgacattaacgtaggaatgctgcctggtaatatctttaagaagaacaactgccagtccaaaggccaatagacctttttatttttatttatttatttatttatttatttatttatttatttattattattattgttttttgagatggagtctcgctctgtcaccaggctggactacagtggtgtgatcttggctcacggcaacctccgcctctgggttcaagcaattctcctgcctcagcctcccaagtagctgggactacaggcgtgcaccatcacacccagctaatttttgtatttttagtagagatggggtttcaccgtgttagccaggatggtctcaatctcttgaccttgtaatctgccagcctcagcctcccaaagtgctgggattacaggcttgagccaccgctcctgaccgacttctttttttattttgatgagaacattac

SEQ ID NO: 36173 - DNA, 1194 bp, Homo sapiens
aaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcgatcttaggtttatttctatgatttttttttttatcgttaacttggaaaaaatacttttgctcttgccctttgacatagtaaattttttttcccatgattgattaatcatcaagaaaacttaatttattcaaattgaagttgtggttaatcagatatttaggagcttcatttttgttttttttcctctaggtctgtaacctaaaacagaagtgtttgcctcagtaagtgttttggtgaccagtattggtcttatttagaatgaataaaagaatatttg

SEQ ID NO: 36174 - DNA, 1025 bp, Homo sapiens
ggaggctgagacaggagaatggcgtgaacctgggaggcagagtttgcagtgagccgagatcatgccactgcactccagcctgggcgacagagcgagactctgtctcaaaaaaaaagaaaagaaaaagtaataagttagagatgtacttgttcatccattttacctcagtggtaacatcttgcataactatagtgcagtatcaaaaccaggacattgacatcgctgtaatccacctattttgttcacatttcaccagttttacatatattcatttgtgtgtgtgcatgtatgtgtgtgtgatatatttagtatttagttctatgcagtattgtaacatgtaaatttgtataatcattaccatactagagatacagaagagtttcttcaccactagaatctctcatgctgtgttttataaccagagtgtctccttcctctttccttattccctggtaactgctaatttgttcttttttttttttttttttttttttcctgtggtcatttaaagaagattatgcgggctgggtgcaatggctcattcctgtaatctcagcactttgtgaggctgaggcagttggatcgcttgagcccaggagttcaagaccagcctgggcaacatggcgaaaccttgtctctacaaaaaaaacaaaaattagctgttcgtggtgttgcacaccatagtcccagctattcaggaggctgaggtgggaggatcacctgagcctatgaggttgaggctgcagtgagttatgattgtgccattgcactccagcctgggtgacagaatgataacctgcctcaaaatggaatcaaatagtatgtaaccttttgggattggcatttgtcactcagcataatttgtcaagttcgtgtaagttgaagtatcaatattttgcccttttttcattgctgaatagtagtccatggtgtagatgtgccacagtttgtttaaccgttcagccattggggaacatttgggtcatttctagttttgggtattataaaaaaaagctgctataaac

SEQ ID NO: 36175 - DNA, 1044 bp, Homo sapiens
tggatctgtaggtttatgtttttctccaaatacggatgttttcagccattatttttgaataccctttcaattccatgctcttttctttgggactccagtgatacggagttagatcttacgttactgtcttacagatcctcaagacttttaacttctttttagtcatttttcttcctgttgttcagatggggtaaattctattgatctgttggtcctcaagttcacagattctgtcttctgtcatctgctattgagcccattaagttgaaaaaaataatttttaaattgacaaaaattgtgtatgtgtgttgtgtacaacagatattttgatatatgtatacattgtggaatgactaaactgagctaattaacctgcgttaccttacgtactcagcattttttttgtgtgtgctgaaaacacaatcgtagcaatttaaagtatgcagtaaattattattataaactatggacaccatgtttgtaccatagatctcttgaacttattcctcttaactgaaatttatctcctttgatcaacatttcctcacctatctagtaagttttgttttttttttgtgttttttttttttttggttgttattgtagcttgttttatcatcatttggttggttttacaacctttttcttagctgaaattttctattttttaaatctgttttaaaagaatttgtaattgattgttgaagtgtttttaatgatagctgattgaaaattaaaaacctttccaacatctaatacacatcaacattaacatgtttattttctttttctcatccaagttgtgactttcttggttcttggtatgatgggtgagttttgattgtatgttgggcattttggcttctagataatttttaaataatcacttttcccctaaatatgattaatatatgtttactatagaaaatttggagactattagaaaatatgaagaaaaaccaatccttacttttactaccaaaggtaataatcactgttaagtttttgtatattatatatatctaaaatacatctgtatatatc

SEQ ID NO: 36176 - DNA, 1034 bp, Homo sapiens
tgaagccattaaagacattcttcatttctgttatgttgcttttgatttctaacatttctttttatcctttcttagaatttccgtttctctgcttacattgtctatgtatttgcatattgtctacctttttcataaagcacctagcatattaatcatagttttaaaaaattcccagtctggtaactccagaattcctgacatgtctgtttttgatacttgctctgtctcttcaagctgttttttgccttttattatgtcttgtaattttttattgaaaggtatacatgatgtactaggtaaaaggaactgctgcaaataggcctttagtgatgtagttataagggaggcattgtgtagttctagtattaggtcccagttttttggtgaacctgtgctcctggactgtgaacataaccattgtttctcagtcccccacccttatccctgtcacctttaggtgggacagaatggttagaaaggactggaatttggtatttcccttccctcttgtgaaaggctgaagtgaactggagttgtttacagtacttctttacccacaggtaggttaggctctggtaaattagtttctgttcaaggcaggccttgttaagaactgattgctctggcgtatttcaaaattgttcttttttccttccccctaccagaagcacaaagggatttttctctgatatttactgtaagggcatagtagagctcctggaggtaaaattcacaagagtgtcagggcctcacatgactggatcctcctggagtttttaattgtcatttgttggcactgagtctccagcaatttgtcattatagttgaggctttcttaccctggcactggttcccaaggaagtttctgcttgtgggtttctgctctgatgacttgagatttttctctatctgcctacctgtctctcaattttggggaaccgtggtttgccctgtgacctcacttctctgaaggatctaactacagctattggtttttcagtttgcttagctttttacttgttaggatggagtgg

SEQ ID NO: 36177 - DNA, 1027 bp, Homo sapiens
aacatctgaacttcacttatccttctgctttttgcattattgctctgcatgtttattatacactttttttttttttttgacatggagtctcactctgttgcccaggccggagtacagtgctacaatctcggctcactgcaacctccgactcctgggttcatgcagttctcctgcctcagcctcccaagtggctgggattacaggtgtgtgcccccatacccagctaatttttgtgtttttagtagagatgaggtttcaccatgttggggaggctggtcttgaactcctgacctcaagtgatccacccgcatctgcctcccaaagtgctgggattgtaggcattagccatcgtgccggcctattgtacacattttaatattcattagatattactgctttgtacagtcaatgtttgtttacacatgtatttactctttatgatgctcttcactttatgctgcatttccattctttcctgtaggttaggaactttttaacttttttttttggcctgtgtaacttcttttagtcctttttttttttttttttttttttggtaaacgtcagttgtcaaatatactttgtatttatctgaaaatgtacttgtttttgtttttgaaggatattgtttctgtgcattagattctagattcacagttactttctttcagaaatttgaagatattccattctctctgctttccagtatttttgttgcaaagttagcaaaaattttttatctgtttctttgaatataatgtctttctgttttgactacttttaagatttagttttgccaaagaacgaaactggaggcatcatgctacccaacttcaagctataccacagagctcctgtaaccaaaataacatggtactggtacaagaacagagacatacaccgatggaacggaatagagaacctggaaataagacctcacacctacaactatctgatttttgacaaacttgacaaaaacaagcaatggggaaaggactattaaatggtgctgggataactggctagc

SEQ ID NO: 36178 - DNA, 1025 bp, Homo sapiens
accttaatcacaaaacttttgaatactgcagtttgctatgcagtctttccttagcttcttatctgtgtagcttcacaattcagtagatatcgctggagggaaatagttaagcctgtggttcagttctctgtttcttttttatgaccagaatcctggcccttcaagtctcttaatatttgtctcaccagctttgtgagactgttgaaagttctgctggattgttttcctcctgagaattcatgcaaaagacccagacagaagacctgggtcttttgcatgaattctcagcctcttgctttgtgaccacaatatgcaaataaatagtttgagagaaaaagtggcagagtggctgctgaatggcaccttctttaggattctatttgttttgaaatgttggttccttaagttctgattgcctccatattgagctcttggatgatttaaacagactgatctttttattttttattttttgtgttttatttgtcttttctagcagttcttgattggagattattctgctgcaagtaatgtgacaagtattataactattattaaaaaacaaaataatgaacaatataggaaaaagtctttactccctcatacctccataatctcactgttcttggtagtaaccattgctgttgtgtatatatatgtataatgtacatgcatttgtataacacataagtatacgtttacctatgtgtaacatacagtaatgttagcataatgacattttggtcagtcctataggattataatgccatatttttattgtgtcttttctgtatttagatatgtttagatacacaaataccactgtgtgaaaattgcctatagtattcagtatagcaatatgctgtacaggttggtagcctagaaacaatatgctataccatgtgtagtaggccatggcagttagatttgtgtatgtatactttatgatgtctgcacaatgatgaaattgcctgaagataaatttcttagaatgtatccctgtcgttaagcaatgcataagatta

SEQ ID NO: 36179 - DNA, 1048 bp, Homo sapiens
ttcagacgtagtgatttcttatcttcatgtgctgaatggtatgatactataattgttgaagttctaagaaaaacccaactataagaattgatactgttttgaggatttaaagaacacagatacaagagattgaaaatgtgctgtaggtactaatactagcctcctgctagtaggtattgtgctagccttccctcccttttcctcctctctttcaacatttgatcagtgcataacatttcttggagaggtgtggttttttttcttcccttcgttatctgtttactagggtgatgggagttaaaggtagtaaaaacttcacaatcatggttgagtgcatttcagtgtaaactttgtattctcaaccttttgtatgttagtcttttagtgaattttgggtggacagagtgtatgatagtgctgtttctttagaaatgctctctcgaaactaaaacctcttggattctgtaaatatgttacctgttgaaaaaggaaacagcatttctgcccttactttgaactaacttgatctgagataaatacatacacacatgcacgcatgtgcacacacacatacatatgcactctagttatctggttatatacaaatatacccaagaatacctaatataaacacgccctcttctccccttcctcaagtttaagtgatgtgtagttggtctaaggggtactacagctgttttgcttagcctagtggttgttcaagtgaatttaccagtgacccaattttagtctctatcatagtgatttgaaaaaaaaggccaagtaaagtcacttagtatgagataaattttctttactttcctcttcactttaagaaatcagttgcttttttaatttttttatttttttttaacctttagcagactgtattagttcattctcatgatgctaacaaagacaaacccgagatggggtcacttataaaggaaagaggcttaattgactcatagttccgcagggctggggaggcctcaggaaacttacaatcatggcggaaggggaagcaaacatgtccttcttcacatgg

SEQ ID NO: 36180 - DNA, 1061 bp, Homo sapiens
agtaaaagtaatctgctggtaacttcaatttagttttctttttataaaaggaactctattgatgttagcactgttttaatggttttctgttgtgtagtagacagttttcatttgggattgtcaagttagttgtaaataattgtatagtttcaatgaaatgcctgtctgtattcacactaggatattttctcattgcacaaatttccatatttttctctgatcaagtgagacagattataaaacacaaaggcccctctaaggcccttcggatgtgttccagcaatatgcagcagccccccacccccttttttatttcccctgtgacagggtctctctctgttgcccagtctagagtgcagtggcacaatcttgtctcacttcaggcttgacttcccgggcttaagctatcctcccatctcagcctctcgagtagctgggatcataggtatgtgccaccatgcctggctaatttttgtattttttgtagagatggcgttttgccatattgcctgggttggtcatgaactcctgggttccagcagtcccctcctcagcctcccaaattgctggtttataaagttgggagctactgcgcctggccacagcacacatttataaaaaatgttcatgtgattccaaatttaaaatagagtgatttctgtgactttttttaattgttcacttttttaacatgcagtttcatcttagatgtatgatattgtatgtaaattgatttgtatttctaaaaaaatgaaattaagggactccatatctacctgtaagatttctcaacaaaaatttacaaagctagctgggaagacatgtatgtacttcttgaatttcctcctgctattccttttccccatcttccttagagaggcaaagaagaagagagagggagatttacttttaaaataggagaacattaaatgctttattattaatgtgttacattaagcagttttaagtcatagtatctcaagtacatactatcctttatattgcccccaacacccaaaatatacacacattgggaaaagaatgggggctctttgggggtt

SEQ ID NO: 36181 - DNA, 1045 bp, Homo sapiens
agccacagtgcccggcctatttgtgcttatttttgttcttttttttgccgtccttttcttcctcataagtgaagttatatcagtctgatcatgaaacctcaactggttacacatgtttggttttagattctttatctttcaaatatatatataattttccagtaaacttggaagaattcatttatattatacatatattatcacatggttctacattttgaatctcgtccttgtttttgtttccatcatataatacgttatcatggtatcaattaccaggtgcatttttaataacaggtcagcatttgaatggcttttatatttcagagacaatactcagtatcaaatatattgtacattataactttggaattctccctttcctttcggatttttctagtgagatggagtggctttctgttgtcttttacagccttcaaagctactgtttttaaattatgccacagacctgataatattctgaagagtattgctcctggaagactgcagtggagaatattgttttttcctattaattctcttacctgcctattctggcaaccaaatcttgatccatagaagtaaaacatactgagtagaggtgggaaaagttgaggaaatggtgtgatacagtccatactcatagtcatatagttatttagtgaaagagctaggattaggactcctaattcctagattagtattctgtattctacagtaaaagagatatttactccatataggcaaacagtattcgtactgaagcatcttactatgatagttttcctataaaatttgttagttacaacttttagtttgggtttccctctccttgctgtaccaccatcttctccatcctgattacttcaagaaattgcactatagttgaacttttcttgagctcttggaattctggatcaaatttaacaagataacctttaaagaaaagtgaaaattactcaatgtatacagaaaaataataataacaacccaaaccagaataaggagacatgacctcacatcagtacaagggatcaaggaaaaa

SEQ ID NO: 36182 - DNA, 1049 bp, Homo sapiens
agaagaaattttaaactaaaatgacattctgtcagctatttcagtgtggaaccaaaaatatgtagtttagtgaatttattgaattttggatatgtttcttttttggaacttgtaccaccaagtacttgaggtacttttgttttaagtcatacaaggttgaaaaggagctaaacttaatttccttaatacattagtttgcattttctttgtgtcatgtgctcttttgaggatctggtgggattttctctcctgagaagtacaaataagcacttgcatgcacagtcttgcatgaaattcctatcatattctagaagaaatttagagagtatcttggattcttgtcagtaagatttgttgtatcaacttagaaacactttcattttagcccatattatacaatcaatttctgtaatttttatgtttacttatgtattaagccttgaagattcagtttaaggagatttatttttttctttttactgaacatgaagttacttcataagtgccttgattggatgattggaactattagtaatttacccctcaaattatatctaataatctaagcattcattgtgctttcctaaaaacaatcaagtcctgatcttttctggatcatttgaacttaaatggagaaaaggcagagcatctatgtattatgagtcactgccaatcaaagatatcagaaatacttctctaaaattaatgtcatatttaatatatgataatttgcttctataattcctttcaggagcatacctattgaataaaatatagtgtatgtgtattgatttttgataatgtatacacatatttcagttgttttgaatctacctttataaaaagcttttggtactattttattacagttattactttttaatttttttttttttaagatgcaggatcttgctgtgttgtccaggctggtatcaaactcctgggctcaagtgatcctcctggatagctgggattatatgcatgtaccactgtgcctagcacagtcattactgtttaatgattaattgaaaacattgattaagcacaga

SEQ ID NO: 36183 - DNA, 1094 bp, Homo sapiens
cactaatcccaataaacttttttgggattttcattttgaagaacagcttttaaaacctactgcttaactcttaggaaatatttaatcttatttgaaactgtaacatgccctatactttgagatttgtggagagttaagctaggctttctcttttttttgcctttacaagggtaactttataacctccatttcttggcttttttctttttagtaatccctgtataattggaagaagttaggcaaattttgacattctcaaggtttaaagaaagtttagtacaatatttatttactaaccaaagtgtctcctgttctctttgtgcgaatatctgataagctgagtgattaacatactgttctactgggagtggataatggttgatatttaggtgactaaatagtccctgtaacccaaagtctggctcttccccagggaaatttaagtatacacacaatcgccatgtcttcataacattgtaacattttgtaagctatcaaaaatcagattggatttttgctaataagagcaagttgtattttgtgtgaaacttgagccattaaaatgacatttgcaggtttaatataatcatagctaacatctctcaagcactttttatgtatcagtgggcagtgtgatttagtgatttacatatactgtcagccctttctattcatgggttctgcatcagtggactctaccaaccatgggtcgaaaaaatacaataaaaagatacagtataacaactatgtacatagcattcacattgtattaggtattacaagtaatctagagatgatttacggcatacaggggggcatgcatagattttatgcagatactatgtcattttctatacgggacttgagcatcttgggcttcgttagctgccaggacagagaggtggagggtcttggaatcagtcccccacagatactgagggataactagtttgtaatacttattacaacctgtagtgtagactttatacttacatattagaaagatgaggcttagagggacggatttgtgcaaggccacacaagtagtatatggcaagagagaaagagaacctgatactagaaggtggatggtc

SEQ ID NO: 36184 - DNA, 1030 bp, Homo sapiens
gaattaggagcataatctttgagaaaagtcttggttgcttaccattcgggctttgtgatgagttgaaatgtcctgaatgagaactgttctcaaatgctttcaagaccaacaaaaagtacgatacccacactgacctggaactctttaaaccattaagatatatcactttttcgcagttcagtccatattttttgcaaaatgttctgcttagtttttctgctaagaaattactgtttctgaacaaggttaagtgtcgtatgctttcattgtagttttttttcccctaacatatactgttttcctaattagactataaattcctccacagctgggaccttgttttgttttctcgccttccccataacaaatatcatttaagtgaatgttgtaaacagttacttcatttaaattgcccttaaaatgctttatgacaaagacgttatttgtagtaatacctataatggtaaaaagtttgttgcagtcttacagacgataagattgatcaattgttatatatgcttagtggaattttatctagctgttctaaagagccattagactagtctttctaatggaaaatgtttattgtctaagttaaaacagcatttgaggccaggcacagtggctcactcctgttattgcagcactatgggaggctgaggtgggaggatcactagagcacaagagttggagactagcctaggcaatatagtgagacctcttctctacaaaaaatttaaaaattagctgagtgtgatggggtgtgcccgtagttccagctactcaggagactgaggtgggaggatcacttgggtccaagaggtagatgttgcagtaaaccaagatcatgccactgcactgcagcctgggcaacagagcaagatcctgtctcaaaaaattaaaaagcattttatagactgcatgtttgtgtcccccctccctccgcaccagaattcatatattgaagccttaatctccaatgacatgatattagtaggtggggcctttggggggtgattaaataataagg

SEQ ID NO: 36185 - DNA, 1035 bp, Homo sapiens
tccaagtgccaatcagccccagccctgcttagcttcccagatcagatgagaacaggcatattcagggtggtatggctatagaccttttagattatttttaattattccattttttctacctcataagcttgacagatgtcttttagtatctttttactgttcacctcaggtattaaaacatggaaccttggtttatcatctttaagataatttggtattatacttcttccaggacaatgtaaggacctgcgaacacatcaacttcatttactgccacacctcatgttatatacattgtatattcttaatatgtatttcctaaattctcaagacattttttatacaatatgaatttacatttcatattgtataaaacatttactttttctattgtgtttcgtggttcctggaatctgagcttccatctaagaccttatttcttcttgaaggacatactttaatatttcttcgaatatctactggtaacaattcattcagattttctgtcctgacactgtcttattttactttcattttctaagaacgtttttgctgaattagcagctattttatcattttgaagatatattttattccttctggcttccattatgtcctctaagacataatgtccattttgtttttttctcttcaaaggtaatctttttttggatggctacttttaagaggtttgtcttaagtttggtgtgcccacatgtgttttgtgtttgtttttttgtgtgtgtggtttttttctgcttcgagattgataatgtttcttgaatctggctgtgatgtccttaggctgtttgagaaaattcttagctctgtttgatcagacattgcttctgctttcactctcctttctcctcttcttttgatactccacttacatttgtatttgacaattcactttgtcccttgtattttccatttattttcttgtctgtttcatcctgaatatttcttcttaactttcagttcactattttctcttagtagtctcgaatttgttaaatctctcttgaagcattt

SEQ ID NO: 36186 - DNA, 1063 bp, Homo sapiens
ttccacatgtaatagaaaatgaataggataataaatgtggacatgtatatttaaaaagagggaatattggaggtacataggttcacagaaattctgaaacccacctgggcacagattggcagttgcttggtcaagtttcaaggcctagaattctcttagctctgccttctgggatcttggatctactcactgagtcaccctttctttttcttgtttacacttctgcctgctttctgcctatagaagcttggatgtcccacaagcttctttccatttggttctctctgtgcctttcagtccaggctggccatgtttctgctaatagacttctcttaaaaactttgtggctcacttgtgaattttgagttcactccatcagacaaaagcaacaaccacacatctcgtcccacataaactctgcctcaagcttttgctgatgaaaatacccttaaactttttaaaaacctgtgatgttattcagagattttctgagacacatcgtttgtctgatgaaaatactctgaggcacaacttaagatctttctgagctattaaaggactttataactacagcctcaactttatgttttactggcagtgccctagatttgctttttgctcagagatattccccaattttagcacatttgtcatctgcacaggctgggaatcttcaaatccagcaagttttgacttgtttttgtttgtttgtttgtaatagagtctgttttttgctgtgttggccaggtgatcttggactcctggcttcaagcattcctcccacctcagcctcccaaagttctgggattttaggtataagccaccatgcccagccatggctcctttttgtttaacagtccttactttgatggtctctcttctcacacattttactatcagcaacaagaaaaaatacacatgaaatatttaacacttggccggcaatctcctttgctagatcaatgagttaattaggcattttttctactttgtacatatctgtggataacaaatttgctaaactttctgccattatgtaacaaggatctccttccctctagtt

SEQ ID NO: 36187 - DNA, 1020 bp, Homo sapiens
tttagattataacatttgctctgagtattttacattacagcctttggggggaaaagtacaaatgagatctgagaacagtggtactcatctttgaggaattatggaaaacgtaatagaacactaaacatgggaaaacatcggccttcaggttgaaaagtggaaatctcaatccctgaattttttttttttttttactaagtaacttttttgcccattggtgtcatttaaccaaaagaagaagaaattccaaaaaaaaaaaaaatcaactgaaacaaaagaatagactgaatttgccaaaagagtgcttaaatggagacctaagtcttcaaagctaaggtgatgagaaaagaacaggtcttaaatttcttcagagcttcaagaggcaaagcttgaaagaagaaaaaattttattcttaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagccttcagtttgtggtagtttgttacagaaaccctgtaaagttaatacacagagttcaaagagaatccggtaatatctctaaaagactcgtgtattagtcaggattctccagagaagcaaagccaatagaatgatacatgttgttaaagcaaattaaaatggagaccatgcctgaagaatctctgtgcagagaaacccag

SEQ ID NO: 36188 - DNA, 1086 bp, Homo sapiens
tgataagccgaggtaacttctataataagcagcagtcctatatcttacgtatcacaaatataaagcttttaaaatgtaatgttaaaatgttcaacactttaagaaaggaaaagaaaaaaagaggccaggcatggtggctcatgtctgcaatcctagcactttgggaggccaaggtaagaggattgcttgaggccaggagttcaagaacaacttggccaacacagcgagattttgtctcttaaaaagaaagaaagcaagaaaaaaagagtccaggtagatgtgtagttgaaaatggcctaggctgttcatgtttaatgctgtgatgcttagctggcacataaagcatctattgaggtataggagaatgaaatggagctaagaattatttttgttattgttgtttgatgatattggatgttaaattgtgacatttaaaattattacagcagttaatagcctagccatcagtgactagcttgacttgattagagctttgattatgggggaaagaaagagactgaagtgaagccgatctgaattcaaattccagttaggaagatgttacagagttcaggaggggttatgcaatgcggaaataacgatgacaatagaaaagaaaaagagaggacagaaaagagaagggctgtagagggagaatattacaacaattgattgaattgtgaggagagaaagggaggacagaaaagaatcaaagataaattcaaggttacgtttccagtctgggcgcacagaagtagagatgtcagggtccagattagtaaagacaaggtaggtttactcataactggtctgaagggtgaggaaaaggacacctagatagaggtgaccaaatgacaggaaaatactatcccgctgaaggaggaataagagatctaaggtacaacctaaggaccaagttaataaaattgtattgtgttagggatttttgttaaataactagattttagctgttattgtcacaaaaagaagtaactatgtgagattatagatacgttaatctgcttcactgtaatagccattgcattatctatgtttctatagttatctatatgtgttccacaacat

SEQ ID NO: 36189 - DNA, 1050 bp, Homo sapiens
tccactttttttttttttttttttttttttgagatggagtctcgctctgtcgcccaggctggagagcagcggcatgatctctgctcactgcaacctccgcctcctggattcaagccattctcctgcctcagcttcccgagtagctgggactacaggcgtgcaccaccatgcccagctaatttttgtatttttagtagagacggtgctttatcatgttggccagcatggtcttgatctcttgaccgcatgatccacccgcctcagcctcccaaagtgctgggattacaggcgtgagccacggcacccagcgagtaatctacttttaaaaaaaactatacatgtatactgaatatacaagtgataagaaagaggaataaaatcggcctttattctgcttgctaaatgtctactattcaagttttaagaattacacacactggtagctattgtttctattcatttcagagcttctaattgctgctatggggtctcaatgagaaagaagggaagtggggaggaggcaatgaaaatgcatgagattttcaggaatgccaacaatgtgaagttggaatcctactctaactactttcattcattcttccaaaggtgacggtggtctgttgtgttcaaaaggagctggaagaggaaaagcagttttaagatagcccaagggacggcaacttaatgcctccctaaggagaaaccacatgggctgtgctggtggagaggataataatagcaataataaaaataaaaaagagtgtagaggtggggtggcaagggtggggaaggagtcctgataacttggaatgaggtgggaggaagaggtggaggtaacctttgcaggtgtttaaggaggatttgtaagggatgcaaaaataaggacaactgaagctgtgaggcgggatacaggaacatatccagtgagctcccaggaataatggagagcacacattgcatcatcaggatcactgagacccgaatcctctggggaagtcatgtcttttttgtactagatgttttgaagcttgagctggggcggggggtgag

SEQ ID NO: 36190 - DNA, 1055 bp, Homo sapiens
ggccaggattccacgcccaagtgcatttagtaggtcagtacagtaattttaaatgtctttctttcaatcttttgccatcttcaattatacctttccaccctactatttgtgtaattttcttctgtctgaagtctctttactgttgttctctattgcacagcatgacaaattacccatcaagccatatcttttcagcccagaaatgcgcaataacacggagtcatggcattatcgcatgttgtgcactttatttcctcacagttcattcaagtgtgtcactttattttcctggcttccttttgtcatcatggagattaaccattttatccttcctaaactttagaaacaattagaatttcattacagtggaagctgagagtgaatgcttgctcagtactatatagagtatacttttcatattatcagtggcaaaattaaagtcatgaatcctgagtctttttcaaaggagagactttagaggttattatacagctgagtaaccctggctctgggcaagagaattatttgaggttgtggtcaccaaacacattaaccataagaaaccatttagtctgacatcgagtacctgattcttatattctcctgggaattatgaaactctctgggacccatgtgttctgtacacaaaatctttttcttccctcttagcttcagctaaataccaatagtattcaatgagatacaatagatattgcaagtatgtgctagaaaatcaattggtattgatgctctaatcagcagggctgcagctggtatgtagacacaccactggaaatggtgattaagatcatattcaaaagcattaaaaaaaaacttcaaaacgtttagatcactgttcagatagattgctgttttgctgggatagtagatgatttgggaagccagtgatactactagatgctgctagattaatttataagatttttaaataacaatctattttatgtgttgaatttataatatattttaattatatacttatagtttataggacagttattgttggtaaacaaacaagcaaaaagttcaaagct

SEQ ID NO: 36191 - DNA, 1058 bp, Homo sapiens
aatcctgggttttcttttctttaaaacctctctcagtgattccaatgtgcagccaggtcccactcaaagaaagggggaaaaaagccttaataatgggctgactgaattgtccttctgtgggtagatttgctcatcaaatcacagtgcacaaatagggtaagcttgacattaattgtggagctgttgctatataggaagcactatggtagacagtagggaggataaaatccctgcttaacacagaaccaacaaacagccaggcgcggtggctcatgcctgtaatcccagcactttgggaggctgaggcaggcacatcacctaaggtcagaagttcaagaccagccttgccaacatggtgaaacccccatctttactaaaaatacaaaaattagccgggcttggtggcaggcaccagtaatcccagctactctggaggctgaggcaggagaattgcttgaacccgggaggcggaggttgcagtgagccgagatcgcaccaatgcactccagcctgggcgacagagcaagagtccatctcgggaaaaaacaaacaaacaacaaacgaaaaacataggtgaaactcctcccctttggaaaagatcaatttcccaaaagtggtattctatttctttgaaaattgacaagtgtggcaacatatatcacctgaaattttttttttttaatctgtgttttaacaggaggatctttccaagagcaatgtgggatgaagtggttgttgtggttgctgagggacttaaactggcttttttggtgaaaagggatgtagcaagtcagggaggcagagggagtaagttgcagtggaaagactggtattcaagacatgactatagtgagtcaggagaatagggtgcaaccatcttaaaagggctctgagtaaatagggagtttggatttaattcagttagccaagagggaagatgaggagagtagcagaatcaaaactgtgctttaggatgagtaatgtggatccataaattaaacaggaagaacaagggataccacaaagtttgcagttaatcagaagtgaggtgaaaaagg

SEQ ID NO: 36192 - DNA, 1083 bp, Homo sapiens
aaaaaattgttggtagtcataatagaaatacaaagatgtaattttaaagttaattttgtgtactattccctgatggttccacttgtggataagtgggactctcatggaatcaaagctttcctaactctgcatctctcttttgtcttctcttttagaattcctaataattgctagtattgactgtgatttgagttttaatttctctctttcttctcaatctgccagatatattaagaaacaagaattcctggcaacaggaagtaaataatgagagagaaaaaagataaagacacagataaaatgcaactaggataatctaacccaggatgacttgctattataataatagtattaaatggcctcatgtataaagtgaaacatagacattttgagataatactattaccttatttttccccttttatgttagaaggaaaacaaaataacattctaaaagttctccataaactaagtcacctcaaatattttagaaggaggtaagatagaccaccaggtactgtggctcatgcctgtaatcccagcactttgggaggctaaggtgggcagatctcttgagaccagcagtttgagaccagcatagccaacatggagaaaccctgtctctactaaaaaaattagccaggcttggtggtatgcacctgtagtcccagctacgcaggaagctcaagcaggagaatcacttgaacccaggagaaggaggttgctgtgagccgagatcgtggcactgcactccagcctgggtgacagagcgagactttctctcaaaaaagaaggtaggagataaattataaaaaataaagcattgtgcattagagctgataagcccaatattaatctgaaacccaattattaagtaacaaaatcaaagaaaatgctggtttagtggtgagacagtaaattccttctttcttgagttgactcatagtttcctaggtggtagccaggaggtggtggtaagatgggagtagaataaggtgatagataactgttcccttaaggctaagcagggaagtcagcagtctagtggtttccatacaaattaatgaaactcacttataccag

SEQ ID NO: 36193 - DNA, 1024 bp, Homo sapiens
ttctctgaaggagccactgtatggtatggtaatccttttgttaggataattaggatgatattttcctgtaatccatgtcatggaccagcaattcagtgtagctcatcttttggtgtaacactgtttttgcatagatgtacttgtgtaattatttggaggtaaaatagtacatttttcattcttcaagtaatgtttaactgaaagaaggcataatagaaagaagtgttttagatatgtcttacaagtgatcagtataattttgagaacatatgtgaaagaattgattttcatttatatttccaatctgcgattataaagcttttgttacggttatagttagaatcattagttttatttaactaatttcaacagtgttgatgagcaggaatgaaatgaagagagcttgttccttctctggcagactagtaagctaaggttggagagtgttctggaaaaagtgggacttgattgggactttgaaaaatggtggaagagagggagtggaaaaaggtagagaggactgggactagcttagattaaaggtgcagaagcatgaataatacaagtgttttgtcccagacacgtattagattaacctggctggaaatgttgaaagaagagaaagagatagctggaagtgcagaggtttgattgttttttaaattgatagataattcacatatgaaaaacaatcacctttcaaagtacacatttccatggcgtttaatatatatatatatttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccactgcgcccggctaattttttgtatttttagtagagacggggtttcaccgtgttagccaggatggtctcgatctcctgacctcgtgatccgcccgcctcggcctcccaaagtgctgggattacaggcgtgag

SEQ ID NO: 36194 - DNA, 1027 bp, Homo sapiens
atgaaactaatttttgggggggtctgagtcttacctgaatgtgttaggggaagttctgcctccgaaaaggaaatgaataatggtagtgttaatggtgcttttttaaaaaaactgaataatttaagaatatatgatgtaatttatatgtataagtcacctgacttaaaacgtgtaacattttccaaagattccagaagaaatggaagaatttaccgttatcctactgaatggcactggaggagctaaagtgggaaatagaacaactgcaactctgaggattagaagaaatgatgaccccatttattttgcaggtggtattgctgtcttatttgaatgagtttacatatttcttaaatagtatatataaatgtatatatgcacgtgcatatatacatttatatgcacgtgcgtatatacatttatatacatatatatttagcaatttttttcattgaacattttcaataaagcacaattgatgcttgtttaaagattttgtaattcattcgaggattgttatttaattgttcgaagttttgactaatacttcaaaaattttttgaagcaaaaagaaaataagtactgttttattatctttttccccctttcagatttctcggtatttttttttcttttgtgcagaaaacacttctccatgtgatttcttcaaataaacagtctagttggttcagggctagattatgtattagaaggacctgagtattatgcctaatggatggccatacactataataactaatttttaagggaaatattaattaaaatttcttcgttttgccactttaacgctttcttcagaactgtctttggccacctgaggcatcttttggttttgtttatgaaacggttgttgtgtaactctttcttgaatccttgttgtcagctatatatgggttaatttacctaatgcaggaattgcaggaatcttgtaagccttttgtattttattgatttgtattctttctttcttcttctttttttttttttttttgagatggaatattgc

SEQ ID NO: 36195 - DNA, 1033 bp, Homo sapiens
ttattttttttaagagatagagtcttggtgtgttgcccaggctggagtgcagtgacaccatcatagctgactgcagcctcgaagtcctgggctccagggacccttctgtctcagtctcctgaataactgggactacaggcatgtgccactgcactcggcatagtcactttttaaatatcctctatttgtaagactctctgtgggccttcaaagatggatagtatatgacccctgcctgcagcagtcttgtagtctggagaagaacttatataaaataaaattgtgctgctatcattaatgtatttataagcctctaagtaactggctttaatctctcttttaatagattttaatattaagtattttgtaggttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaagtaagtatcccttagtgtgttattattattattagctctcagaatcctgaaac

SEQ ID NO: 36196 - DNA, 1046 bp, Homo sapiens
tgattttagaatctctgctttttagcctcttgtctgatggatgcaaaccctgattttatatgctttcctggacagtgttgttcttttcactctacagagaattacactctccctaccctttccccatccaggcagctaccataagtgtcctagactaaggtagcacctctgaaatttaaaaggtaaagaacaaagtattaaaaacaaaaatcaaaaccaaaccaaaacactaatcaggagcaggattagttaatattttaagactagcccaggagcagggttagtaatattttaagactgaaaccaaaaagccaaccaggagcagagttagttaatattttaaggtattggtaacatactaagtttggtggatagaataaaaataaaaagggaagataagtttactttgatattaatctctcttgacttcaccaaactttttccccatctttcccatgtgtctctacttctgtttgtgtccatgtctctctgtgtctcttttgcacacctctgttttctctgtacctttccttgcacttctttcatttatttttcatttttttttgctctttctactccttccaactgtccccattttcctttcctcctgaaatagtgatattatagaatagagatgccaaatatgttttaactaattaaaataatagaaacaaaatagtaatctcagttgtttattattttatactgttctcagttgattaaatttctataaatcagtggctcttgttagccaaaagtgtccttattcagacgtgataagcattgtctctttattttcttaaacatcttttgagtaatgttgataatacctgtacattatgaattatataatttcaaagggactgtctttaaatcctatatcaaaaatatttttaatcatttatatgtattttaagatatgcttctatgttttttaagattcagaaggtttgactgcacaagttattattgatgccaatgatggggcccgaggtgtaattgaatggcaacaaagcaggtaaggccaaggctgcatgagagccctc

SEQ ID NO: 36197 - DNA, 1045 bp, Homo sapiens
ttcaagcaattctcctgcctcagcctcctgagtagctgggattacaggtggccaccaccatgctaattttttttgtatttttactgtattttatatttttagtgtattttaccatgttggccaggctggtctctcaatctcctggcctcaagtgatcagcccgcctcggcctcacatagtgctgggattacaggcgtgagccaatgcacccagccccctcttaatttttactttttaaacttaatgttgccaatttaaataaaaagatataaaccaaaatataaggagacaaaattcaatgtaaaatagcttattctttacattcacaactatattgtatttctttccaaacattctatagaaactcacagtgtatataaatataatacattctgcttttacctttttgaccagattcttcattttgctgatggagaaaggtataaaaatgtcaatatcatgattcttgatgatgacattccagaaggagatgaaaaatttcagctgattttaacaaatccttctcctggactagagctagggaaaaatacaataggtaattaataatttcttataaacagcttcctctccttcatgctgggttccttaatatgggggaagatgtaaaggaatgagaaagtcttggtggttttctgtgcttaaaatgagaatgattttaagttagagcatttcagaattcctgtgtctgtgtaacagtgcctctcacgtgtgtatgttggtgtatatatgcatgtatgtaaaagacaaagtaggttgatactacagataatattatttcctcagttattgtaggattatttaatttgtagatgtctttcctttggaatttgaattttgttctggtttcctacttagcaatagaaggaattacaaaggtagtaattctacctttgtagaattactttgtacctttgtacaaaggagtaaaggaactcctttagtgtcatctactctgtagtatttccgcatagtgttgaggtatactgatacttcagacagattatgggagacgtaattcttggtt

SEQ ID NO: 36198 - DNA, 1046 bp, Homo sapiens
taaaaggatccaagagagtaaacatatggtattgattacattcttgcaagtgctaaattcctagtcataaagggttttgtatttcaacatttccttcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggtgagaagataaagtatttgtagtgtatatataattattgaaatcatctagcattcatatggtatattttatatgaaaatgctcttgcaataattttttactaatccatagaatatttcttgatagataagtattaattgtcagctgtaaatggatttttgagaaatatttaagcattatacccctaatcttgtgttctgactactacctgaaagttatatgaaaacaaaattggaagtaggtaggtaaagttgaaagatacatgaatattttatacgcaggatgcaaacaagtaactttttatatgtatttacttgatgtgccatgaataatttatagtattagtaaataatgttcagaactttttataagactctttcagaatattcttggaaggaaaatttgctttctgctgctgagtagaactttcatgggtaaaattgcaacattcctaaaaaaattaaaaaaaattgtccttgttctttctttaacattatatcatggttaatgactaataatgtattcccgtcatgcagtaaatgcaaaaagacttttgaagtacttcctattaacttgtatttttattggactaaatggattctgaggaaatttgtttcttgatatttttattatagttttattatgtaattttgtcatttttttctgtaacttttgcattaag

SEQ ID NO: 36199 - DNA, 1047 bp, Homo sapiens
gattgtttccatctctctactttgccatcacaaaattgactttcatttggttgtttgaaagctgatgttattgttaaggttactatgttctgctcatgttcatttggggcagagagagatattttatgagattctcaaagtaaagaagacatttcccaaaagactctagaaaatggcttatgtctcattgtccagaactgggtaacaagcccactcactcattcattcattaattcatgcagcagttatttaacaaatgcctgttaggtaccagatactgtttcagatgctacagtcatgttagaaaataagacggtaaaattctttattttcatggtccttaaattctagagagggcaaggggagaaaggcagtaaacacagacataagaaaatatgtactatatctgatggtgatgagtgtactatgaagaaatgttaggcaaggaaggcagatggagaatgcaagggagggagtggaggttgtatgtggggaaatctaaaataggatgatcagtaagggctgtttggaggaaatgacagaatgacaaagactggtgggggatgagggtgtgagctatgtaatatctggggtaggaacatttaaagcagaaggacccatcagcaagagcaaaggccctgcagtgtagccctgcccatctggagcaacaaggaggccactgtggctgatgtctgcatgtgataggggatgaggttcaacaggtgcagggccagggctctgtgtcagggatccccatgaccacccacagtttcgatgagtcactaagaagactcgcaggacctagcatttagtcatatccatggctatgatttattacggcaaagaatacaaaataaaatcattgaagggaaaaagctcatggggtgtaaagtccagaggaagccagggcaagcttctaagattccccctcccacccccatccattgacacaggacacacttaattccccagcattgagttgtcacaagatgtataaaatgttgccaaccagggaagcatactagggactcagtgcccaggatttta

SEQ ID NO: 36200 - DNA, 1028 bp, Homo sapiens
tccccatatactcagcaacttttccggccccatatgtcaccattcccttcatttaatcacttataggttgtcagtaattcacatagatcacttttaattaataaaccaattgctgaaatgcccattgtctactgtcctgtggatggaaggctagactgacagcttgcctgcaagggctggacttcctgatgctccaaaattgaaatataacaaataaggatttggctattgaatttcaatttcataagaaaatgggacctgtaagagggagagaacaaactttcactgtagcccaatgagctcgtccttggaaaaaaaatgggcagctgtgtttgtaaggagtgttggattggcaaaagagtaactgtgaatatctctcaagcagcagaaaattacacatgaatatgtaatttattttttataaaatgtctcttagcttataagtttagattacaagttcagcatttagtattcaaatcttcaattgatgaaacttcacaataacgtttttcatcaaacttctggacttgggcactggacagtgtgtttataatctacttttactgttagagaaaatgaagacctacactagtattcataaataatttttgttcattttattgtaactgcggtcataaactctagtgttttaaacctagtgttaagcacacttgttctgggaaataatatcgttacagctacaaattttcaatttgtcttagagtctaaagggaagatttaggttacccaattcctactgtattgttgaatatgtaaagcatgcgtgcttgagctttaattcattagatgtccatggctattttgattgttgatgataatagtagctgcatgatgctcagccctttgtgacttttttccttgcttatatcctgtctttcctatcacaaaagtttcttggtaacatgaagtttatcttttaaccttaataagatatacaatattgtgcacacaataaacattctgttagcattattcggtgacacagattagattcacagctgaggtac

SEQ ID NO: 36201 - DNA, 1046 bp, Homo sapiens
aaaaggtaagtagtacaattagctaatctacagcccatctcagactactggtaacagttactcttatcatttaatattctaaatctcaattttctaattttgccttttatataattcgccaactttcaacctttcaactctaggtagggtataaataccagaatagaatttgggaattgaaggaaggactaaaatggtttatcggcattttttagcatgaggaattaaagtcatattttaaagccttggaagttgaagctttgtttgatgggaataatattaatctaaaaaaagacttcttttgcagaagtatcattacagaagtaaactaccatctatattaaggatagaggaattgattatgattggtttctgtagaaattgaaatacttttctttcttttttatttttctttctttctttttctttctttccctttttctttctttccaaagtcttgctgtgtcacccaggacagagtgcagtggcacaatcatagctcactgcaactttgaatgcctggactaaagggatcctctcacctcatacttctaaatagctatgactgcaggcatgtgccatcatgtctggctaattttttaaaattagtttttagtagagacaaggtctcactcactatgttgcccaggttggtattgagagatatttcttttgaatcttgatgatttagtttgaaatttaattagtgtcatgacactcactatttctttgaataaatcatcttaacctaacactgtaaatctcaaggccgcctgcttacttacctatctctgagtgcactaggtctattactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactt

SEQ ID NO: 36202 - DNA, 1048 bp, Homo sapiens
agcagacttaaacttccctgcctgacggctctgaagagagcagtggatctcccagcacagcgttcaagctctactaagggtcagactgcctcctcaagtggatccctgacccccgtgtatcctgactgggagacacctcccagtacaggctgacagacaactcatacaggagagctctggctggcatctggcaggtgccccgctgggtcgaagcttccagaggaaagaacaggcagcaatctttgctgttctgcagcctctgctggtgatatccaggcaaacagggtctggagtggacctccagcaaactccagcagacctgcagcagagggacctgactgttagaaggaaaactaacagaaaggagcagcacatccactcagagacctcatccaaaggtcaccaacatcaaagaccaaaggtaggtaaatccacaaagagggggagaaaccagagcaaaaatgctgaaaattccaaaaaccagaacgctgcttctcctccaatggatcacaacttcttgctagcaagggaacaaaactggacagagaatgagtttgatgattgacagaagtaagcttcagaaggtggataataataaactcctccgagctaagggagcatattctaacccaatgcaaggaagctaggaaccttgaaaaaaggttagatgaattgctaactagaataaccagtttagagaagaacataaatgacctgatggagctgaaaaacacagcacaagaacttcgtgaagcatacacaaatatcaatagctgaatcagtcaagcagaagaaatgatatgatagattgaagatcagcttaatgaagtaaagcaagaagacgagattagagaaaaaaaaaataaaaaggaatgaacaaagcctccaagaaatatgggactatgtgaaaagactacgtttgattggtgtacctgaaagtgacagggagaatggaaccaagttggaaaacattcttcaggatattatccaggagagcttccccaacctagcaagactggccaacattcaaatccaggaaatacagagt

SEQ ID NO: 36203 - DNA, 1053 bp, Homo sapiens
atactatctcacaccagttagaatggcgatcattaaaaagtcagaaaacaacagatgctggagaggatgtggagaaataggaatgcttttacactgttggtgggagtgtacattagttcaaccattgtggaagacagtgtgacgattcctcaaggatctaggactagaaataccatttgacccagcaatcccattattgggcatataccgaaaggattataaatcattctactgtaaatacacatgcacacatatgtttattgtggaactattcacaatagcaaaggcttggcaccaacccaaatgtccatcagtgatagactagataaagaaaatgtgacacatacaccatggaatgctatacagccataaaaatggatgagttcatgtcctttgcagggtcatggatgaagctggaaactgtcattctcagcaaactaacacaagaacagaaaaccaggcaccacgtgttctcactcataagtggtagttgaacaatgagaactcatggacacagggaggggaacatcacacacttggggcctgtcggggtgggcactaggggaggggtagcattaggagaaatacctaatataggtgacgggttgatgggtgcagcaaaccaccatggcatatgtatacctatgtaacaaaactgcatattctgcacatgcaccctagaacttaaaatataataataataaaaataaagaacgaatgataggcagtatagaaaatggtattggtgatgcagtcttggattacggaaatggaagagcgtattgagaacatgatcaactcctaaaaactttcaaattcatttttaaattaatctaacctcttttcttctgtaggtgaaccagcttttcctcaaatctgctctaactcatgttccattttagcatttaattaccgctccctggggatctgccacatcatacaaatctgtgtgtaccggatgggcctgtgagcagaggagctaggcgggaaggcacaagtgacctggtgctttaagctgacacctggctattcactcttaggaaaataaagata

SEQ ID NO: 36204 - DNA, 1036 bp, Homo sapiens
tttaagttgaatttattaaactatttgactcaatttaggtatgctcaatggcatggtgaaaatattattacattcatgactgagtgaccattcaacattcaattgtgaaattaaaccaaaaaactgagccagacccgcatctcaggtcaagaccattattcatccagcagttcgaccacttccatctcatctatcatatgtacaatattaagattgcgcaatgagaaataccaagcaagatgcatacatgcacacaaagcgtgtaaataataacctaaagcactaacctcatagtaagaaccaagtatatacagagaaaaaaatctcttcctctgtagtactgcataggctgagaataagggaccccagtttgcaaagtctctgtggaggaaatggaatctgacctggttgttgaagaatgtataagatttgaagacttggaatgtgacacattctaggcaaggaaaagaacaagaacaaagacatctaagttatagtgatcctggctgctttcacttgagtaaggcttgcagatcccacagagaaataggtaagttttgactgcaggtgaggcagcttcccattgtctgagaaccatgaggagttacagagtcaccaatggagttagtccaaaaagtcacaatatgaaaggagtatttttaaggattgatctggcaatgaaggattaaaggaaaaatggactaaagaaggtaagagactctaattagggagagtagagaggttgggtggactgcttttaccatcatccgattaggatgggttctgagcttagacagtggtaatggcaatgagaattcaaaggaaggaataaggactaataaaaatatcttattttgccttattaaatttctgcacttttcttgtctgtctttaaatcaataaaaaagccacattgcaaattttatttactaaacattaatgtaatatttattacatattacaggaggtagagattatgaggtaggtactaatattattctcattttacagattaggaaattgtgacataaagagt

SEQ ID NO: 36205 - DNA, 1083 bp, Homo sapiens
cagggcagcctttcctataggctagttgtgtgcagtctagaactgcctttctggcagagccctattcagataccatctttcgggaacatacactctgtgttctgccaggatgggggaggagcttggtttcaggcactatgttttggttgtaagggcgaatgttattgccaaactgaaacatgtcaaatatcaacaaccaagtgggttttgtggtcacatttcatctgtagatgatggcatgtgcaagtgattttatggggtttgatgtggaaactatgagaaattccacaactccagagtgcacctctaagccccaaccccccgtttattctcgctcttctgcaagacagagatcaaggttgaatgaaaatcttgagtacaaattctcaatttttgcatttttaaaaacttttaaagtatagatttctttacaaaaaatgctcagagaaaaaaattaaaaagccaggcatggtggtgcacgctgtagtcccagctgctctggaggttgagaaaggagaattgcttgagcccaggagttggaggctgcagtgagctgtgatcacgccactgcactccagcctgggcaataaagaccttgtctcttaaaaaaagaaaggaaaaaaaaaaaccttagttaaccatatttgggaattaaatgcttttctactgtctgttttttgggtttatcccatttgtgatcccttctgtcaattgtcaccattatcttgctcacctaagccacctttcttcttttatggactccaaactcttccctgtggtcttaacctgacccctttctccatagtctgttctctcagcagcaggagtggtccttttaaagactaaattgactctaatcattttccctaaaactttttggtgtcttcctattgcacataacagagggactctgacctccatctccctcaggatcagtctctgcccattctctgatctcatcttctaccacctccccgttcacccagcacagccacagtgggcacagttctttaaatatgcccagcttcttcttgtcctacatcctgtgttctagttaatacctaagcctggaaagttctgccc

SEQ ID NO: 36206 - DNA, 1068 bp, Homo sapiens
ccgtatgtcaggatatgtaaataatttcaaatttctcacccttagtagtctcccacccatataaataagcttacagtgaatagtggccagattttagcagtgagttttcctatgtagtccattcctaatcaaagactgcattacaggattcatggttctgtctggtatacttagtattgtaacatcctctgctttcactctttggggaagcttaacctctgtctgctcaatgatgtattcttttcttcatacctggataatgttttggagtacattttaataaaaccagatcatgagggtaaacaccaatgtgagaagcttcattgtgcatctcatctttagttgataattgatggaatattttgtatttcatggatcctacctcagtacatggccaagaaactgctggactccacctgtgcaatttttgaaaagaaattgaatgatgcgttccaggaagggtttgcatttgctcattatttctggcttaatcaaattaaaggagaagaatgaaaaacagctaactccagagcacctgtaaccagtgttgccggaaattatgaccctgttagcttgacattgtgtggtgaaggggtctaattattggactgttaataatattatttaagccctcattaaatgtgctaccatttaataggattttctgatcacaaatcttcattagagtcttagaaagtttttttttaatcttgtatttttccataaattcatcccattgaataactcaagggaggtgaactttggccagtgggtcacagcaaaggataaagattgggtgatgtatatcagggatgggcggaatttgtaatagtttccagctgtctcagcagtattaatgaaagtattagaaaataaatatggaaaaatgattagagattcgaaagaagagacatcaagtatgcaatgtgggactttaaaaaaaaaatacaagatcttgctctattggtcaggctggagtgcagtggtatgatcatagattattgcagcctcaaattcctgggcagtcaagcgatcctcctgcctcagcttcctgagtagttgggacta

SEQ ID NO: 36207 - DNA, 1037 bp, Homo sapiens
tagaaaataaataccttttctttttctaaaggaactagggcatatggattaaggtaaaggaagatgagaaacaacatccaaaaatacacattttttaaaaaatagtcaactaataagttcatgttttataaaaatataagtaataaattatttttaacatgaacgtaattgtgatttcaaaatttcaaaattatagcaatgtccttaaaatagtgttgaatttaaaatcttcactttacaaaatgtctgtgaccatattatctattatgctgttagtaactagagatttttaagtaaagatagcttttttgggtagtaatattttcatcaaaattgcagtgcagtaagaaaaaaaattcagtctctaccttgaaagtttagggttggaacataatcttagtgagtatatctataaaactgttagcctcaattatctctgaattgattttgtttgttcaaagacacaactgtgaagaatcattattctttctactgtgttttcagatgaaccctgacagatctttcatgacagataatactaaaaattacatgttcatctgtgggaaccagaaggaaggtcatatcttgcttctacctcctagaatagctccatggtatttcaggccatcgaagaggatttttatgctggagaggcagcaaatatgtattgatccttaaataacaatctaatttcttctttcttcctattactttagtaggtataaaatccagtagtgaggtatgccgaaaatggggtggtctttagactcctggttagtactttgaacattttcattttaaataatgattctcttgcaaactggtcattcctgtgatacatatttccctttcacagcttctgaatataacttggagtgatactggtacaatgctgcctttctctcccaccttccaaatgtatttgcatatgtgcagactattcctccttctaactgctacttctctgttttttgcttcttcggcctttcaccttctcacacccccatttcctaactccccaaggccatcattctcac

SEQ ID NO: 36208 - DNA, 1049 bp, Homo sapiens
ctgaaaatctaatcttttatgaaaattacttcttagatgctttcagaaatgttgcttcttaccaatgtgatacataaaactaatctcgtttgacagtggtgatgacaagttttttaaatcagttttcctatgtattcctgttacagttttggttgtttatttgaaccttgaaacaccagagcaaaaggaggatgatgttaacctagtatgatatggttattgtattagctaagtagtagctatgtcttatttaatattaaaaaacagcgagtaattcgtgtgttttctgtccgttctacaaataaacctggtaatggagttttttcagagaaccataacatctgaaacacattcgatgggtttaccaaagaaagtaattatggctgtaaaatctgtgtgactatttttaagtgaagttcttcaggaaaagggggtagacagcataatgagaattctatttttaacttaggtcacttttttcatggactgacaatgctgtgactttttcagacagacaatgagccatctagcttttgaactctttcgtattctgtaaacattaggaagcaccagtgtgtctcctaatgtaaacacactgatccagacctcatgaggtatattcatgatcatttactttgtttattcaaaggtcattaaaagatgtgatttagatttgttttcttaatatttctgtggaaactaaaaagctaatctacaatgttgttttacatacaggtttacctgaaaggaaaataaagtttattttagcttttggcaatttttattgatataaaacatataaagtgagtcacacaaaagttgaccttgaaacttctcatttttcatgttagtggttttaatactattgcatttgaaatttttaacttttaataaaattgggttaaattgtatccctccttttctttatatatttattccgcctctgttatcttatctttctgcatctttagaagattataagcttttggaatcagaaacaatgtcatagacttttcttttttttgtcttcccaggaagttgattaaagt

SEQ ID NO: 36209 - DNA, 1069 bp, Homo sapiens
gtctgtgtataaaatatttattgcagctttattaacactagcatgaaatagtaaacaactcaggtgtccatcagaagtagaatggatacattttcctgtattcattcaatggaatactatacgacaataaaaaaagtgaaatattgctacatgcaacagtatgggttaatctcacagatacttgttaagagaaaccgggcaggaaatagcacatactacatggttccatttatatgaagttcatgaataggcaaaattaatgatgatgatgcaagtatacatgaatactttaggtttcagggtaatgagagagccttgcaaggtgttagaaaagttctataccatgatctggtttgtgggtctatactttatatgggtctgtgtgtaaactttaactataatttaaggtgagtgcaccctactgtgtgtatgttaaacttccatctaaaaaatttttaaggtgatgataaagggaaatcccaggtagaaattgttttaacaacttttctgttatgaccttataaaactattcgatcttgcaaatcatgtagtacatgtattcctcttgatgactataaaattaaaaatgaatggggaattagtaagaaacattatagatatagatgttagaggtaataaatggaagagcaagttccagaataagttactgaaaggacaggtggtgggaaaaatagaaagaggacatcaccttcccactacagggaaattctctaggggctttttgcataacagagtgcccttgcacataatggctagatttggttagagtctaatgcaagtattctgaaatgcttttgaatgataagccagaaagaagcaaaaaaaataaaattatagaatgttagagctgtaagacaaggtatattacatttcatccagcccaaccctcttattttaaaatggactgtgtgcattgactctttggaagtgactcagtacagtacagagtgctctgatgtggtgtttctttgacaaggaaggatgcctttactgaagttttgttaatcatttccagaataatgcatgttaaacatgaactttgtacaat

SEQ ID NO: 36210 - DNA, 1035 bp, Homo sapiens
ttttaactgacctactcagataatgaagactcttaacaattcataaatgtcttgatatttcttctctaacagtcacacaaaataaaaacagctcttgaagaaaaacaattcaaagtttaaaacatataaaaatttaggtatttaatgtaatttgaagtaaaagtttgaattgaaaataattataaaactaatatgtgccatttctttgtaataattgttataattttcttgcataattcttaaaggggaaatggtgcaaagaacagcataatagtatggtaatggttgtagaaaatttatttcatttttcattccttaaaaatctagataaaagataggaactgttttctttaaaaacctgtaggcatgtgttttatttttaaatgttaatcaaatttatgctatactcctttattttaactatgccaatggactgatcaaataattaccaatagtgattaaaaaggactttctatatttaaacaaatattaaggtaactaaggggtaactcagctaacgtggctttttaatgataacaaaatatattagatatccacatgtcatgtaaaaccttgtgtaaaatattgggctgcttttcccagccttgctttttttttttttttttaacatcctatttataaagattaaaaagcctgtgggtgagagtgggggatgaaatttagtatcccttaaagcactttgctaatgctttgatttgtatatatgtgctcactaaatgttggatctgtatgggttagcatattttctattatacgttagaaaatactaattcacttttttaaatagctgaatgagatatgaaaagacagaactggtgagttagtagctgctgctttttaggcatgccatactatcaaaccaagatagaacattttaagtaaaaacatttgaacaaaatcctaaagacatataaaggaagtcactttatgaaaaatataactgcctttcaacatctttaccttttctcgtacttgctcaaattatgactatgatgcattatctataaacataaa

SEQ ID NO: 36211 - DNA, 1113 bp, Homo sapiens
gtataatgaaagaaagtaggaaagtatcattaatgggaaaagaatagccaatgtaagaaaaagggaagcttaaatctaaaatgaagtgaggcttgctaaaaaatgatgaaatggtaactgtaggaaaagagaggccatttaaagtatacattcagattaaacatgcactcaacactggagaaaatgtcgactataaggagatgttacagtattagaaaaaggaaagaagcttaagtcctattttgcttcaatcttctctgtcaaatagaatatttggggatgggggaaggctacctgtaaaagacttccaactatcagataagtgaactgatgaaaaagcatctaggtgttctaagtaacattgtgttttcttcctgcatgaatgataatattcaaatatgagagaacctgatgaactgactttgaggaatgtagcatgcaggacagtttcgtaatggaaaacaaatgaaaagcaaatatttttataaatctaatttataaatctcaaccatcttatgaatcctcaaaatctaatttatcggctttataaattagattctgaatcctcccggtcctaaaaaaaaaaaaatttcgtaaaatatcttattcatctgatttttggggaacgcttagggaaagaaagtggtgataaactagaagattatgtatactattagaccaacttcctttgcaaggtgtataccaacataggagaatgctatagacattgtaatctttcactttgactcctgactttcttaaggatgaaatggtgaaatatagactggatatagttgagttgttttgtgattgctttaataaatgtacctaagtattgatttaatcatttgttgtgaattctaaagctaaagagaaatgctggaaaacactggggcttcagggggagaatggccatgatggttaggaggatgtcatatgccatcatggagagggtcacagatagaagcgagggggagggctcaagtgtgagaagtcctaggggagagagcatggctttcttcaaatgaataactgacatagccaaaaaggaggcctggagaatcgactgggagaggcaagcattgaatggaagttaactgaatgaactctgaa

SEQ ID NO: 36212 - DNA, 1060 bp, Homo sapiens
catgttgattgctagaatagggagtacgcagaggagtactatgcagagtcacctatcaggaatacaattattagctaagactaaataatagtaggtaagaagtaggtgaagtggaatgttaagatggtcatttaaaaaggtttgcaagaaaaatctaatatgtaagcatttgaggaaaacaaaagaatttgaattcatcagagtattcctcatagcacaattgattatcaaattttatagtaaaatttttatttggaaaatttgtaatgtcaaaaatataaagtaaattatacatagtttattgtttgaaccaatatcataacactggaaatcttatatttatttatttattcattcattcagaaacattaatctatccagactatgttcatgtatgtatttgtagactggttattctatgccctcaatatatattataataaaaatcagaacaagaacaataatattgattaagtgtttattatgtggaattgtacttatttcattaaatctttgcgacaacctgaatggtagggacttttattcctgccattttacacatggagaaacaaagtcttagagacttttaggcaaggtcacatacccaataacatatgagcagggattctataatcagtttcttcatcatgcactgcaacgctgaaagaagagtaccttttgtattatattggaaacctcagttttgccttttactaaaaccatttactcaaatactacactgaaaataattgaataactgtacaataaatagcaactcaagagacacaaataatcacttcatagttaaatgctaaactgatgatactgacaataattccctatcacttactctgggtatcattgggaaagttactcagtttctgtaagcctcaggttccctcttcaaaaagtgagaataataatagaacccaccttaggactaggactgttgagaggactgagtagtataaataatacatgtgaagcatggccatgtgtgcaaagcaggaacagtgctcagaaaatattagctactcttattgtcagggtggtggttgct

SEQ ID NO: 36213 - DNA, 1047 bp, Homo sapiens
gcgttttaccaactgcctggatgggaggaggaaaaagtgatgtgtgaagagagatgggggaagggagaaaccggttgggcaagcggccgattgttgagcataatctaacgaatttccaaagaaaacgtaataaaaccggacaagaaatattgttcatagacaagagcatactttgcttggattttttttttttaaaccagtactttgtaggcaggttggaaatgaactcagtcgaggtcaaaggaaccttaatcctttgaagagcgaggtagagaagcaagtacaatgtaatcaataggctttgctgtctcctcaacttctttctcctacattgcttaattagcaccgaaaaacaaccaagttgtttccaggatgacacgggtgggggctgggggaagcttgatcacttcctcgaaggaagaaaaagtccttttaagacaccacctacggctagatttgcagagtaagacatgattacaactcctgtgtccagaggaataagaatagagttcggcctaaaaaagtactaccttataaaaggcatatgacatagtggtttagctgacatattgtttgcaacagaatcggaaaatctttgttagaaattagtgaagcgcataaaattgtttttaaaaagcatgatttggtatataaatagggatttaactgtgtgaagctttaattttcggccgagagccttggaccatttaacgtagtaattctcatgatacatcttaaatataggtacatttctctttttattgtgaatgtttggtaaaaaatagcagtgctttcgtcacatcacactgggattcagagcataacagcataaactcatctagattactggcaatcaacagaactgccttacaagagaaatgtagaaagaaaaaatatgaatctggtgctctctctatatatatatgtatgaccaaaaataccttggaagatttttggctgtccgtgtctaaacgttttagattcttttgcgtagtgtatatggataggttgagcctatgagtcacaataaactaaacttattggtct

SEQ ID NO: 36214 - DNA, 1034 bp, Homo sapiens
tacttgggaggctgaggtgggaggatcccttgaacctgggagatggagggtgcagtgagccgagatcgcaccacggcactccagcctgggcaacggaatgagaaaaaaaaaagaaaaaggaaaagaaaaaaaagaagcctgaattctatgtgtgttgctggctattggggtgtgtcttttccaaggccctcttagtaaacagacacatactgacattggttactatctccatatataaacaactactagttgatacctattccttcaactactatccaacatcaccagatccattctaattttctccctttccatatttttaacactcttctctcacagtcgaagtcctggctcatgttattcttaatgtacttacatatttcatcaacatccctgtaggtaacaagtctcacactgttgcctcctcctacataaatacctttctcactttgatactttatgtcaggcacttgggttttgtgcttggcaactccctcctccacactctaatctgtagcagaagttctcttcactcctcataacctctaatacctcaggcttcttggtgcacttttaatttgcattctttttgttatctatgaggttgagcaatttttaatgaagagtgccagtataaatcctttctccatttcctacacaaaatctttagtaaaatcaacattgcccaaaaatatttttgtgtgagtgaattatttaatagttcttgaatgaaagctgagttttatgtttagctgcacagagtgaatatattatttaagctatttattcatttaacaaatatttattgaattcattgtatgttccagccacttcctaggcactgaggatcaagtggtaaaaaacagacacaaattgccttccctcatgaaatttatatttttaatggtacagttgaataatgaacaggctaacctgtaagcttagaatgtaatttcaggtagtggagaagctacaaagagactaaagcacagagacagtgtgagcagttgcaggtgctggagtagcagagaagt

SEQ ID NO: 36215 - DNA, 1040 bp, Homo sapiens
caaagaatgtatagccatctttaatctaccacagacatacttttcaatgttttccaggtattattacattgctaagaaatccttgagcctcttacagggaactagattaatttgtgtcatgtcagcaaacaaaacagcaaattcttttggagattcatccatagatggttgagggcaggcctcctcccatggacctatgaattagcagttatggaagggaaggaaggatactcatggaattagagaacagttttaagagcatgaactgttagtcaccctgcctaagtccctatctggctcttccattttctctgtgtgaccaggagcaaatgaatgacttttaaaatttttagcctcagtttactcttgtctacagataataatagtaacaataaaaataataaagcccttataggattgcctgaacatttcagttaatatacacaaagcagtgtttttaatattcagctgagactcacagtaagaaacatattttacaatatatatgcgtgctaaatgaaacagaagtatcacaaaataacccttatgcttgctaagtatgatagtgatatactctgatattttctaatatattctattttaaaaatgtatgttggtaagacccatactaccttgttttcccaactgaccaataggtcataattgcagtttgttagaaatttatgtaaatgagtttttcaatgttgattacgtggatccattgcatctttatgtaaggccattcataaataagtgatgctggggctgagtctaaagattagtaaacacgcctttatggccatagctttcagtcagcttggacctcaattttaaaacaattatttatcattttgtgactttaaaaattctatcagtattctacttttacttctaatatttaaaaagactcagctaaaaagactttaaacaactttattttggaagaaaaacgtatctcctttccataaatggaaaagcaacacatgccataattgtaaaatacctgctaaatatctaatgagacaattattaaattctca

SEQ ID NO: 36216 - DNA, 1042 bp, Homo sapiens
cttccagatattagagaaaaaagtaatgaaatttaattgttcagattgaaggagaatggaaaagtaaatgaaaactgtattgatgttttaaaatttaagtagaaaaagggttatgttaactcagtgatttaattctattatctggctctagatgatttttaaaattgtgaatgattggtgaatgagcgaatacatttattataaacttgatgctaacaatgtgacagtggtataaataataaatgcagaataagatttccatagtggaaaatcactgttttggcacagacagaacttctttccatattacttgcccagggttagagaaacattactattaaaaacgattttaaaattcttttaccaagttatgatgttaagtcatattggtgatgaggtagcttctctctgtagcaaccatctggttttgggttgtgatagttcaatagggtaaaggtatcattgcaaaactcctgtactcagtcactctccacctccacgttagctgtgtgccatagtgcatgcaggtacaaactccgaactgcatttcaaattttccatatcctgttttctcttgcccttaattttccttgtaggttctggtggatgtgttgccaaagtttgttcatacattagcatctgttctttgaccttcctcatctgtgaaatagtgttgttacatacctacattggatagatgtaatggagaattttattttgcaaggcattttcaaatatttttttctcatggagtcgaaaagtagaatattaactcatttattaggagactatcatgggagaaatgtggctgtacaaaataatatgtgtattactaaggtgtttttggctgcagaactgacactgtctctagtgagtttaggccaaaaaagggaatgaattagaagtatgctccacaggtttaaaagcagagggagagttgaaaattcaaggccttgggaaggtcaacaaacagggtcctaagggatctgtacggtgatcagtcatggaaagtctctgtagggcactagccttcaaatgcctc

SEQ ID NO: 36217 - DNA, 1022 bp, Homo sapiens
atgctatggcacaggaagggttaaggaacccatccaaggtcacaagctggtaagtggcagtcaagacccaggcagcttgatgccagatgcaagattttaaccactatctataccagcttataaatcagctgaattggtttttgttgcttgcaattgtgagtgataggattaaatgatagtgttgaatgagaagatcagtaagcaaaaagtgatagtgttgaatgagaagatcagtaagcaaaaagactcaaaaagtaagcaaaaaaggattagtaagcaaaaagactcaaggtccacactcacggagagtatgattgagttgaggagacagatattattcaaataattttatcagtgaatataattacaaatgtaggtaagtgaaggaaaggatcataatctttagtgttcatcagaaaggaacctgacctggactaggggttattgaaagcttttctgagaaagtgatactttgacagtgatgtgaatgaatgaactaggtcaagagtgtttgtagacctatggcacatgcaactggagtcttccgggggaatccatgggtgccaggaccctgagacaggaggcaagatgcccactctaattgatgtgtggatgatgaggaggggccccactgctagctgaagtagatgaagctagggagttaagcaggtgaccaactcatgcagggccttgaaaggacacatcaagtactcatgaggctttcctctctctggctctactcacctacacaaggcaagaaaataaaacagaggacagtgtgcatagtccttggttttgttttctcatgggccaggactcataatgggaagggaataagtgcaggatcttctgtatagatgattcctggaaggtattcctagactacatgctatacctcaagaggtttcagggaatgtaacgggatccatgtgatatgcaccagagcactatggggtgtgaagttgtttaagaatttccacacttcgcatctgtaagctgcaaggagtgcaataccttgtatt

SEQ ID NO: 36218 - DNA, 1047 bp, Homo sapiens
cgtggatgggaagaatcaataaaattaaaatgtctatacttcccaaagcagtttacagattcagtgctattcctatcagactactgacaacattcttcacaaaactaggaaaaactattttaaaattcatatggaaccaaaaaacagcctgaatagccaaggcaatcctaagcaaaatgaacaaagctggaggcatcacattacccaacttgaaaattacaaggttacagtaaccaaaacagcatggtactggtacaaaaacaggtacatagaccaatgggacagaatagagagcccagaaataaggcctcacatctacaaccatctgatctttgacaaagctgacaaaaataaacaatagggaaaagactctctattcaataaatggtgctgggataactggctagccaactgcagaagattgaagctggaccctttccttacaccatatacaaatatcaactcaagatggattaaagacataaatataaaacccaaaactataaaaaccctggaagacaacctacgcagtaccatcctggacacaggaatgagcaaagatttcgtgacaaagacaccaaaagcaatagcaacaaaagcaaatattgacaattgggatctaattaaacttaagagcttctgcacagcaaaacaaactaacaacagagtaaacagacaacctacagaatcggagatattctgcaggttgcaattatgcatctgacaaaggtctaatattcaaaatctataaggaacttaaatttacaagagaaaaacaactccattaaaaagtggtcagagttggctgggcgcggtggctcatgcctgtaatcccagcactttgggaggccgaggtgggcggatcacgaggtcaggagattgagaccatcctggctaacacggtgaaacccagtctctactaaaaatacaaaaaatcagatgggcatagtggtgggtgcctgtagtcccagctactcgggaggctgaggcaggagaatggcttgaacccgggaggcagagcttgcagtgagctgagattgcaccact

SEQ ID NO: 36219 - DNA, 1066 bp, Homo sapiens
tttttcaaatgaccaatgcatgatgttaagagatcatgtatggataaaatatccattcaaagtgcagaatagctggatagtcccagctacttgggaggcttgagcccaggagtttgagaccagcctgggcaacacggcgagaacccatctcaaaacaaacaaacaaacagtacagaatagaccaatggatctttctgaaacagagtagacgaggtttattaacatggtttgaaaatcacctttaagaaactagtacttgttaagttttggtataatatcaaagaagaatatacaaaattatctgaaaaattaattgaaacactcattcctttttcgattacattgttgtgtaaggttggattttcttaatatactttaaccaaaacatcatatagccataaatttaatgcagaagatttgaaactccaactgtcttttatgaggccagatattcatgaaatttgcaaaggtgtaaagcagtgctactcttctatcaagtatttttttggcttgaaaatatgcttatttaaaaaatatgttatttatcttattttgtaatgggtcattattactttaaaatgaattaacagacatttaaaaacattcttactaaatagactgagatacagtaaatatttatacatataaccctgttaaagaaaatctctttggagtcctcagtaagttttaggtgtaaagtgcctgtgagattaaaaagttgagctgctgcttttatctctttcctgagtgacaggcagagtcaaccatgccactcctaccccaacacaacccaatggttcctccttcactcatggtaaaagccagagctctcacagtggcccatgaggtctctcattgagcttgtcttctctaaccttaccctttgttcatgttgctctagataccctgactttgctgtgttcaggaacatgccaagcttatttggcctaagagtttctctgctttttccttttgccctgagccctcttcccccagatttttgtttatcttttcatttcatttcttggctatgcaaatgttacctcaagggagtcacccctcttgc

SEQ ID NO: 36220 - DNA, 1051 bp, Homo sapiens
atggaaatattgaactttattttgattatgtattggtaaaaactcatgtttttttcttgaagtttaattattgtgtttaattgtgtatttcatggtgaaatgtaccagtaatgactatccatgattcaagtaaaaggtagttgatcttagagcttttagacaaaaaggcttgcatttacatccattcaatgagcattctttaagcacttcctgtgcaatagttcctgtgctaggttctggggatgcaatgatggaagacagaaatggtcatggtccttgtgaagtcacagcttagtggaggcaccatgtgttaaacagatagttataagagtaataaattacagttgtggtaaatgccatgaagggaaagtatagacagaaggagaatcagggagaccactacatggttgccttaatattcagatctcgcgcaatagaattcactgttattaacgtatcaccacattttacagtagatgtcttgaacttattcctcctttctaactgaaattttgtgtcctttgaccaacgtctccctgctacagcccccatcccctagcgatcatcatcctactatttgctgctatgagttcaactcttttagattccacatataagtgagatcatgtgatatctttctttctgtgtctgtcgtatttcacttagcttaatggcctccaggttcatccatgttgttgcaaatgacaggtttttctttttttaaggctgaatagtagtccgttgtatacatataccacatttttgttatccattcatctgttgattaagttgattctatatcttgattattgtgaataatgctgcaatgagctcaggagtgcaaatatctattccagatcctgatttcaattcttttggataaatacccagaggtagaactctttgatcacatgctatttttttttatttttatggaaaccccatactgttttccataatggatatactaatttacacttccacaaagtgtacaaatattcccttttctctacatacttgtcaacacttatcttttgtcttttttataata

SEQ ID NO: 36221 - DNA, 1028 bp, Homo sapiens
ctccatgagcatggcactctggaaatgttcctacatgaatgtgtccacctttaacttttgttcaaaatccttttgaagttgtaaactgacaaatcaatggagtctatgaatgccattattttcagcattcactcattttagaagaaaaggaaacttcctttcctcacctcccacagcctgaagaaagtttcctttttgagagcaaaattaccatttgtttaaagctttctcttcaattatagcaatttccacatgttttaaaactattctcagcaaaagaaaaatcaacattatgtgcttttgaaacataggctaatctggtagacatcagtttgaaagagtcatggctgaaacaagtgacttggaagattttcattgtatgctcttagcccatgttgtctgtgaactcagaagcaggacaaattgaatttttttttttgtgaagataaattgatgcacaaggggaatcttgaaatgcactattaaaaagctcaactacttaaggataagacaacatgtagctgaactttttcatatatatatatgtatatatatatacacacacatatatgttttttatgtttcataggcttcagttaggaggacagtacagagcctccactgcaatcaaccagctgtggcctgccaattctagttcctgacaggtagcaagctggattcttggctgtaaagaatctcaagcagtttcgatatgctctagggagggcaactgtttagcctaagcaattcaaagaagcataattgtgcttcacagtacacagaaagtcaccacatctgtttcgtatttttggcttttagaactgaactagaacagagaaataaacatacagctttgaatatagagtaaaaacaagttcatggtgcacagatgagcatattgtatgtaactcagtgaaaatttccttaatgagggtttcttttggtaaagtgagaaatatttctggtgttaatcaaggttttttaaaaaaagatttaatagaaaatattgtctatttaaatgtcaagac

SEQ ID NO: 36222 - DNA, 1034 bp, Homo sapiens
gagtccaatatatcattcttatctctttatgtcctcatagcttaccttccacatatgagtgagaacatacaattaaaaacataaatttatttctcatagttctggaggttaggagcccaagacaagggtgccaacagttttgttatctggggaaggctgctctgtgttccaagatgatgtcttgaacagtgagtcctttggagggaaggaaggctgtgttcttacatggcagaaggtcaaagggcaaaaaggcctaacactgcatggaacttttttaaaagctttttaattccattcatgagagaggagccctcatgatgtaagtaatcacttcttgaagaccacacttcttaatatttacattggcagcatataaaatttagagggaatgtattcaaaccatagcaatgtcccacactcaaatcatcctaaaatttcaaggcctatcctctgagttcaatatctggtccatttgtggtagactacccaccagcaccatataggggaaagtgacactagacttctttgggactattaaaactgaagttaccttctcattttctcataggagggaggagaaaaattcccaccctatcctcacagctgcctaagtgaataaccactcaatcaaaaatggaatctggagtaaagaagttgtgaaacaaggcaaacagaaacgctttgcaccaatcccatgacccaaaagtgagggattttcttccttctcttcttctgcaatgttccttcatgaataatatttagttcagtatttttcatccttatagaaaactagtgttcacaggtaattttactggaattatggcaggttagggtgcaaaatatacacatattatagaggtacacattttcatattcatcagctttactcattttaaagcttttgattctcttcattgcccttcctgctataactcgaagtggatcagccgtgaactttgggtcattctaaattttattgattatcccattctacccaaccaaaaggcaaaagtatttctaccacattactttgt

SEQ ID NO: 36223 - DNA, 1033 bp, Homo sapiens
aatgtaatttataatcaataacatgcacacaaattaagggtatattttgatgagtttggacaaattgatgcacccatgttaccctcactataatcaagatctgttacatgtacattatcctataatgttctcttgtgtccttgaacatttagttctgtaccaccaacaccaggcaaccactaatttcctttttatcactatagactagatgtatactttttaagaggtccttatgaatgggatcatacttaaatactgctttgatatagcttcatttctctagtacagtattattaagattcatccattttgtgtataccagcagttcattcctttttgttgctgagtagtagtctactccatggatatgttacagtctgtttattcacatattggtagatatttgggatttttttgtctttgctaatataaattgagctgctatgaacatttggttacaagtattcatgcagacatgttttcagttctcttgggaaatatctcggaatgaatgaatttatactgtttgagatggcaattatgtgtgtaacattataagaaaatgccaaactggccaggcatagtggctcaggtctgtaatcctagcactttgagaggccaaggcaggaggtgattacttgaccccagagtcttagatcagcctgggcaacatggcgagatgctgtctctacaaaatttttttttctttcttttttttttttttttttccaaattaaattagccaggcttggtgatgcatgtcctagtcctagccacttgggaggctgaggtgggaagatagcctagagcccaggagttggaggctgcagagagctatgaactgtttttcaaagtagtaccattttatattcccagtagtagtgtatgagagttcctgttgctctgaagttattttggcactgttaacgaaaatcaattgaccatgtatgtgtggtctatttctggacttcctgtttggttccagtgatctctatatctaccttataccaacactacactgttttggttactg

SEQ ID NO: 36224 - DNA, 1098 bp, Homo sapiens
ttttctttcttttccttgcctgattgctctggtgaggatgactttcagtattaggttgaataaaagttgtaaaagtaggcattcttttctagtttcagtccttagggaatggctttcatggttttcccatttcacataaggtagctataggtttgtcatgtatgacctttgttatgttgaagtacttctgtgcctagttggttgagagttttcatcatgaagggatgttgaagaaattttattaaaagcttttttgcatatattgaaatgatcatatagtttttgtccttcattttgtttttattaatttacttatttgtgtatgttgaaccatccttgcatccttgggataaatcatagtgtacacttgatcatagtgtattgactatgacaatacactatgatcaatacacttgatcatagtgtactgactctttgctatgttgttggatttagtttgctagcattttgttaaggatttttgcatctgcttttctcagggatattgccctgtagttttctttttgtgttgtgtctttgtctggttttggtatcagggtaatggtggccttgtagaacgagttaggtagaattccctacccttcagtttttttgaaacagtttaaaaagtgctgttgatagttctttatacatttggttgaattcagcaataaagtcttttggtcctcggctttttatttgttgtgagagttttattactgattaaatctcattggtctgttcaggttttctgtttctttctgattcagtcttggtaggttatatgtgtccaggaatttatccatttcccctaagttttctgattcgttggtgtatagttcataatagtctctaatattcttttgtgtttctgtgatatcaattataatgtgtcctttttcacttctgattttatttatttggggttttttcttttttgtctttgttagtcttgctaatggcttattgattttgtttaacttttaaaaaaaattaacttatttgtttcattgatcttatgtgtttttaagtctattttgtttcgttctgctctttattatttatttaaaatttatttatatatctttaataaatatt

SEQ ID NO: 36225 - DNA, 1058 bp, Homo sapiens
caagtgcatgacgacgctggtgctgggcagggtttgaaacacacagaaactgtgggacagggtttctgccagtgacagaggccccaggcaggtggctctcaggatctgaggagctcctgctttggctccttttgtccccagggtggcctccctggtgctctccacctcctactccttaggatgtaggacactgtgtaggtgagagtgctggccacctagttgcattgttgactccagctggcatcatgacactgcagctctctgggtggacaggaatatcagtggggctccgggcttaggcactgttgggccacagagcaggatgtagtctggtagtgtctgggctctacctggcgccatgctgcagcctcttgggtgccagcagattatgtgggactcagcgtgtactctttctttggaataatgccattgagtggactccaggcagctttctaaactagtctctgggccagtgaggactaaggggctctccagttgctaggattgcaggaattcatggtgggaatgtggatctgtgtagatgtctcttgtttttcccattcgtagtgggtagtttctccaggctcctagccagttccatttgagccagctgctttgcttctctgtctttgcttgcctcagagattccctgccacttttaaattgtaatgttctctcttagatgccctattcagtgtgtgattatctactcactgttttagtcctttgtggaagagctgagtgccaagcacttctaagtcagccatcttgaagcccccttcttccagggttttttgtttttttgtttttttttttttgagaccgggtctagctctgttgcccaggctggagtgcagtggtgcaatctcagctcactacaacctgagcttcccaggttcaagcaattctcctgcctcagcctcctgagagtagctaggattataggcgcctgccaccacgcctggctaatttttgtatatttaatagagacggggttttgccatgttggccaggctgttctcaaactcctgacctcaggtgatctgtccagcttggcc

SEQ ID NO: 36226 - DNA, 1052 bp, Homo sapiens
gtctattctgtcttaacaaaaatgcttatgtagtttctcgtcaaatacttcctcagatccattttctcttctctacgttttaaattaccattaaacttacgttataccttttcttcatattctttgtgtttttcaccttgtatctccctccctttctctctctctccctctttctctccctctaccatttcccctgtcctcctctttctccctcttcccccgccccatatagattttttttttctgtacttgccacattctggatagtattttcgtccagtttttagttcattagttctttcttcagctatgtccagtatattgttaaacatgaccattgcatttaaattttttgtgttttttccagttaaaagactttttaactgttccaaaccactatgacttgtttttatgagtttcaaggttttcttttgtctttaacatggcaatgacatttattatctatgcttgattattccatatctgaagtctttatgggtctgtttctgttgttgtttttgctgtttccttctcttgtgcttttttattttctcttgcaagcttattattcactatatgcttttaaattgcatttgagaagttatttgtagaaacaatacgtgataaagaccagagtatcttcccccagaaagaatttctgttgaacttctgccaagtgcctgggtgtaccactagttaaggactattctaatccaatgtctatgtttgggggactctgggtagttcaaatgaagtaaagggctacatatacatttagttttgcttctgattcactcttaccatgaggatgaagcccttcactttttcatcctatgagcaattagcttttggccatgactttttttttttttaatcttttcttcccttgtgctccagaaaccacagttctgtattctagattcttccttaaaatcagtgaaagtcctcagggcgaagtcaggtatctgagtagctcccttgagtacctcactagattttggcctagcacttcctcataatttgttctcttttttttctgaaatgttttgctt

SEQ ID NO: 36227 - DNA, 1022 bp, Homo sapiens
taaaaacttactattatggctatgtagtagtgtgcatgtttagctaatgacatgaaaagaacaacaactttggcaggatcttttttatcatagtaaaaaagctatagttattcctcgaaatcactgcaagacctcttctgtttaataacattaatatcaaggtaaatttaatattaagcaatatattaatattctattgtgattttaactgtatgtaccacatatttatataaggaaggagggaaagtcccaactggttgattttttttttttttttttttttaaatgttgtttttggttgttggaaagctggattgtgtttttatataaggcttcactttgtgggctaacatccttctttcctgcccagagtcttaaagcctgggtggtctaaagtgatcttgatttactatacccttgagatggagaatactttcagaaatcaaaatttaccaacctcttgcttctttcctgagtactgtcactgctgatattcagatacatattatgttggaaggaacattttgtggatgcatatgtgcatatggacataatcagtttactagtttaaatatatattttcactgttctgttttatattctcttgataacagtgagaagtaaggattaactaacttgctcagagtgatcaagcaagatactggctttacagagaatggagttgatttcctgcagtgttttctggagactagcactagaccctagtcctgccgatcacaccaggggaggtgttggtgctactgatgtggtcagacctgctgctggtttcccatgccatatagccgcaactgcaaggcttaaactcagctgtcctatcaaggcaggagactgggtgggattgacagccacctgtgaagactcacctgctaggatctggctggctgtcttggtcgctgatcatgtccgaagaagtacaccactttcttaatcatgcagcttttaaaaatctcctcagccccacacttgagggtctctctcctagattctaatgtctagcccta

SEQ ID NO: 36228 - DNA, 1096 bp, Homo sapiens
ctagacattttgtgaacaaagaatgaagagtaggctatgttacatagctgtgttaagcatatgggctcttttcttccaggcattgagcccagactatgaaatgtgtttggcttttggttctaactatactggaacctaagtacctaaaggatgaaataacaagaatagcataataattcactttggcacctcttttacttagccacctcataacttgtaaatggatcttccagaagtctatacctggccaaagtaaattgctgagtcttttttgttgttgttgtttatgagttatatcttgtttttaatacaaatattaacattatgacacccatggaaatagtgacagtgaagcacttatatttcaatgtgatataagttcataattgcatattacagattcaaaataactgtccatttgacttggaatatgaaaattatattagatgagaactcagatattaatttcacaaatcagcgttctttttctttgttttattgtttcagaaagtaaaatgaatatgaatgattttaggcagaacagcagaaggaactgggagagaggaagagaattgagatatagtagagaaaaacttcaaaagctttttatgcatgtaaaaaaatgtttttgtagaagttagagataatctgtaaaactgaacactgtaaaaatgtgctacttagtattttatagtaagaacaaattagattcagtatttcattttgtttcctaagcagtcatttatagtaatttttttaaaattccccttaaataatcacttatatcttattaatcttggttgtaacagtgatggatatagacaattttagccagaaggcattaattgcgtctctcctagaaaaaaccttgtcatttctatttgttactcttgttcagctttaaatggtactagggattttttttttttttacatccgtgtgtgtgtctgtgtgtgtgtgtgtgtgtggtgtgtttatattaagattcctccatttctccctctctctgctgttgtagccaagccagacagcctattgagaagcagcaaaccatctgttaatggatttgaagttctgaattatacttgagtgtgta

SEQ ID NO: 36229 - DNA, 1040 bp, Homo sapiens
tgggcctcacatcccctggatactgtattttctatctgcatttgattgaaaaaaatccatatataagtgaacccttgcagttcaaacttatgttgtttgagggtgagctgcattttctttttagtaactgtgaattacgttataccattagcttgattttacagatgagtagcatgtggctcaaagaggtttaaatattaggttgctgcaaaagtaactgcagttttgccattaaattttttttgcatggttttcatatctgttaattaatttatttattatactttaagttctgggatacatgtgcagaacatgcaggtttgttacataggtatacatgttccatagcggtttgctccacccatcaacccatcatctacattaggtatttctcctaatactatccctctccttgtcccccaccctcaaacatgccctggtgtgtgatgttccctccctgtgcccatatgttctcattgttcaactcccacttatgagtgagaacatgcggtgtttggttttctgttcctgtgttagttcgctgagaatgatggtttccaacttcatccatgtccctgcaaagggcatgaactcattattttttatggctgcataatattccatggtgtatatgtgccacattttctttatccagtctaacattgatgggcatttgggttggttctaagtctttgctattgtgaatagtgctgcaataaacatacatgtgcatgtgtttttatagtagaatgatttataatccttagggtatatacccagtaatgagattgctgggtcaggtggtatttctagttctagatccttgaggaatcaccacactgtcttccacaacagttgaactaatttacactcccaacagtgtaaaagtgttcttatttctccacatcctctccagcatctgttgtttcctgaatttttaatgatcgccattctaactggcatgagatggtatctcactgtggttttgatttgcatttctctgatgaccagtgatgatgagctttttttcatatgtttgt

SEQ ID NO: 36230 - DNA, 1107 bp, Homo sapiens
agatccttaaggatgttggggaaatgagatctgtacttcaattgtctgatttagaaaattaaccaataaatacttagggattgtttttatgattgaaagaggcctctagtcacacatgctttgtatttaattccagctgtatttaccttaagtaacttaagcactaagcgttagtcaactcatctgtaaaatggaaatagtaactccccacagagtatcactctgataaaatgaggtaacaatcagaaatgtttggtaaggcacctaatctgggtacgtcttactgcagagcataagctcttcactagtggactgctctctcagagtaattgtcctaatagttaaattgttaagctttaccttaatcccaattcctttttttttttttctcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattaggtaaaaataaaacaaaaataatcatcatggactgccctctgccatagcgtgtacatgtactctttttgactttaatttttttatttttccacaaaggtgaaagtaaatctcttaatcccttcattgtgttaattaggctgaaattttagctttctttcatcttcctaaaacattaaaatggctaatatactagtcattttgtttttcttaagcattaaaggtctataaatagtgtttgtaaactcgtttagcccacgctttattttcattgaatttcctttaatggctactgtattattaattttaaaatctgtttttaaaaccatagccttcttgctgctttcgttggtcagttctctctaacttgagtctattgtaacttttttttttctttcattttactaagtcctcaaaaaccaggcagccaagcatagtggttaagagtagaggtcaagaatcagattgcctgcttttgaattatagtttctgtttactactagcattgtagtagtctgatcttggacacattgtctaaatgttgacactgtacttta

SEQ ID NO: 36231 - DNA, 1058 bp, Homo sapiens
tcactaggctggagtgcagtggcacgatctcagctcactgcaacctccacctcccaggttcaaacgattctcctaccttagcctcctgagtagctggaactataggtgcatgccactacacccggctaattttttgtattttagtagagatggggtttcacaatgttggccaggatggtcttgatctcctgacctcgtgatccgcccgcctcggcctcccaaattgctgggattacaggtgtgagccattgtgcccagccaagtctatacttttcatgtcttctattctgagacttaaaaattgactgagatttgcacttagtactctcaatatggtgatcattttcattaagttttttggattggaaccgggcgcagtagctcatgcctgtaaccccagcactttgggaggccaaggcgggtggatcacttgggctcaggagctcgagaccagcctggccaacatggtgaaaccctgtctctactagaaatacaaaaaactacccagactctgggtcttctcagctatatcacttctaatcccaactttgacctgccagaccctttttggctcaagttccatctcccttgtgactctttctctacctcacagctgcatctttaaaacctccagttactggattattttctttctaaatttaaattctgtaaatagggatgataggcctaacttatatttcatgcaagactccatcataagttaagtgctggccacgttaagtgctagtgcttacgttaggtgcccatacctggccagtcgacaggctagaaagggagttaaatcctacataatgtggccaactaggtcactccttcagcaagagctgtggatatggtgatgtgtctgctgcaatgactgcttagtaaattctattaacaacagataatctggcaataacccacccgctttattttttcagatttgatggcattttgtctgggttacattttctgtataatattgaaaaacaaaggtttacaaaaattgtaaatgttatagtcaaattgatatgttaattactttaaaagcattagaa

SEQ ID NO: 36232 - DNA, 1034 bp, Homo sapiens
attccgcatatccagttgattaagaagcccttttgcttttacattttaaacaaatctcaaactcattactttctcttcatctccattggatttcgcattctagtcatttagttatttgtcatggtggccttctttttggtctctttaagggatggtttcagattttgtagggcctcaaacttacacaatttgggaggtccttcataaggaaaaaaacccacaaaataacagatacatatatgtacaaaagtaaatatttagaatgataagtgaaagcacaacaaattacaactaaaaagttgtcaaatactacagacatttttaaatgtatgtatatatttttgagacagggtcttgctctgttgcccaggctggagtgcagtggcatgatcatagctcactgcaacctggacctcctgggcttgaacgatgccccccacctcagcctcctgagtagcaaggactacaggcacgtgccaccacacccagccagtttttttatagaaacgaaattctgccgtgttgctcaggctggtctccatctcctagactcaagccatctgcccccctcagtctcccaaagtgctggggttacaggcgtgagccaccacacctggcaacagatctttttaacagcctgatacttcttcaacttttcttatgttttttgggtgaccatagtctttggtcatctcttcatatgataaccactgataggttatggctgtgtccccacacaaatctcacgttgaattgtcataatccccatgtgtcatgggagggacctggtgggaggtggttgaatcatgggagcgggtttttcctgtgctattctcatgatagtgagtaagtctcatgagatctgatggttttataaaagggcagttctggtcatgctctcttgcctgctgccatgtaagatgtaactttgctcctcctccaccttccatcatgatcatgaggcctccccagccatgtggaactatgagtccattaaacttccttttctttataaattacccagtctcaggtat

SEQ ID NO: 36233 - DNA, 1687 bp, Homo sapiens
agtttcctggctcatgggaacatctgtagacatagaggcagctctgttcctgctttaatttcactaatattaactgtggtggttgcccactgagaaaattattaccagccacacaattgtagtgcttggctttctcgagtattcaagagagtagctgcgtgggatggcatgcacttataatcccagtgacttggaaggctgaggcgggaggatcccttgagtccaggagtttgagtctagcttgagcaacatagtgatactccatttctaaaattaaaaaaaaaaaaaagaatatatatatatatttgttaaatttgaaaaagagaaccaacaattccttccttgaaaaaaaaacttttattttaggttcaggggtacatatttgttatacgggtaaattgcatgtcacaggggtttagtgttcagattatttcactaaccaggtaataaacatagtacatggtagatagttttctgatcctcaccctcctccctcccaccaccctctcaagtaggctctggtgtctgccggtcacttctttgtgtccatatgtactcaatgtttagctcccacttataagtgagaacatgtggtatttggtttcttgttcctgttagttcgtttaggataatggcctctagctccatccattttgccgcaaaggacatagtttcattctttttatgtctgcatagtattccatcgtgtatatgcgccacgttttctttatccagtctatcggtgatggacatttaagttgactctatgtcattgctgttgtgaatagtgcatgtttctttgtggcagaatgattaataacaattccttcttgagtggatagtttatttatgttcagagaaggcacaatctgctccactcgattcattttttaaataaaaacattgtttatatgtgtttgctaatgcatacgtataaatggtactgacgtttaaaatgtttgacaattgtgacttcagatgcaaattttcatgttggatatatagttttgttggatcttcaattaaaatttgattcctgttttagttggagtattttatgattcaagccttaaatcagaagacaagtgaaaaaatgaagaaaagaaaaatgagcaactcctttcatggaattagaccacctcaacttgaacaaccaggtgcatttcttagccaatgtctagacattcattaaacattcattacagatcctttctcacaggtcttagagcaattattctcaaacttgagcatgctcagagcttacctgacattctgattcagtcaacctgggataaggcctagaatctgtgttaatcagcctcccaagtgatgcaaaagcagattggtacttgaatcacattttgagaaatactgctttaaaaattgagcctatagatcctatgtgtcctaggtggggagctgttctagattaaagtctaatgctaagttactactaaatgcaatgcatgaaccttgattggatactggttcaataaaaacatctaaaagatgttcttgggacatgggttaaattttaatacggactggaaattagattatatcatgtaattactgttaattttcttatgcatcataatggtattgtgatgaataggagaatgttcctgttcccaggagatgaaggtgaacgtagagtcccgggcgcggtggctcacacctgtaatcc

SEQ ID NO: 36234 - DNA, 1025 bp, Homo sapiens
tttgcaaggcaagtatcatttcatacaggtagggaaatttggggcagcctttatttaagtaattgatgttaaaaataaggtattactttgttcatgtggtttgtggtcatgtaattttataagttaaaacttaaattatgattttgaaaagtacagttgcagcacgcagatttatgtggataaaaaatacatattggagtagaatgtggtgctaggttagtgaaatattggcttggaaaaagcataaattaagcacctgtacagcacacacccagcacattgccttcaacgggttctctgtaagttttagttgaattaaagagtaggctccagtagccgggcatcatcatatcagtaagccaaactatttaaagacttcatttagtactatagattttgacgtttaaacttagaatgtcacagttcagaatttaagattttgaaaaactaacatgtttacatgttaagagaaaaaagatgtttttaatcatatgtttaaggaactgtgagggatgtgacttttgtatgataattttctgttgaaattacatgaattattcagtaggcttccacaattattattgactactttcaaaggcatatgagcactctgacgtcttatatcctttttaacatagtagcagtaaaatagctagatgtatctccagtggctgatcctgcctagctttctcctagggggagtgctttatttaattgcaaaattaatacaggcagatggaaaaaaagagaaagaaaagaaaaaagttatccttctaccctagaccctttccccggagtcatttacctgttgtaatttttttatgcactcattctgatactgtttgaaagagattaatattctggggacatttgattaataaaagtgtaatcctaggtatctgctgctttccagggatcacaggccgtttcccatggctggagcgtagagtgaaaggtgatggctggtgggtgatgaggtgggcaaggcctgtggaagctgttcctgctgctcttagacttgtgct

SEQ ID NO: 36235 - DNA, 1018 bp, Homo sapiens
gtcacttgactcccatgcccgaattccttccatgtgtatgacggttatgttgtgtataggatctcagaatgactttataggaccaggatttgtatgatcctgttttgcctctctgttttgcttatggataccattctggaatgttttcttctgccttaggaggaagaataatatcatttttcccccctcaccgaagattttaaacttcccaccatagtagattagagtaagaagtagatgtcatttattcttattactgctgatgttatatgtttatttcttagggataaagctttcagagttccctagctaggcaagcagaggattagcattctgaccagggctctcaggctctgagattcagcagggggaatgggtggagacgtcagaatttaaagtgaataaaatatgatatttcaataaaaatcataactaagtctttccaaattagggaacaacatagactttaggcaagattgtggtcctaatgaatcctagtatttaaaatgacttattatttcatcatcatttgggtaacactacctgaaaatattcaggcttgttttgtttatccactgtaaatagactaaaatttaaaaaaaaaaaaaaaaagagaaagaaagcaaagcaaagaaaaaagggtggagggtatggaaagggaggccagcccttgacttccaggagggttggcacacaggggatacctgaagaccacagaaaggataaagcactgaggtctgagttagacagagaggctgctcccggagccactagctccagccaggcgcgacaggacagacgagttatcaagggtgagagtctccggaacgccagatcaaaaacccaggaaactctttataggttctagtgggctctgctgtgagtaggaaggacaattaggattataagattggagatgaagatggaggtgaaccagctgggcccggtggctcacacctgtaatcctagcattttgggaggtcaaggtaggcggattgcctgaggttaagagtttgag

SEQ ID NO: 36236 - DNA, 1049 bp, Homo sapiens
attttcagtcatcctctcactcaagtaattgaagctgctaatattaagttttaccttgctaattagaaaatattacagaggaaagcagtaataatgataggatttttaaaaattggcaaaagtgtgttagggaaaaatgagtcaaaatgaataatcaaaaagttaagccagatactggaatctgtgcattgggaagatcacagaagacaggtaatgttattatgttaaatattcaccatacacagtgttcttggttccatagctacaaaagaatgtaagaatgtaaggagggataagaacgagaattacatgaaaaaccagatttctagggaagtattgaaaaaacccccagccaaattgggtggttgccaggggctggggaaagggggaaacagggagttagtgtttattgggtacagagtttcagtttgggaagaagaaacatgttctggagatggtggtggtgatgactgcacagcagtgtgaatgtacttcatgccaatgaatcatatacttaaaagtggttaaaatgggccggatgtggcggctcatgcctgtaatcccagcactttggaaggccgaggcaggtggatcacaaggtcaggagatcgagaccatcctggctaacacggtgaaaccccgtctttacaaaaaatacaaaaaaaattagccgggcgtggtggtgggcgcctgtgctcccagctcctcaggaggctgaggcaggagaatggcgtgaacccaggaggaggagcttgcagtgagccaagatcgcaccactgcattccagcctggacgacagagtgagactccatctcaaaaaaaaaaaaaaaaaaaaaaaaaggttaaaatggtaaatttcatgttatgtttattttatcataataaaaacaaaacaacaaaccaaccaaccaacctgaagactaatgtcaagaaaaaaaaatggcaaggatctagtttagctaacggaaagatttaccagatagtcctggaattaatttttaagggcaattatagaatcaccttttctgaagaattaaaaaaaaatagat

SEQ ID NO: 36237 - DNA, 1034 bp, Homo sapiens
aggccgggtgtgatggctcacatctgttatcccagcactttgggaggccaaagtaggaggatcatttgagctcaggagttcaagaccagcctgggcaacatagtgagacctgtctctacaaaaaaaaaaaaaaaaaaaaaaaagaagaagaagaaaggaaagaaaaaaaagataaaatggaataaaagtgcagaatgctgactccctcgaggcttttcctaaccattctattctatggtggatgctacggtcagcatgtttttttaattgttgttttttgttggtggggggtgtttagatcattaaagaaatggtttcatcatccactttctctcatgtcccttttctcatcagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaaggtaattgactctgtgtatctgatagcctagttttttataaaatatttttcaaattatactattttaaaatttatcattttttaacatacgttaatactagtcttagtttggaagtttggctaatgaggctaaagtgccttcacaacagtttatctggctagataattttgaagcgttagggtttgtgtgcagtcccttttataaggaggcaaaatgtccagatacggaatttttttaactaaatagtggcccttagtagagtcatttgaatgtggtgctatactatgtcacataggcattgtaggaaatagaatttatgttgaatttccccaaacaatcacatcttcaggttcctaaaagggaaatgacagaattggtccatatatactgatagcgatggttaagctaaactaatttacttcttcattttttcatccatataatgaacatgttttgaagtttcagttgtatgtaggagatattggtgtgcctcatttatccttgcagaatgcc

SEQ ID NO: 36238 - DNA, 1937 bp, Homo sapiens
tacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaa

SEQ ID NO: 36239 - DNA, 1030 bp, Homo sapiens
ttaggcttgtgattttttccgcgtgtcagatgtgcagaaagaacgtgtgggaaataacttatggtagatatgaacttcaggtaattttttaaagtcattaaactctgggcagatatgtttgaagcaaagttaactggatagaataaggaatgactgtagtgcccatttatgcctccaagttttgttaagtcttaaatattagaccaaacgatattgttttgcttagtttttacttctctgcccatttccaggaagcaccaactctttatttgaaaaggacaaactattttcttatttctgcaaatctgtttgaaaaagggaagaaccaatcttgggaaaaaaattcagcctgatgttctttttcctagcatgccttttgcccgttaccacttccacatcccctgtttctaagatagtctgaaatttcaaaatgcctacaaaaagttctctgtctttaggttgtttggaattgttaattattggtggcaatggatgagtgttcagcaccttggaacttttgcaaaagaaacttaataaggatacgtttgctgtagttggaaaagtatttgatgaacagctgacctttcaaatgtttacatgagttgaatctctgaactgctaatgtttggaaggtccaagttccaattcagacttagacactgaatccctttgtagagaaagctttgaaatctcttcagctgtagttttctctctctttttttttttaaggccaacttcacctaccagttaattggttaatgtttgtgaatgctttgagtaggcaaaaagcactttctcagggcagtgccccattgttccctctcccaattgtggtttgccattcacctgagtaagtggataagccatgggccaagtttgcattgtagaaaggaaatgattctacagatacttagccatgggatggaaaaatatgtttctttcacgtagagtttgtgaataaagcttccactgtgctgagcaaaaaatgcaaaaggaagccttgttgtctggattaggtcacttataaata

SEQ ID NO: 36240 - DNA, 1028 bp, Homo sapiens
gaggtgtctgttcagatcttttgtctgttttttagttggtctgttttcctattgttgatttttaagtgttctttctatattttgaatttaagtcctttatcaaatacatatttgcagttttttttctcccagtagtggcttgtcttttcattttcgtaacagtgtctttcacagagcacacatttttaactttaacaaagtccaacttatgaatttctcccttcataggttgtgcttttggtgttataaatgaagttcatcattaaacccaagaacacaggtattttcctatgttttcttttagaagtgttataattttgaatgttacatttaagtctgggatccagttgaattaattttatgaaaggtatgacgtatgaatttaggttcttttttttcttttaacatatggttatctaactgtttcagcaccatttattgaaaagacaatcctttttttcattgaattgcctttgcttcttcctcaaagataaaatgatcatatttatgtaggtctatttctgtactctctattctgttgcattgtctattatttttgtaataacacattgtcttgatctctatagctttatattaaggctttatattaagtcctccaacactgttcttcttctttagttattgtggtggcaattctaggtcttttgccttaccatatacactgtagagtcagtttttcaatagagacgaaataccttgctgggattctggttggggttgctttaaagttacaggccaagttgggaagaattgataccttaacaatgtgtgttttaattcataaacacaatatttctccatttatttagatggtttttatttctttcatcagaatttcatattttttgatatatagattttgtatatatacataagtattttattttattttttgggtgctattttaaatggtattattttttaagcttcagattccaattgttcattgcttttatacagaaaaagaattggacttgcttattagttccaggaattttgttgttatt

SEQ ID NO: 36241 - DNA, 1047 bp, Homo sapiens
ggaagtgacccaaagtgtctttcagagaaaaatgaagtttccttgcaaaagcaagtgctaacaataagcatctccattcagggattatgaagtgccttttgctattgtagttatgttattctagtgtctattactgttcatatatcttttcattcagaattcagaatacagagctgaaaacttctccctgtaacatataagttatgacttctctccagagcatataagcttttactatgagtaaaattcagtcctcagcaatatagaagtataaaactttgtccttaatttctaattgcttccatttaactgagcaaacattttaaatggtaacactttctttatgccctccagtctcatgctgtccattaaaagccttagcactttcagcattatgaacccacagacgaggccttgacttccttcttaggaagagtgagatgttaaagacacagactggctacctgctgtaaacatgtattgcctttttctttatctatcaaaagcgtcaagaaactcttagctatttgagctcactcttgcaaggcactatgctaataccatggggatattcaaggatgtggttcttgtcttttagaagtttacaatccaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaaaaaaaaaaagaagtttacaatccagtaaaaagaattaaggcttttataattctatctggtgagtgctatattcatagcttaacgcattgtgggagtttagagtagaaagaatttccatggaatagaaagatctagga

SEQ ID NO: 36242 - DNA, 1119 bp, Homo sapiens
ttcataatggcagcagggctgcatttacaaatgagctgattgagtaatgcacaaccacagagagtgatgtcctcattgattatgaagggaatagctctcctggttgataatcgtgtataattctctacattttcaaaattgtatgtattatatatatgcatacacagacttacatatgctacacaaatccataatcaggagagggtagaggacccagggacactcaatatgagcacatatgaatcctggctcatattggatgtaaaagttatgtaggactcaatttgcatgcttctcttctccttcctgtctttcccagcatgaccccctccccaagactatcaaaaaccacagctgtctaggggatgtagctcttcctgtttgctgagaggctataaagatactacttagacaataggctccaacaaccccgtgaagatgccctgctctctctacacagctgggctatgagacggcattcctgtcacatagatacagaggccattaaactgactgtgggttattagtaccacttagtctaagaacaattaatttgaggctgtgaataagaaaggagctatgtttttgagatggacttcatcctctagaagtcacttctatgtaattttaaatagtaatgaagaggataatgcagctgtagactggactttgtaagaaatgacatctggacatatgtgctttctgggtgctttacacttctacaaagcagaattctagcttcacaaagccaaccactggcaagggccatataagtatgatcaacaattgtcaacactcccctgcttctctctgttcttggaacaaagttcaaaatacctaacatcctcttttgtgccctgccttatctaggcccacttacctttccagcctcctctgcctgcagttgcccacctgccatacacaaagaacccaactggcccctaaccaagtgatccaaatactcaatacaatcccaatacaaatttcagcagaggggtgttgtgtgtatatgtgtgtgtctgtgtgtgtgtgtgtgtgtgtgtgtgtatgtaaacagacaaattgatatagtaatccaaaatgcatgtgaaatgcaaaggactaagtatagcaagtcat

SEQ ID NO: 36243 - DNA, 1043 bp, Homo sapiens
cccacgacacgtgggaattatgggagctacaattcaagatgagatttgggtggggacacagccaaagcatatcactagttttcctttttaatcatatacaaagtatgaatgtttctaaagaggatctttcagtcctctagattattaacctgaattcttagtacccgacttagtgggtcctttacatcctagatagtctgatgtgatgagaaggctcaggaaggtcactgtcagcctgtaggagtgtccactgccaccccagcataccccagaatagagagctatctgtggaaaaccacacaatactccagagaggaaacccatgcctacttggtattcccatcatctaccataacataaaataaaagttttttattctctaatgatagcccattataagtctcccacatttttaggtgtggctgcctagtctagtgccatttcaattcagtaggctcttttttttcgatgcctactgtatacaaaccagagcaggcatttcaagactataaagatcaaagaggaaaataaaagctctggccgcatgtgtaactttcactgtccacagcctgagattagtggggaggaccgtcttaatacaggtgaccctggatgttcatgaaggccgctgtgccttgacctggggagtgctgctccatgacaggatttctccagatgccgaaatagagcgtgactggaaatgtttaaaagaaaaccatgacttcatcctttaatgagagcttctctataaaacagtgaaactaatcccaaagcatagaacagtgcctggtccattaaaagtgctcaataagtagtaattaatcaactaaccaatcagtgggtttagttacatttaatgtttaaatgttttcatttgttttgttttttatatttcctgtaaaacatgaccagctgactttctctattattgtgcgtatcctgtttaaatgttactaattacaattgtttaagaaccacactcttaggctaagatgcagatgggggccgtgggttgggttggaatatgccaagtgaacctccta

SEQ ID NO: 36244 - DNA, 1027 bp, Homo sapiens
tggcccctgctctcagctgtcttcaagactagtgtggatatgagccctccccagttttttggggtttcagggtactcttcaggtactttttacagcatgtgtgctaggccacagtggtaaagaaccggagaggaggagggactctaggaggactctggtgaagaaagcaggcaaagaggctgtgattggagtcaaaacaacaatagccagcattccccagtagaactcttgtaaccaaaacctgcacctgcaccacctgcctcatctgccaagtgtgactgcccgggctttagagggctcaattccttttcaactttaccctgactgtagagctgagcattggattgttagaaagcagacaaaccagaacaaaacaaaaagctcttgttttccctttccccgtcctcctttccagggccttaaccccaccaactctggccatggttgcccaggttactgtcactgaggcagttggcatttctgggattgtgacaccctcgaacgccagaaagaatagctgtagagtgtaataaaggtcagaggactcaagaaaggcatgaagattagagagtaaaggaagacagaccagaggaaggagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttgcaactcttaatacttaatacttaatttaggtataatcccaaac

SEQ ID NO: 36245 - DNA, 1897 bp, Homo sapiens
tctccccctgcaaataagttagtcatttgttttgttttttatatttcctgtaaaacatgaccagctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagaccgtgaaaagcttggtgaaaaagaagaaacaattcctcctgattatagattagaagaggtcaaggtaaacaggctggagtctttttctattttattttaattcatactgaattcatacacagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcctgtggtttaagtgcagtcacttaaatgaggcggattcgtggacagttgaacaatgtcagtcatctttgtagcaggccaggatttgaaagagtattcaactaaacttcattaacaattctagaaaatcaaattcatgcttctcactcatccatgtgcactagcccatttatttagcagacacgggaactagactgaactatccgtgattgaaagtttattattctggaaacctttatatttgcttcctgagttttacaattcagttgcagccatagcgtttctattaatttgggctcatttgtacattgctttgcaaagttcctagagagcatgctaagggccacatgttctgtctccactgagtgcccattcagtagaggctggtcaagtgcaggtaaactctcttcatgataggtgattggttggtgatttgctctctccctttactgaatttagtagtagtgtttaaggaagcagttgattcacagtccctgatcactttattctgtagtcatttcatcctcctctgacttacctcacacgttattagttacctattaataacattttcag

SEQ ID NO: 36246 - DNA, 1045 bp, Homo sapiens
ttaaatctcaaagttgtttatgataggcttaaagtcctagataacaaactgatactaagaactagtaaacaaattcaggatagggatgtgtttcagcagttcctcgtttctaacagaatttaattcaagaccgtttttgatctacccttgttttttctttctcatagttctcacctgccatggtgaactttctgatgataataatagccagtattcacctggaactgaagggctggaaactgttccaagcctcttacgtgtttagtcttttattctgtcaaactcactaagagatagatgttaacattatattcattttacagctaagggagcagaggcacataaagtaacttatccagcatctcatggcaagcagatagcagagggagaactcaaactcaaggtcattttaactgcagaagccacattcttcaccaccatggtgcactgcctctctagttcatacttgctttcctttgtacattgttatctccagtgtttgaaattctcttatccccagttaatttgtaattgtcttgaacactacttgataaagtgttcaactttagtatttcagaaaggaaatatactctccagtgaaagaataagcttcaagttattcagcatagatagaacaggttataagtattatcaagcagcagccttctcaaagggatttttatgtgagatagttatgattggatctcttaacaacagtttaaggctttttcgccttagtgtgttatgatctaatttttatccaaaagtggtgggtctctcttgtatgaatagtagggataacatcaaactttattccctggtcccttatgcttctcttccaaaatcttctgttaactacataagaatgttgggggtgggttgaagaaatgaaatgttagaaacataatatgtgtaaattgtttcatgtatgttgattgctacctttcttgcagtttacccaattcgatagcaacagttatttgggcacacatccttaacagaaaaaaagcaaaaacaaaagaatacaaaacaaaaaaagtacaca

SEQ ID NO: 36247 - DNA, 1048 bp, Homo sapiens
aagataccttccaacccccaaattttttgactttctattaaacttcctgatgttataatccaagatggcttttaaaacagaagtactcttaagagcttttgatttgaaattttagatagggcttgttgaaaaatttcaagtggtaggggaaattaattgatgttaattaatatcaagtggtagctagaatactaagaaagatattctaaatccatgtatactacttaattaagtaatgagatacacagtttgaccacttggtggtgcccagaatgtgtaaaaaggtctaatacatgttctaggggagctcatctgctgagctcttaaagaattatttctgtttaagagttacattttatttaaaaccgacctcaggtaagggaaatgtatattttcttagtagaaattctagactatatataagaaatcagcgtaaggaccagtttttgttctttctctttttaaatttcaagtttcatttaaaaaaatatatgctaacctttttagaatattcatcttggatactcagagttggcatttgtttactttggtaatagattcttaattttcccatatgctgttgtttaggaaatgctaattttaatgtggccaggttataattgtatctttaaatttaaggaatattcatgaagtttacaatcttcctacatttttgaaagcttatatcctgaagtttagtgacactggtcattttttcctaatgatatttcacactaattagtctaattcacataaataatttactatacttttgcatttgatactacttgtgatattctaatcttttcattttttgacagtatgaagatttcttagatgctcgatttaaaaccatgaagaaagattccttaaattcatctcatccaatatcatcatctgttcagtcttcagaacaaattgaagaaatgtttgattctctttcctattttaaggtattgctgtgaacaaaaaggtagctggagtgggtttaaaatttcgtataatttcgtatgtgagcaagctgtgtgatttagattattttaaagat

SEQ ID NO: 36248 - DNA, 1051 bp, Homo sapiens
aatatgttcagagaaggtcctaagtaagctcttggctgtgttactcagaattgaggtatgctgtcaggtcaggactgccaaaacaagtaagcaaaaagagattttaagaattgaagattcgattttagaatctgaaacacacgccctgggtttcaaggtaaagaaaaagcagaatgttaaaccccattcggatcaccataggtcggagaatagaagaatagtgataacggtgtcattcacatttatgttgtggggagggatgaatgttatggctgtcagacaagatagagaagaaaatacacaaaatgtgtgagatacagtctatgtcatcaagtagctgaaagttcagatggttggtacttgtggagcaataagagaggtaatatgtgctgagtgggacagaatttttgcctaggataaggaagagaaacttttgggaggtaaatgggaattgagttggcttaaataattaaaatataggtaaagaggaatgtgaagtatagggtagggcaggaatggaacaatgaggtctgcaaagaaaatgaagtactaatgggcaagtgatgttttttcagagagtcagtgtttgaccacagtggaagccacacgtgaagagggaaaagaagagaaagttgagtggggcccagttgtagaaggctctggataccataaggaattatttttttcctatgcaacaggaagcttgaaaagacttttgaacagaggaatgacttgattaaagttactatttaggaaaagtattttggtttcagtttataaagtagatttaagtggggagaaacgtaaagtcaggaaattgctgctaaagtccaggcatgaaatggtaaaagtttgaaatgaggagtgctagtaagggtggaaagaaaacaatgggtataaaaaatactgggcagggaaagtacttaaagtattagtgacagggtaaggccagtaaagaaagaggcagaaatgtttttcaggttcaaacctgactgacaagaagaattattgtacaggtactattaacaaacaagaaaatcaggagttcagt

SEQ ID NO: 36249 - DNA, 1040 bp, Homo sapiens
caacttttgcatcatggtgtttttccatcccaaactagttcctaacattatcctcaggtttttcagcacccacatcaaattatgcattggcctcttcacttcaatactgcttcgacacccaaaagcaccttggttttaggcaagcttattttcttctaatcctctggttcagaaataaataggtcagagccatgataaatacaagtttaattaaaatgggaagatttgctccatccttttgtgctttaaataaatgggcatatggtgattgaggtgaggcctgccatagtagagtgattttatcaatttaggtacatcatgactttgttgcttacaattcaaattcatatataatctagaaaaataatttgaatcctgagtttaacccacctgctttaaagagactgttgttcaaaaattgcttcttagttattgatactagatgtcttaggggctttgggccttagagggtctgcaaagctctgacactaggttctagattttatagataacttcatatattttctgggaaagaagggctgtgaccactaaagtagtttaccactgttttctagaaagacttaaggcaactgacctgttcatatgtcactcttctgctgccgctgctccctggcactcccacagtattaggtcctaagagactatcattgtggaggtggagggtaggagcataaagagaaacccagactcaggtgcttcacaggattgagtagcagtgtttctgattctagactgtatatcattattcatatcttgtagatgttagtattgtgatttgaaagaatacttataccttcttagggattttaacttgatgaatttagggattttaatgaattcttagttggttgatatatgtgccacttctcaacctagtgcctccctcactcccttagctatcacttagctctgttccaggttacattccttttagcagttgctcatttacctagattagaagtgtaaactcaacattcatgtttcttttttatattaacattaaatgtagtctttataga

SEQ ID NO: 36250 - DNA, 1030 bp, Homo sapiens
taggtgactaaccgtggcctttgtctctgtcaacacagtgttctccctgtgtttctgtgcccaaattgccccattcttagattaaggcccaccataatccagtatgacctcatcttaacttgattgtacctgcaaagaccctattcctaaatgaggtcatattcataggtcccaggcagacacaaaatttgaggggatactattcaacctagtacaggtagcaataaataagattagtgcatatcactcactttttttcactattaaagggcaatgttagttctgaatataccctgtgaggaggcagaatatctcccgactctgaagctgcccagttaaacttcataatggcagaagtcagtcttctgcttgcctctctgttaactctgtttatagcttagtgctcaagaagcacttgatacttacctcttctttgaactgcatcttcatcccagatgatttccagctttctgggcagatatgtgtttattaggaacatacttcaaggagggatctagggactgatggatagagaggaagggcagaagacttagtatgtgtttccaagattggacgcccttttactgctgtgtgtcttcacatggttagctaaaagcccagttaactttagctcaccaagagggagaatgtgtcactttaacattcttattctaatattagggtgaaaattctggtagcatcaatactctcaaactaggaaatctgacattctacagttaggaattgggataggagacatttatgaatccttggatatgacgttcaaatgtattactgtctaagactgatttctaattaacttctatatcattggaaccaaagcattatgtacatttattggtcattttgttatgtaggctgcacatgacatatgctgcattttgtgatgctgtagtgttgtgatgggtagggtctggaggcacatttcaattgtgttaaattgttcacatctgatgttaacatctgatcctagccatattcctgttttatcacttacaaatctgtcatt

SEQ ID NO: 36251 - DNA, 1045 bp, Homo sapiens
gctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacag

SEQ ID NO: 36252 - DNA, 1094 bp, Homo sapiens
aaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccgacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaa

SEQ ID NO: 36253 - DNA, 1030 bp, Homo sapiens
caatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaat

SEQ ID NO: 36254 - DNA, 1093 bp, Homo sapiens
ggggttttctggatatataatcatgtcatctgcaaacagagacaatttgacttcctcttttcctaattgaataccctttatttccttctcctgcctgattgccctggccagaacttccaacactatgttgaataggagtggtgagagagggcatccctgtctcgtgccagttttcaaagggaatgcttccagtttttgcccattcagtatgatattggctgtgggtttgtcatagatagttcttattattttgagatatgtcccatcaatacctaatttattgagagtttttagcatgaaggttgttgaattttgtcaaaggccttttctgcatctattgagataatcgtggtttttgtcattggttctgtttatatgctggattacatttattgatttttgtatgttgaaccagctttgcatcccagggatgaagcccacttgatcatggtggataagctttttgatgtgctgctggattcggtttgccagtattttattgaggatttttgcatcaatgttcatcagggatattggtctaaacttctctttttttgtcgtgtctctgtcaggctttggtatcaggatgatgctggcctcataaaatgagttcgggaggattctctctttttctattgattggaatagtttcagaaggaatgataccagctcctccttgtacctctggtagaattcggctgtgaatccctctggtcctggactttttttggttggtaagctattaattattgcctcaatttcagaacctgttattggtctattcagagattcaacttcttcctggtttagtcttgggagggtgtatgtgtcgacgaatttatcccttttttctagattttctagtttatttgcgtagaggtgtttatagtattctctgatggtagtttgcatttctgtgggattggtggtgatatcccctttatcattttttattgcatctatttgattcttctctcttttcttctttattagctggttttttgaaaagatcaacaaagttgatagaccactagcaagactaataaaggtaacatggacatttaagccggtgaatagaaagaaagaatacacc

SEQ ID NO: 36255 - DNA, 1037 bp, Homo sapiens
caacctctgtaaaagtggctcataaaaggcttcagaaaagcaacgttagagggtagaactattctctcagtatctagattgaacttcttggctgaacagcaatgattgccttgggacagcatttcgttagcatgtcctgaaacttgtaacctaatacaaaagtcaaacatggcactactgggtcatgtacccattgttaattgaggttgatattggtgaaggatgttcctatatatcaaagaaaagtttctttaatgatatgattttccagattgtcagactgtcatagtaagaatctaatgaatttagaaatttggctcttttgaactccaagatcccatccattatatctattctattatttgtttctgatcaattgcttcaactctgtaagattagagagttctcttcccctccctgttcccttataaataaataaattttgaaagggacataattcatttctacctaatcttgctaaaaatgaaatatgaggattttatatatgtatgaagttttatctattttacatgtaggattggtttttgttttttaaagaaatattttgaaaggacactgaagtacataaatgaaacacacaagcttcaggaatggaaggttaaggcagttcctggatgtttagcaaaggaagtatatggactttcctttagcccttccatttacacaactgtgcctctcaactgtgctcctcagtttctgtgtcctgcagttcaggttctctagggaaaatatgattgccttgcttggatcagtaatctacctactactgtccaattagctctgatagagagaacaggctagaaaaatggctgaaggaagaggaggggctgttctcaaagaaggatatgagctggaggcaataaaaggtgcctactatcagtcacttgagcaattttaacacttttttccttattcctcatgtttggttgatgtatgagcttgaaatagaacttttaactacgttactagtagtcattagctatcactactatttatttcaaaaaatactatttaca

SEQ ID NO: 36256 - DNA, 1140 bp, Homo sapiens
ttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattccta

SEQ ID NO: 36257 - DNA, 1046 bp, Homo sapiens
tgttcagtaccgctatgctacactgtgtcaatgtatgctaatatattgactaataaatacacacttcagaaacagctagagagagagtaagagcctgagagagacaatgagtcctggttatttgtctttgagtgcctggatctaatcatacctgaaatcataaacttttttttttttttgaaacggaatcttgcactgtcacccaggctggagggcagtggcacgatctcagctcactgcaccctccgcctcccgggttcaagcgattctcctgcctcagtctcctgagtagctggtattacaggggcctgccaccacacccagctaattttttgtatttttagtagggacgggtttcaccatgttggccagactggtctcaaacccctgacctcgtgattcacccgcctcagcctcccaaagtgctgggaatataatcgtgagccaccatgcccggcctaaactttttttttttaaattaaataagcaaattcccctttccgctttttttcagaagccagtttgactgttaaaactgataaaactgataaaactcctaatatatccttcaatatgcaaggagtgatacacagaaacctgtatcaaacgtgaaagcttacagatcacactgaaaccactggatggctctacagactttgcaaacatttacgcttgcatctaggagaaatttgaggactatttcatgagattctttgaggtaattcattgaagtaaccaacccttcagtattctccctgtatttacctctgcccacttatgctctctttcatttcttcatgccaagcctgactggcatacaccttgctctacatctagggtctacagcttcaggaaaaatcagagtacatagtgaaagcagtgtcctggtgacctggcatgctgcaacccaggctcccatctcaaaattgcccataaatgtatctgttttccatggaccttccccagaaaagttacactgagccttgtctagtaggggagccttgcgtcagatatagtgtccatctcaaatttgttgctttaagtca

SEQ ID NO: 36258 - DNA, 1124 bp, Homo sapiens
aaaaaaaaagttaaaaaaaaaatcccaaaacttaatttggtactccatataataggatacacaattgatcaatcaatatatgaaaaggtacgtagcatcattagtcaaaagggaattgaaattagaactataaggagttaacattccctacccagtgatcagaatggttaagaatatcaatactaagagttatgtgggccacatggggtggctcatgcctgtaatcccaatactttggaagactgaggcaggaggatcctttgaggccaggagttcaagaccagcatgggcaacatagcaagacactgtctctacataaaaattaaaacataatttttaaaaacttaaccaggcatagtggcatgtacctggagtcctagctactcaggaggcagaggtaggaggattccttggcccagaaattcaaggttacagtgagctatgatcacaccactgtactccagcctgagagaccctacctctattgaaaaagataaaaagttgatttgggtaatttgttgatgatctgaaactctcacacacttttggtaggactataaattggtacaactttgcaaaaacagtattaatctgctaaaattttaatctcctaaaatcttagggatacgcccaccaggaatgcaaacatgcatatcaaagctacactggaagttcttaacagtattatttatcctagctataaattgcaagcaaccccaatggagttagaatggataaataatatgtgacatattcatggagcaaaataccattcagcagtaaaagtgaagacactatagctatgtacacaatgtgaatgcgtcccacaaacataccggacaccaaataatataaatgcatgattctattaatgtatactcagaaatgaaattttagaagttagaatattggttacctttgaggaaaagaaaagggatagttcaccttgctccagaataccctggtaacatacatactaccatggctgtctggtgggtaattctaccctctgccccaagtcccatgtcccactccagaccacaagcaggttccccagtctttctacccgattcaccaatggaagggatggtggaactgtgttctaacaatggtcaacaactcag

SEQ ID NO: 36259 - DNA, 1028 bp, Homo sapiens
aaacctctgtctccttagcacaaatcaaggcaggggcaccaaactgtactgagttataagattcttggccactggggactcagaaaaaaatgtagtttcacatcaagaatatagtgatgaggtagtaaaaatgattacttagtaatttttttttttgagatggaatcttgctctgttgcccaggctggaccctaattcctgggctcaagggatcctcctgtctcagcttcccaagtagctgggactacaagtaaatgctaccatgcccaactaatttgattaaatattaaccctttagtacatggcttctaaatattctgtgtggcaaataagtcattcatatagcacttttgctgcgtacaaaaatacaatatttgtcttgtggaaaagcatttgtgtgatgaagttgtgggccaaactagctgatttttttcatggggcactatttttacttgaaagaacaattgacagacaaattaggattattcagacttggatatttggcagacattttctcaaaaatgaatgcagtaagactgtcatctcaaggaaaacaactgacagtattttgttatcaataaaaaaaaaatgtaagctttcaactaagagttagtgttttagaaaaccatccagtactctgagcatgaaaacttcacaattaagatgttaaaaataatgttaatgtgatattagtgattgtcattttattttattgtacaatgaaatgtgtcactacttggaaggtctgaataactcagtaatgcaatattttccaaatgttcaaagcatgatgttacaaaatcatgaaagtttcatttaaagtgcaagttaggccaatagttttaatgtaacacagtatattgaataacaaatttaaataaaaggcaaaagacaaattgagaaaactatttcaacacatattaacactgtcagaaatagcactttatattattttaataagtataatagatcattgagttatttctacttgttcgggtatagaaatgaaatagttttttttttttaat

SEQ ID NO: 36260 - DNA, 1075 bp, Homo sapiens
gcatgtgtctttatagcagcatgatttataagcctttgggtatatacccagtaatgggatggctgggtcagcaggatctccctcttatctgaaagaaccagccttaccctgcaaaaagcttcttgatgacagtatttgtttcctcacaaggagattctcaataacaggacttcctctcgccaaagctgaattgacaaatgctactgttatgtgtgtaacagtgatccctttttcagaggcagggttaagcagtctctctaagcccagtcactgtacagttctttgcaaactctcgtctcattgtctaaacaggagtaatgcttggaggggctacaaatgcctgggccccaaatagcaacctccctgtaaatatcatacaatttttctcctattggtaattggtagtggtactggtgggttggagttaaagggggatattgacttgtgttagtggcacaagtttgcgaggccaaacaacttaagcttgaaggtttgttagtttttagattaaaaagaaaacttctttttaatttaaatttttaagttttgtaggtacatagtaggtgtatatatttaaagaaaacttttgatgtcaacagtcaattgcactttttagcccagtactctacaaacccagacaattttgtcaagctttattgacttcccttaacaagttctctcatttttctggttgtataattttgttagagtttataacacttaattatatttcatagccctgaaagttgtaattttgaaaattcatctaacaatttccaatggtccttcagactttatatttttttggcacaaaagtggacttgggctaattcccttgatagctaccctttaacatacatagactttaaatgcctgactacttttaatggtaaaatcctggaggtattaaaggataaattgtgcttataggtctggtcagagaccaatattgtgcgtaccaacagaagattgcatctcttagaaactgtatatgtcttaatcgtattttaccagggactcttctcttgtagctcatatttcagggagttgtacaagtcattgatatctaacttta

SEQ ID NO: 36261 - DNA, 1026 bp, Homo sapiens
gttcatgaattatacattttaatagtattacagcctgaataggcaaacatgaacaaaacaattgcatctgttcttcaggcactcactttcaattaaagacgcatataagatgaaagaaaagggacagaaactgatattccatgcaaatggtaaccaaaacaaagcaggggttgctaaatttatatcagacaaattagattttaagtcaaaaactatctcttgagacaaaaaaaaaaaagatcattacatagtaaaggagtcaattcaccaggaagatatgacaattagtatgactctatcagagcacctaaattataaagcaaatattgacagatctgaagtaggaaattgacagccataaaataatttatgggactttaatatcccacttacaataatgaatagactatctagacagaaaatcaataaagaaacctctgacttaaacaacactgtagaccagtggacctgacagacatatacagaactttgcacccaacagcagaagaattcacattcttctcaagtgcccatgggatgcactctgagataaatcatcttaggtcacaaaacaagtcttaacaactttaagaagattgaaattattccaagtgtcttttccaacctccatggaatagaaatagaaatcaataacagcaggaaaacaggaaaaattataaatatgtggaaactaaacgatatagtttgaataaacctccaggccaaatctcatgtcaattgtaaccctccatgctgaaattgaagcctggtcagagatgtttgggtcatggggactgatccctcatggcttggtgctgtccttgtgatagtgagttcttgcaaaatgtggttgttttaagtgtgtagcacctgctcctccttgctcctatatttgccgtttgaagtacctgatcccatttcaccttgcaccatgagtaaaagctccctgatatatgctcagaagccaagcagatgtcagcaccatgcttgtatagtctgcagaaccacgagccaattaaacctctt

SEQ ID NO: 36262 - DNA, 1064 bp, Homo sapiens
ttttttttgccatcatgctcccctttgactttctgttctttctttcttcttttcttttctttgtctgtaaaatctagttcctgcagaccctttgactttctggaaggccacatgtggtttcatgaaacagattgacctccctctgttaaacaaccagaagggtttatggtttttatcttattaaatgccctagcctttggttataaaaatttacttttctcttagaattaaaactttctttaatattatatacattttttctcatcagttttcattttgtttttattttgcattgctgttttttgatagtgcagaaaagagttggacacattttgaacggttgatgttggagaatatataagtgcaccttttgtggcgttttatccagatttggcattaagatgtcccattttatcagatgagcatgctttaatcttcatctggcctcttattctggtgttaggacagcctttgcttgatgttgaggaaggtatctgactctgctgttttgcttccttatgtacctggcttgccagtttaaaagtttcaccattttaagtttcctaacagagtggcacatagagcatatttaagaagcctattgtaggaattcacccagatttagtgaatagaaattgaatacttgacctttatctagaaaagttgctgttttgttgtcaaccagaagaactttcttagtacagcccctatattccaaatagctagattcttaattgctgtactttcattaaattgcttcattattattgctgcatcaagattttcactaaacgaaaaacagccatagattgtttatttctgcttattgttttttgtagaaaaaattaaggaagaagacatattagatttcactgctgttgtagaaataaatttcctcttggtgtactctcaagtagatgttggaaaatgaggctcacagaggttaaagtagttggcccaaggtcatataggttgtaagtgctgggaccaggatttgaatccacagactctggcttggggacctgtgtcactctggcaagcttgtcgtgtgggaattaataagc

SEQ ID NO: 36263 - DNA, 1049 bp, Homo sapiens
tgctagttctataattactataatggtgttaactactgttattaccattaacattttccactctgattcatacctaaccatgtcttttaaaaatttttctaaatttttttaatttttaatttttgtggataactagtaggtatatatatttatggggcatatgagatattttgatacaggcataccatatgtaatcatcacatcagagtaaaatgggtatccattacctcacacattttttgtgtgttacgacctaattgtacatttttagttattttaaaatgtataattatattctcattgactacagtcaccttgttgtgctatcacgtactagatcttacttatcctttccattttttatgcccattaaccatcccaactccccctctaacctctccacttcccggtctctggtaaccgtcattctactatctccatgagttcaattgtttgtatttttagttctcacaaataagtgagaacatgcaaagtttgtctttctgtgcctggcttatttcactgaacataatgacctacaattacatccatgttgttgcaaatgagagaatctcattctcttttatggctaaatagtactccattctgtatatgtaacacattttctctgtccattgatctgttgatggatacttaggttgtttccaaatcttggccattgtgaacagtaaatatcagagtgcagatatctcttcaatatgctgatttcatttcttttgggtatatacctagcagtgggacatatataccccaaagaaaggacattactgaatcttatggtagctctagtttttttgaggaacctccaaacttctccatagtggttgaactaatttatattcccaccaacagtgttcaaaggttccctttgttccacatcctcaccagcgtttgttactacatgtcttttggataaaagccattttaactggggtgagatgacatctcattgtagtttttatttgcatttctctgatgataaatgatgttgagcgccttttcatatacctatttgtcatttgtatgtc

SEQ ID NO: 36264 - DNA, 1100 bp, Homo sapiens
aggagtggtgttggaagttctcaccattgtatttaactttttaaaaatcattcattcaagtggttatatatgtactaaattatttttttaacatgttcgttttatttcaaattgagccaaagatgttgaactttacacaaactataatctcttacattggatcatttatatgaagttatttttaataattattagaatttatggaatatgttagcagaattatggtaaagcaaagtttgcattttgtaaatttactgttccattcttgggtcaagtgtacagtgaacacattcattttcagagaaagaactgagaggacacaagcaagaatacatttcacatttcagctgttaaaggaggcaattttgtgtcatgtaagctcacagatcctggagccagactgagctctgtccacatgtagaaggtgtgactttgaacagacgttacttaaactctgagcgtcttcatttcctaatatgcaaaatggagaaattagtattattcatctcaggctttttgtaagcattgaatgagttaaaacctgtaaaagtactttgaatagcgcctagaatttaattcgtaatcattagtgtaagctcttattaatatcaattttttattctctacttagtcttattttctaaatcgttgctattaacagtttctgagttttttaatgtggtttctgttagttttatgaactgctgaacatcaaagggaatgattataaactagtgatttctaggaattaaattttgaaccattcatggagaaaatggagaaaggcatcacaaatgtagtataatttctaaataaatagcaactaaaaattactttccaagttagacacatgccattttttaggtcaaagttgcgggtcagaaaggtactgggctccagattcttcacagcttgaaatcttacttcattcatcattctgagcatagtcagtagcaaatcaataatttacttgaaaagaaacaagtaacttactactcttttgatatgtggtatagaggtcaagaatatatcttaaaaactctatatcaaaagttataaataagataactaccaagcaaaggctgattataattaataat

SEQ ID NO: 36265 - DNA, 1057 bp, Homo sapiens
tgggcatagaatcaattttagcctcttacagaacactattttcattattctcagcagtgctattctagttatcagaaactgagcatcagatataagaagtcacataattttatttttctgagcaattatatttccccccattgttttcttgaattatacttgttcattatgaaaaattgtcaaatgcaaaaaaacataagcacaaagaagacaatatttttaaattacccattattttactacccagagataagcactgatatcatttgtttgtgtgtcagccattctgctgttctgttcatgcatatatgcacatatacaaacagagattcaaaaccataagacataaaattaagataactgagcaatatttttcactgagcattagatagtgaacattttctcctgtcactaaatgttcttttacagctgcatctaagtagctgcattacattttattttatgcctctatcagtcctctattattgggatcttagaaatttgtttttgctgttataaatgacactctgatgaaaatacttttagattaattttttcctatctctactttcttaaaataaatttctagaagtaaaattaagtagaagagtgtggatatttttatgtgtttgatacgtatatgccaaattgttctttaaaaaagccatgtgacagtttatatttctgtggcagtctgtatgagaacacccatttcccagcctgaaattagctttcttttttttaactgccaattcaagaatacgttataacttggattgataacatgaacattttttatattatttttgaacatttttatattatttttacttctacatgtggttactctgttgatgttttcctcttttcttttatatttgtaagacttatttatgtgttaaagacattaacccagttgtattttatttcttttgcaactactttttctccagcagattcttctgttttcaacattttgccaagtgttactgaagaaaaaataaaataaattttaaaaccaaaccaaaaaacctctttagatagctaactttatttg

SEQ ID NO: 36266 - DNA, 1032 bp, Homo sapiens
caggtagcttgtccatgtcaaagttgtatatcaattaatttaacaaatttttgtttatgatcttctatatttcaggcactgtgctaggtactggtggtacagagaagtcaacaaaacatatacaaatccgttctctcatagagtgttcagtcagaaattaaagtgataagaaaaacaagtcatattgtaatgggactcaatactttagagcaatagagggggagttgggatgccaggagcctggggaagggttacacttttaaataatgaggtcaaggaagattcactgagaaagtgacagttgagcaaagatctgaagggcagtgagagaggaaaccacatggatacattgggtgagcatattcttggcagaggaaacagcaagtgcaaagatgctgaagtaggagcctgcctgtgaaaagaaaaggaggccattgtgctgggagaactaccaggaagggaagggtggagggaagagatccctgggatgggataggggtggaaaggtaggttctgtagggccttttgactgctgtgtattgagaacagattgtaaggtaccaacggcaaatcagggggatgagtcaggaggcagttacagtaacctggacacaaagatagtgtctatctacctactgtgcatttaatgctgcaagtattgtatgtagagaccaagtacaaagaggtcctttctgttgatttttcggtctgaattcttttccccttgtggttcaaatcttacatggaagggaaggaaaagtcaattacatgtttcacaatttttagtcattactggtaataataataataatatgaatcttgcatgtatatagcattttgtagttttcagggctttcttatatatattttcatgcctagccctcaaaatagcctacattgaatgagtaacagctctgaggtttataagacgtacccagagtcatgtagtgatcccttctcttttcaggatattgactttggtgaatatatacaaactaaataataatcaataaccttgtatttgtggagaag

SEQ ID NO: 36267 - DNA, 1065 bp, Homo sapiens
tgaataatttttatgagccatactttgagagaaacataacttctccatttgatatatacaacaatgttaggatttggtaaattcgccataatctagagacattcttatcccaccatcaggaactattccaagggaagaggaagaggagaaaaatgtggttttaagaagcaaggtcctaacatggctctaagaagcaagtcagcccactaggtgaaaagaaagttctacagcttgatcagtggtactgttgtacagtatcctaacctaaagcctaattatgttttaaataaaccaccagagcctaaggacttgacccatgagtaaatgcaccactaaatgtgacatacatgataaaacactttaatgttactggaattgtggtttctcacattgagtatgtatatttagtgtaatgaatctctttttattcctcccttcaaagttactattaaattgagactacgtcttaaaactgatggtccaagaaaatagaaaaaacaaatgacaaagaacttcaacccagcctcagcttatacaaaaacgaacacaaaatagatcacagagttaaatgtaaaaaataaaactataaggaaaaaataggagaaaattctttaggacctatggctggataaaaagttcttagacgtgacactaaattccataaaaagaaaaactagtaacttggagttcatcaaagctaaaaacatcttctctgtaagatcccttgtgaagaggatgtaaagacaagctacagagtgggagaaaatatttgcaaaccagaaatctgagaaagaccttatgcctatagtatgcaacaagctctcagaattcaacagtaaaaacaaatcaatccaaatagaaaatgggcaaaggacatgaatagacatttccctgagaaagatctatagatgacacataagccttctatagatgctcaacatcattagccattagggaaatgcaaattaaaagctcaatgaggtatcactaaacacctatcacacaggttaaaattttaaaatagtaacatcaaatactgacaaagatacagagaaatggttcact

SEQ ID NO: 36268 - DNA, 1256 bp, Homo sapiens
gttcttttctgtttttaattatttttatttctcatagtcattctgtttgtttattctttccttaagacacttaatgattttataccttctgttttcattatctgtgcctctttaaatttttgtattccagcaggataggcaccgactcaataattgcttgctgaatgcgcgagtgaatactaaataaggattttggccgttttctgactcagcatttcaaacagtagataatttacctttctaccttgaattatattctaatctaaggaatcattgttttgcttgtgtttatgaaaagccattgtgcatgaattcagcaaacttaaaattctgctacatataagttattgggtaatagggatgtgaagtatgatgcctgtttaaggaagtcacaggctagcagaattctagacaagaataaaagtgttaaaacatataaaaaggactttctccttgaacttttcaaatttctgaagaaaattacaaaagacaatacaatttacattattaatactaggacagactctcttgatggcattaaaagtcaaaattcgatttgaataactcactattttggctttatgtttatatgctagttatataacccatcttaaacatacttctaaattttgagcaaataccatcacagtcattatggaactcatatgtgtatatgcctgttatatttacatatgagcatatagcatgtgtgatgtgtctatatatctgtatttaattattgaatgtgaattacagtaggtgtttgaagaactgcaatgatgaagataaaaatatgttttatattttgaacaaaattatagctttccctagggcattgtgtgttttttttgttgttttaataagaaaccatagaatttgaatgggtgaaagtataataatatctgcatttgaccactgaactgtggtgctgtctaaaaggtgttttacagacactcagcggaattggctctgacagcagcccactcagccaagaaatttgactgtcatcttcatccacttgctttccctcacatggatgacctgtaaataattgtgtcttttccttagtgaatgatgacaggtccctatctatcaaattgcactacataaatgagatagaagccattgaatttagaaacagatgaaattaatctaatgattcattgtttttcattttcttgggcttctctcttgaatgtagaacagtttcttttgcagaattgcacagttagatttgaatagttcaaaatatgacc

SEQ ID NO: 36269 - DNA, 1047 bp, Homo sapiens
taagcactgtaaaatgtgtcattgagtgcagtagcaatgtttagacataaattactgataggctaaaattaatagcatccattccctttttccactttaatattgtaatagattcctatcatatcgcatattgggatagtataacggatcaatttttaaaacacagttggtctctgattctaacttccagtcaccaatttggtgagtatgttccttggctaataatattaaggtacttggattaaaggtgttaataggagttccttagaaattgcccaattctttgtagactagtgtcaactttaataaaatagaatgttacagttggaacccttttgactgtttcaacagaaacaaatgcatttttcctcacaagactagtactttatgttaaatacagtagcaatattataatgcagcgttgtatttagcacagatccagaactgtgaaatcggaacatcttggtttcaaatctcagctctgctacttggtagtggtaataaacattggttaaatgatgtaacctgtattggtctgttttctcatctgtaaaattgggctactaatcttggcagcttgattgggccatcatgaagggtagatgaggtaatataagtaatgtgtttggtgtagtgtctggcatgtagaagggatagctattatttttattcatttattgataaagtatatattaatcattcactatgtgccaagcactttgttgggcatggagaatttggtatgaataaaacagacacacactctgcttttatggacttactgcctgtctaaccttattggagcaaaggaacagtgggtagtttctgtgatgctatttatcaggctgatatttcttaatcaccattctaatttgctttttcattatgtatcattctaattactatattaatgtctgtccattgcattgaagttcacataggattgtctgaatttgggaaaatattctatgggtttatagaacaggtaatagtatttgaatatctgactcatactgaatgcattttgaaaggtaaggaccatcccct

SEQ ID NO: 36270 - DNA, 1023 bp, Homo sapiens
gtatctgagagagtataacctgaagccatacctgggcatgttttagatcaagcttgtccaagctgcaggccacaggacagctttgaatgcggcccaacacaaattcataaactttcttaaaacattatgagatgttttttgcgattcttttttttttttcttttagctcatcagctgttattagtgttagtgtattttatgtgtggcccaagacaattcttcttccaatgtggcccaggaaagccaaaagattggaccatccctgttttagactgtgatcttccttagtatgaaaagattggctgtgattttagagtgagttctatgggattacataaaatgtttgctttactttgtttttttgtttgtttgtttggtgttttggaaattacacagaatgtgaagctgtaaaataatccttcaaaaacaatcaattgtattaaatgccatatcaaccatagtgtcaagcctatactagtgctgggtatactagtcttcctgcctgtaggagtttattgtattctagtaggtgagacaagcacaaaaggagtgtgtttataggcaataataataatgcatactggatctgaagtctgcagagagacaggagcgtacaagtatacctgaaagtggagaggtatgaagtctgggaaaggctttccagaagttggacccagagcagggtatggaagggtgatcaggagctcccaggccagagcaggagggaagacaggttccagacaaaggtaaaagtagatgcagagacacgggagtgaaacagcatcttagacacaaagaactttgggtcatctgacgttgctggaatgtgaaatgcatagggaaaagtggcaagaaattagaagagaggtcaaaggtggggagcaagccataaagatccttgctaggacttgattcctaaagcactcagaatgctcttcagtcaagctgtaacctgactggattttcatttcctaatgccgctcagtcttgggcttgagtacatggaaaagctactagccttat

SEQ ID NO: 36271 - DNA, 1050 bp, Homo sapiens
aaactatacaatagactcaattaggcagtgattctgcatggaggaaatgaatcctaggagactatatagaatgaggaagttcacactgatgtcttccaaagcagacacacacacacacacacacacacacacacacacacctcacatatattaaggttggcacttttagaaaactaacacattttgtaagttctctttatttcttatgcattataatttcttatatgcgttcactataccaaagctataaacatcctgaactttctataaccattgtttaagcaaagaatatgggcttgaaactaagaagcttactagatggaagcaaaagtctacacaattacatttaagagttctgaatttgagtgtctcacctctttaatattcaaagtctagatgtagtgttgaaacttacgtctgttgtattgggaagattcagtgtcttaaattccaggcagaattgaaaatcaaaatctataataacagtatgtccttgttattatgtattatgctctagacaacatttatttggctgcagaaacagcctttaacatgttttattcagtttgctccaaaatctcctcattgtagtctttgtgccctcatataatcaatctttctactcaaaggtcagcataagctactgtattcccaaggcagagagaatatgacaaaaatataatttattgagggaaaataccccatgaccccagatagttaaaggtcttcggacaccttctgtgaaacagtaatttcacagtggttttatgctaacaaaaatgaattaccattggcatgttttatcaaataagcagaatcaagggaacaaggttgccagttaaaaacacaatagtctactgtcaaagcctgctaaagttacagttgtaaacagtttatgggaagagttaaataaaggctgggcatggtagctaaaatttatatttcattgatttgttcaaaatagggcattcctttgatcctctaataaaacacaaataattttagtaacatcttcttaactaattccaagcactctctatgccactttgc

SEQ ID NO: 36272 - DNA, 1002 bp, Homo sapiens
ttctatcttctccttttttatatttgtctcgttttcttaaaaaggaagaaaagttgatttctgattgcttttcaatcaaatgagccctataaggggaagaaataataaagttcacttcatttgtgatccttgagctggtcaccatggtcatgtgttttatttctctaaggctagagaataaatattgtgggacagtaataagtaaacaatcaataaaccaaattgactttaacccgaagggaaaatcagttaagactaagtcataaaacaaattattaaattctaaaaagagatgcttttatttttccattcctcatatcctctcattaatcagttatgttccatggctctaatcatgttaacttggttacttgacatattttgtcagtggctaaactgctgctgaacatcctatttactctccttatattatagaaattgcagaacaataagcagtaacaagagctgggtttttttaggtaatgaagaactagtaatgtgtgtgggaaatgggaatttatattctggaaagttctgagaggtatttgatcatttttaaaaaataatagcacctgcctcattaagattttacaatttctaaaaaattagatacttttttttttctatccagtaatcttaaagcattttttaaaaaaccttcataggaccatttttcaatgtatatttcatctattttagtttttctcaccatattcctgaaagtacatcagagaaatttccatgctgggagcagggaatagtgagtggtccctgataatagaaaaatgtccattgatccacaaagcagttaatgcaagcacacaacttaggaactttaattggtggtgttattagattcccatgtactatgctgcattccttttctccacacattagctgctactatagttgtgttttccatataccaaactcacacaattgaattccttaaaagatctagagcatttgggtattttataagaatcaaaagttagggaataa

SEQ ID NO: 36273 - DNA, 1021 bp, Homo sapiens
gtgagccaagattgtgccactgtactccagcctgagcgaaagagagagaccctgtctcaataacaataatagcttaaacatatggattcaagtttttatttaattttaattttttttgagatgaggtctgtctctgtcactcaggctggagtaccgtggcgtgatcatagctcactgcagccttgaactcctgagctcaagcagtcctcccactttagcctcccaagtggtgaggactataattgaatgccaccacacccagctaatttttttatttcttagagagatagggtctcactctgttgcccaggctggtctcgagctcctgggctcaagcgatcctcctgcctgggcctcccaaagtgctgggattacaaatgtaagcctccactcccagcctcaagtttttaaataatggtttatctctccctgaaatactcttgtattttatttcctaaataagacgtttcattgtacaagcatatgaaactatttatatttaatgtgtggtacacgagaatttagcagtaatgaactgtattaatttttcttctgtgaggcagaatgccactgtgccctaacagatttggttgacttataatttgctttgtttattttactgagattggccctattacttggtaattattttctgattgaagatttcacctgggataagctgatttcactggcaagaattgaaaacctactttgaaacattaaaccaagactatttgtaaacatgacagaatctcttagcatcattttggaaagacttcatctccccttgcaccactttcttaataatatattcttcagtgaaatacatcatggctaaaccagttatcattttcatttcctaatggtcatgaaaagagattttataaatgttttctaattgtgctgtaaatgtaattaaaacgtaagcaacaggactccatagtcgtaagtaatttcatcattagcagcacctagtataggatgaggaaaaggaagaactggtggttgcccttgggtttgg

SEQ ID NO: 36274 - DNA, 1021 bp, Homo sapiens
agctactaggatcaataggtaatgtatatttaccttatttttctaaaagtattgtttccagtaatatgttctcaacatgttctcaactccagattttaaaaacaagcaatcaagcttgaaataattctatcatttgctatctgaatttagagcaactgacaaagttgggaatgacttgcccaaggtcatgggtaagaaatttgtatttaatttttaggctaacactggaaatctgtagcattaactagtcatgtattgaatcatttcttaaataataaccaagagaaatctgaactagaatttttaacttctctatcatcaaaagtgtttaaggtagaactcaaatatattttatcatataatttctttaataaggattttaaattgttcttaattggggattagaaaataattatccctgaaattgaggcctaaagtctggctcaaggctgaagttcctttcctgtcaaatgaagacagttatgtggaataattccgatacagttctagcattctctgattctcatgtcgtgatgagcaggaattggaacaataatcaatattaattccacttacatacacactagtcctaaatcaatgcctttattcttgatcatttcatcgtatagggaatagcctttaactacctgataattaaaaatatggtgacactggaagcaaaagtattaattaacttagctaatattcacagaaaaaaaccatgaagtttttctttaactatcctagaatttctggttaataaagagactcagatcctgaaagttttgaacacttggctaagtaatgtaagtgtgcaaagacaatttaaaataaaataacaataatgtaatataatttttccaaacattcagtactaagagaaccaggttgctcatggtgttagacttcatacatttttttacacatcatctttactgttttgaaaattcactaaaggtgtatattttcataaatatgttctagatatttacattaattttccttcttgaaaatttccagc

SEQ ID NO: 36275 - DNA, 1023 bp, Homo sapiens
attgttgtgcccctttgaactaacttcctcatatctgttggtaaaggaagtgagatgcttaactttcagttctttgctttgtattagtggagtgtttgccttgctcattcttttaatgataatgtactgtgtcaaccaggatattaacttttaatttaaatatgcatctagaaataaaaactaagtgctaagcaagaggctaaatgagccttaacgtcataaaaatctgaagagttctcaattaaaatttccaaagcattgtgctttcatcagatgttaggcaaagaatgagtcacaatatgtgggtcaattcagcaaacttgaaaagagtctcactccaagatgaagtttgcttttcctttcagtaaacaagacttgatattacaccaaaacatataaatatattctgtgttgacacagtaaactgaaatcagtttataaatctctcagaattttcattaaatagattattatcacaaagattaattttgggtgaaggaaataatatggtctgttgactcctgtgtaaaaagagattcctcttcacgatgaaggtcaagttttacataagggggttgtgcttctgtttgtgcatacccactccttatctcctcttacatttcagttctccatcttctactattacattctttagagatgtttccatctgaatgtagggactctgtttttatgtctgtgcagggaagcttagacagtaggacaataaagaaaatggttctatcaaatgctatcaaaaagctgtgagagaaaaatacacattgtcattccccaagtcattccccctgtaatcaaaggacagacttgtggtccctcattatctgcttttatacacacccttcggacaggcatattttttgtcgtcttctgtgtggcagctcatatggaaaagaaagagaatgatccccatccttccataccaaaagaaaaaaaagtgagcccagatttatgtcatttttccaaccttcacagtgatgattaaaatgacaatacttgagctgaaaa

SEQ ID NO: 36276 - DNA, 1032 bp, Homo sapiens
atgagctcaaattactgatttcaagtgatagaaagtgattgaggatacaaaaactttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttccacgatttactgagggccttttgtgtgtaaagcactatagcaggtctaagggaaatgagactgcacctgaccttatagccttataaggagagagggggaaatttacatacataaacacatatacaaataagtatatcactggtatataatatcaggactaaggaaatgggatttagctattggtaagcaaccactgggttcatatggagtccctgtcaacttattttgtctctttcctaggatcagtttatgtttgtacattctagcatctgcagggttttgacatgtcatttccagttaaggactcgctatgagttgctcatgttacctaatatttaagtagcaaggggattccattattagttgctttacaaatgattcacctagacattcagacacaaacctaggcttacttgttttcttttctcatcaaagcagctggaaaagaaatgaaaagcagcaacagcaagggggagtttaaggattttatgcagacagataagaaaatatagccagctcaaggggtaataaaatattataaaataaatagcaattgtttggcatttgtagagatccaagtgacactactaagtggcattcatatcacactcatatactaaagaaggttcctgtccccctagttttatgtctttgctatatatataattattggtaagttctgtttgccctggaataaagacgttgggaaagatcatgttgttaatagtagctatcacttacagagcagaaa

SEQ ID NO: 36277 - DNA, 1070 bp, Homo sapiens
tacataatacttgggagcttttgtttttcttctttaatagtagcatctatatggctctgtaggatacgtctctgtctgtttttctattttatttttaaataaaataatctcccctttcccatccccaccttctgactttatcatttaagaatttacaaggtaacagacattgctgcaaactttacccaattctgttattgtttgctttttttcaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagtgtattttccagttttt

SEQ ID NO: 36278 - DNA, 1025 bp, Homo sapiens
attgtttcggaaaacttatttgtttataactaagtgttatttaatgggctccttacatcaccttttgatagtagagggcagagtatataagaagaaaggccaagaagtacaaaaagactttgaaaaaatatacaattaacctgtttctaaaataaatgggtattttcttccacccagtaaaccagagtaagtctttaaacaagtttggtctcctaagagcagtcagtatccacattcataaatgcatttaccttacaaaagaaaagggtagggattggggaagtcatttcatagagaaatgcagatgaccaataaaataataatgatagtaataataatctgtcttgcctatcatattggcaaagtgttttcttcgtttctgttttaaactggtaataaagtgtgctgatgagaattcattgagacaggatttcagtctatagtagaagtataaattggcacagtgttttgaaaagtaacttggcaatatatcaaaaacttcagaaaatgtacttatgctttgacctgaattctgcttatcaggatctaacccaaagaagtaatcagatgttcagggaaagattatctatagggatattcatagtggtattatttatagtagcaaaaattaatgattatcttaaatgcagacacatatttataataatctttatatatttagtttaacatttgatatattgctcttatcacattttgtggttaatagtaatacaggttaattttctatatcttagtatttatcatcaaaaacattctataagcaaataatttaaaaagttaggtaactaactttctttccataaattaatattggtctacatgacaaagctcacagaaccgctaacttgctgcaggggaaggggtgatttcctctcacctttaaagaatgattattaagttcttttagtgcttataatgcttatttttgaattactttttttttcagaacccaacacagatcttaataccatgaaaaggagtaggtcaaaattaagtacagaaac

SEQ ID NO: 36279 - DNA, 1064 bp, Homo sapiens
aaataacttgccaagctaaatgtcaaaactggaatgtggaactatatttttattgatggcttttattcaaaaaaattcattacaaattcattacaaaggcataacaggatagtggtttagagcaccagtctgtagccagactacctgcatttgagtcctactcctttacatcctagtggtttgatcttaagcaagtagcttaacctcaggtaagtcactcatctgggaaaagataataatagatgcctagagttattacatgtaaatatatgtcaagtggtcagaaccatatttacacatgttaacagagtcagcagattgtcatcaaattccattaagttagagtgttgctgctaaattttctttattgataagacagctaaggtttaatattttttaacatgaattctgagtcttttacttcctccttgatctcattactatacagttcacctttagacaatgttggggttggaagtgccagtccccctcacagtaaaaaaattcgtgtataacttttgactctgcaaaaacttaactaccaagttaagcctacctttgactggaagccttagcaataatgtgaacaatgaacatatatgaatgctcattatgaaaaaactatacacaaatttcaacttttttttacactaaaataatcttgtattatcttgttatgacatgtctgaacaggatttagtttgaggcactaacaagagtaagacatcagtttgaagagagcccctgcgaggggcaacatgaattctgctaaaattgaaacaagaacaaacagcaaatttatggtgaagcttaagtgaaaaaaatggtgaaatcattgacactttacaaaaagtttataggaacagtttcccgaagaaatcagcagtatacaaatggataactcgttttaagatgggacgagatgatgttgaagatgaagccctcaaaggcagaccatccacatcaattttgcaaggaaaaaattaatcttgttcatgccctaattgaagaagaccaataattaacagcagaaacaatagccagtaccatagacatctcagttg

SEQ ID NO: 36280 - DNA, 1062 bp, Homo sapiens
tatatccagtagtattgatggaattgtttgtgaagaggagcgatacatctcttacatggtcctttttgacatacatagagggtataaagatcatgagtaatataggaactgatagaaagcctgtagttggagaatagtagtaagtattggataaaatgacagcagatatggttgaagagccagtgccttgtattctaattggattgggaagccatttaaaggttttaagcagggaaatgggtggctttggttattgtgtggacagcagataggtgaaagtgggtatgaggaaaccagttaggaaattattacagtggtccaaaaagatgtcatttggactagggtggtagctgtggatctagagttttttgggcatatattgaattcaggctgcatttctaaaacaaaaactgaacaacttcattattttaaaaatcagtgcttccagggggaaaaataattacatgtatttactaagatgaaaattaaagtctgccaaaatgttttgttttcattatcccaactcttattatccttgtaagaatctgtaagtaatataattaaaatcttactcagtatattcccctttgtaatttttaattattcagaatggatggggtaaaatctttctgtagaattatttgtaaagtttgttaaggaactaagattataaataagatttcaggaatatgtgtaatggggccttaatttaaaaagatatttttgtgtcttcttacatattaattacgttctggaagttactactaaatattacttaattttatctatttattagagaagacctagcaaaatctataactgcaacactgagttagatattaaatggtgttcttaatactggagtatcacaaaatcacaagatcaattatctgttcacctaatgaaaattttcagtatttaaactcatcatttgtgctaacttacatttagtgaaactcagtaatgctaatttatgttttcccttatcaattttgaaaaaaatacatcttttcacatactacctcctaaacttgcacacatgcatgtgcgcacacacacaca

SEQ ID NO: 36281 - DNA, 1034 bp, Homo sapiens
cctttcccttttcttccatttttggtagtagaggccagctttcaatcattaacagtaatagagatgtatactggtgagtgttctaaaatacttcactttagggatggttttaggaagtaggtcttaacttaaaaatttgcatataaatgtgtccgattatgagaattgataatacttcaaatgaaataacttctccaagtggtaaacgtcagagacaggaaaatgaaggtggtaatctccttttatattctctataacctgctagaatggacaatgctgttacctcagaatgcagtagagaacctgaataaattctagtttaccccttcacccttaatgatgtttcattgcttccctggggcaaggatttgaaatcttaaaatagagattaaagaattattctaattagtaaataagagtttaggggtagatctcaacactatttagattgtagaagacttgcaatgaatgatttgaaggtaatagaaatagtagtgacatgtttgttatgaaaggataattttagtagaatatttacaaaaagataatattttaaggtttgttctgtggtactcttgatggattcattttgtagttagtgaattcagttcatcagagtgtattactgaaggatattaatgaggcaaaggatattagattctttttccagttgtgctaatttctaattagctcttctgtatatcatggatacaaattgtacctcagtccctctagctctcttaaaatttcatgcaattagttactaacagaactagatgagaaagtaaatgtacttaatgtggctcatagaattggataaaccttagagataatctagttcattggtcttcaaactgtattcccaagagtctttggaaattccatgaggaagagaaagatgctgaatagttagggcttgtgtctttcatggctgcttcaaccagagtatctcctttggtctattttatttaagatttcacttaagaacagctttactatttaaagaaaaaatcgtagaaagacacagttgagga

SEQ ID NO: 36282 - DNA, 1037 bp, Homo sapiens
cttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaaca

SEQ ID NO: 36283 - DNA, 1047 bp, Homo sapiens
tttgctttgtgattcaattttaagatcccttttacttaatagattagtgtagtctgttttatgtaatgtatctttgcttttagattgtgcttgctttttttattgctttaaaattcttttgtctttctgtaacaatactttccactgcaagtaggaaaattccaattgaaactggtttaaatcatcagaaaatgtattattacacatttctgaaggtccaaaggtggggttggcttcagccacagttgcattagccatattgtcatcaaaagcccaagtgacctcccttgtcacctctggcatagtataaactttatcccaaagttgttttctctcgtgttaacaataattgctgtcggtttcagtgaggactacatattttttttgttcatgtccaacacaataaaaattgagggaagttctgtcccaatcctggaatattaatattaagccatctacttcagtgtgattgagccaacttctttgatcatctactcacccctagataaatagaatactccaggagattcccatgaccttactgaccctagagcagatgatggagtcagtttttccgaaaagcctcagcactgttgacattttggaccataaaattctacatcataggaagctgttccatgcatagcagcatgtctagtaggatctctgtacctagctgtgaagtgttgagagtcagttaaggtaagtagctgaaatgaaaataacaatcacatctttattcacttactatgataaaattataagcaagagaccaaaaaggaaagtagggccagctccttgttgttccatttttcccctaccatggactagcactggacatgcgtcaatcagacgacatgcagtccaggcagaggaaattgtttcactgctaaggagcaatgaacaaaaggttcctgccatcttatggacctcaaggactgcggacagggagcagggaagggttagaagtagaaaacaactgagtcagagtggagatgagtgtctcagtcaaggcccaccaatagcgaggtctctgtggaggcacct

SEQ ID NO: 36284 - DNA, 1028 bp, Homo sapiens
tctcgccgaccctcctcgtcctggttgcaacccgcgtgcgaggccgcccgcgccctccgagtgtctgccggtgcagtgggggtggactggccggctgtggccgtgtgtgcgcgtgtggattggggcccggtccgagccagaagcttaagcggcagatgtcgggcattgccaccctcgccccacctgtcgcgggtggactttggggcaggtgggaagcggaggagaggggtttcgaggcgggtggcagtcagacctccagcaacgcggccccattgtgaagctgccaaactctctctagtggtggaatctgcaggtctccgccagaaaggagatgggaacgcgaagggaatgatggccccgtccttttccccttgctagtgttccacacgcttagggactccctgcctctccttccacctcagttttcaacccagtgggttactgatttgggtggaaccaagatttccgtgtgtgtgtgtgtgtgtgtgtgtgtttgtgtgtgtgtggtgcacaggtaaagctggagctgggaactttttatttgagcaggaagaatggaggcattttacagtgtgcttgccgctcctagctgaaagaacaattcttgcatatttctgatgttactagactcattttccttttttttttttttccgaagagccaacctacaatttagggttgttagttgttttattttctcaaatcctgtaatgctggattgacactatagaggtagaaatgacccttttgcaaagtttattttcccagtcatttcaaaatatagtattggttattacggcagaagcttttggccgcgatttatgattacactattaagtttaatgaatgtgtcacagaatcctcagtgttttaattatgtaactgtgaatgcattataaactgaaaagtaaaatgaacaggatggaatataagagttaatgaatacagagacctgttaatttgataataattgatgtatagaatatgcttttgctaacagtttatttaattgcaaatgaaagtgttag

SEQ ID NO: 36285 - DNA, 1043 bp, Homo sapiens
aaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagc

SEQ ID NO: 36286 - DNA, 1055 bp, Homo sapiens
aataatatatatatatatatattcattggataggagaaaaaaaggcaattcagcctttttgtaatttacccatccctccttagtggaactatcacttgatttagtatgaaagtgttaggggtgagaagacaggaaaatcatatgatgtaacattcattcttccccattttctcagcagttacactagtggtgcttcttaattttaagacttttctgctgcttcatacctgataacaaattgtattatcaaagcctgtcacaaaaaaattctgtgaaattttaaatgccaactccataagctatataaagtttttccagtttagatatcaatgtgataaattatactgtcaaacactttttaatacttgatgacataaatagctttgaaaaactgatgatttaggattaattacctccaagttctcttgactagcacaatattcctaactagttcattttcagaaaaagtatttctccaatgcattagaaaaaattgctccccacattctactccaggccataataggaagtagaaaaatcctgtagatccaaaataagaaaggttataaggcaaaatttctacaaacatattgccaacatgtatatctgaatgttgaacaaagcctctttccttatagatggaagcacactgttctcgctatttttgtagatccacctcaatgaataacagcaaaatatcttatccagataaaagatatgttttctaaatattgaatgatgaatggcctatagtccatcatgtgttccctcctagagaaggtaaccagccaagggaaatatttcattcctcagagtctaaacaaaacgtggaaaaaaatcaccatgaatggtgggaatccagcagaagacagagaactgggagaacaacagtgctaggaaacagaagattttaagaaatgaaaaaataagttggtcatccgacaatgtagtctgagttagttgctagggattgaatccaatacaatagtttagatcttaaatatatttgaaatatttctccagatcaaaatatgctgggtttttttttttgtcgt

SEQ ID NO: 36287 - DNA, 1029 bp, Homo sapiens
tgttccaatcattgtgtttaattgtgttttgtggaatcaccactttttattgattaataacatttttgatagatttcatcttttcttgttcaactgtaataatctatatgtttacaatgctaaactcaaagttgatttaaatcttagtttctcctctcttcctaggtgcagacttcaaccttagctccagaaacatgcactgaacgtagtgccataatttactctactcttccctctttcccattccaggaacttgatatggaaaggcgtgtctggtggggtatgcctctgaggataatataccctgccacatatgggctctatctcaaccattctcaatgattggagcagcagacatcttttagtaaacattctagaaattcatgggtactttaaaaaatcagttatcaccattactggagggcactatgggcagtagtcaaggttggaagaaagcctgacatttatgaaatacttagtcacaataattatcctgcataacttcattgggactatttgaaacacaaatacatattagtagtactttagcacaaaatagcattgaaagttttacaagaatatgaatgaaaatccagtacttgaggagaagattgttgtgaaatacaagagttaagtattagaaaaccattcctgattttattgaataaattattaatcctgtatattctgtctcttcaatgtgcaattgcagtactgacatattggctctgcatcaatcatatcacctttgttttatatttttcctttatgattggtgatacattatagatatagtctagtgtcccttgatgttttgttgataatatttgtaaagaacaccatgtcctacaaagtgttttgaaaatctatcaactgtagtgaacaatatttactacttattttcaagattctttttattttgaatatttaattttttctatatgttattcttattgcaatgaaatataagctaatttcaaagtcataaataaaggattatatactatttgtaataaaggatattgccta

SEQ ID NO: 36288 - DNA, 1029 bp, Homo sapiens
agttaagaaaccaataaatccccctgccttcttgtagcttagattgtattgtgagtgtgtgcttgggcctctagatatctggcttgtataacagaggtagtagtaccattcattgaaatgggaaactgataaaaggccagctttgggaattatgagttcagtaatatattgacttttatctacctcttgcgacatctaaatagaagtcacacggatgtttcaacattcaagtttggagctcagtgaaaaaagtttaagttgcagatttaaatttgtgagtagacttggttcaggtggtaattgaagttgagacataaaagagattacctagggagaaagtacagagtgagaaaagaagaaacctggaatcagtagagcctagaatcacattaccatttaatgacctggtagaggagggtgagcctgctgaagaaactgagaatgtgtagtctgagaggttggaggatagtgtggtaggggaataaatgtttcatgtaggcatacatggtcaatagagtggaattgtgttgagacgtcaagtaagagaagtggaaaatgtgtctgttagattggtgaaatggagtctgttggtttcctaagaccatctgctttggtgtagttatggggtgacagccaaataagagcagattgaggaatgagtgagagtagagaaaatggagacagtgagcatatataactcttttaggaatttttttttataaagggcaagcagtagctggaacagaatatgtggtgaagggagaggttcatccttctctttcttctgctctttccttcctttatttcctactctcttccctcctttttttccctatctctctctcacacacacacacacacacacacacacacacacacacacacacacgtaaaaactgaagggctgatgggaaagaaccatttgagaagggatggttgacagtacctcagagatccattaggttcttgtaaggtgtaaggttcttaggaggtcaggaagcaatgagatccaaagttaagtagagtggt

SEQ ID NO: 36289 - DNA, 1065 bp, Homo sapiens
gtatgagcagatcaatcctcaaaagtttttaagagatttgtagcatcaggtgtaggccgatgtgaaagattagaatctagaggagcctaacccacagagcgaagcactatctacccatctactcttactcaagtgttttcactgggtgaagcagtagatcagagaaggagacttgagagatacttcagatgaaatcctcaatacatcagaatggtggtatgtagggtgtgtttctgatgaggggtgtgggcgtggggaggagttcaggcagaaaaactgagtactctaggctttcacttacaaaagaatataagagccccttcccaaactgattctctgtagggaattctgggtcttcacattctagggcaatggcccttcaaagactaggctggggaatgggtattagagctgaaagttgtcttcttaggtacataaagtagtgggtgagagcaaagagacttctctctcccacccgagaggctgtaaagctgggagagatctcctgtatttcctaaagctggtggatcagctttgaagctgagggaggatgctagaatctcatcatggctcagctttatttctagatgaaggaaaactgatctctctcaaagtatttgaaggctgtggcaattgatttaaactaaaactgtagcaaaggctagaaccaacttattaactacagctccaactctccagcagcctgtcaaaaaaaggagtgggtatgtccatttcttgaggaaaatattcttgaattcagactctactgttcttttatacaaactgtctggcctacaatcaaagattatatgacacaccaaaaagtgagaaatttgacccataggcaagaaagtagacccagatcttggaattatgagatattcgttaatatagccgttacaaaaatgcttagggatgtaatactttcactctcattataaggtattccttgtctcacagtttattagtttaagtcaagtagaaaaatttactgttgtatcgttatgtccctaaattgtattaaaagcagaatcttagttaagataccttgataatctaatttat

SEQ ID NO: 36290 - DNA, 1045 bp, Homo sapiens
gcaacagtttagacattgcttttcacagtattatacttttaaaatgaattagaattacatataaaatcaagttgtaagaaagaataaaatataacttaatatttataaacttttggacatggagataagacatttagaggttagaaaacccacagaaaataaaaaaggttaatgttagcaattttgagtatctaataatattctaatctaaaatattaaaagaataattccaagataataagacaaattacgaattaaaactagtgcttatcatacaaataactcataaaaatagggagaaacatactacaaattcagggtttaaatggagagtggacatgggctgacaggtcacatgagagtgactaaaattgtttttaaaaataaatgtaaagtatgacaattcaatgtaaccatatgtacaaatatagctctgaatagattttattttttgaaacatttttagcaaaatttaaaaagctggaccataacgggatgatatctttacagtaaatagtaatataaattgttctactctttgaccttttaatatttttgttttttcgtgcatttaacctgatagtcactatttgtttctttccactttttaaaagtttttttttctctctttctttttaaataggtttctggggagcaggtggtgtttgcttacatgagtaagttctttatggaggttgtgatttctgagattatggtgcacccattacccgagcagtatacgctgtacccagtgtgtagtcttatatccctgattccctcccaccatttcccacgagtccccaaagtccattgtatcattcttatgcctttgcatcctcatagcttagctcccactcatgagtgagaacatacgatgtttggtttttcattcctctgttacttcacttagaataatggtccccagttgcatccaggtggctgcaaatgccattattttattctgttttatggctgaatagtgttatatggtatatatacaccacaatttctttatccactcattgattgatgggcatttgggttg

SEQ ID NO: 36291 - DNA, 1037 bp, Homo sapiens
taaaaaattatattcacctgtatggatagtgtggctctggttcatttgtttcaactgtttttaatttttaaatagatttttaaaatttatggatgtaacacaattcatacatttttctttaaatggatatttttatttgttttgcttttaattttcactgacacaaacagaacatacagaagattcttctagagatgtgacgtatgtgtgagagtttcttttattttgtatacctagaagtagagtaccaagaagaaagggtctgcatgtcgttaattttattagatgttgctaaggtgcttcccaatatgtttgtaccaatttatactcctatcagtatggcaaaagagttttcatttatgtacacctttaccattcttactattttttttttttgccatcctggtaggtatggtttcaattatgttactagattagattatattttttgattactagatgatttaacatcttttcctgtgtgtattagctcttctgttttccacttctatgtattactgtttaaatttgcttcaatgtgggattatggattgatttttagtctcttttaataagtaggaggaaagccctttactataactgtctaatttcactacatagcacacagtagtacagctgatttggggcattaactctgcatctctcttctctgaaagtatttattttgtttctgagtccagcagtttttttgattctttctctttatatttttctgcattgctatgtgttggacgctggcatagtcttttaatgtatatatttactggttaatgttgacctttttttcataaagatgatatataatatatatataagtttatttgagactaaattgacttaggaaaaagacacaaatggaagaaccatagtttatattaaaatgtaaaacgtgtttatcaaaaagcatcataaacagaattttaaaattatttgccacatatttaagcagacattaatttatttaatatatagagtacatttgttctaagaaaaacaaactctctagtaaaaaaaaa

SEQ ID NO: 36292 - DNA, 1021 bp, Homo sapiens
ctacaagtttctagtggaaactatttctgtttacagcttgaggattgctgtatagttggaattttgggttagttttaatcaacggcattttatttaaaactattctgtaggccagtgtgaaattttctttcctacttgtactttatgaactgtttgaaatacactgataaactttgtggtgtgtgtatgtttacttacaaaggtatgttactagattgttagatgtcatctgtaaagaatactctgattttgaagttaaggggagtcaggattgacatacttgatattaatggtaatggcattcatttatggttttattcttgatgaatcctactgccaaatttgtttttattcaggtttatttctaaaagttggctttgtgccattgttctttgatatcttcagaaagtaaaaggaggacacactttttattgccatatacttgagtgaaagcccacaatttatggggagtttggggaacatttcttaatttcgtatgtcattgtcaatatcagaaaagatatattttggaggggttaggtagaatatgatttctttttctaattttcaactctatactgattctcttcatgtttggttgctctaacacagtgatttttgtttatcatggagtaagctaacaactttacaaattaaagtatattagaccacatttattttattaatcagtcagagttttgcttatgcattgaagacattgatatttccagtgtttcacaaatgtgggcagttgactactctatgccaggggctaccaaaatgaagattatagtcactgccctcagatggatagaacaaaagttaacaataatgcaaagagatagtcaattttgtgataaaatctacagaattctttgggagtaatatcaagagagtctaatatgacctgtcagtatggggacgatgatgggaataatcagggaaactttgcagaggataccctctgagtgagacttggtggatgggtgtgtcactgaatagaaggagtaagaagattcca

SEQ ID NO: 36293 - DNA, 1031 bp, Homo sapiens
gtgattagaaactaaaggaatagtttcaaagaagcagtggtcagtaatgtaaagtgctactgaaaaatcaagaaaaagaaggccctgagtatgcatagcatgtaaccacaacgaagctagagcagtttcaataaagtaatgggggcaaaatcatattaatattatggagggccaagaaaggaggtgaagtaatagaaacagagaatggggtgatatctggaaggggctcaaaggtaagattttttaatgctcagatgctaatggagtccatggagaagaggaggtagaccacacttggtaagtaaattatgctaaactgagacccagccagttatttctcctaggccataaatcacaggaatatcatagtgttttttgaaaactgccaagctatgtggatttcatgcttgttacatcatgatgaagcttggtatagccccttactctctccaaaagtcaatcagaactgtagacttactatttctcaatcaatcaaaaatatatacacaattaaattgaatctgatctttattaccttctgagagacacttgtgtttttaaatctgctggcagttcagtgttacacagattttcttagtgacggtttctatgaaaacactttaaaatgcaatttactgctgtgatcagtaatgggggaggctgtaaaatttccactgttctaaattctactccctttgctctgtcatgcctggactgtcatttttgtaaaccattgtcttcttgttggaattttctgctggagtgtacattgctgttgctagtgttttattcgatcactggcgatgagttctgttttttttttctgatatcgagcatttcaaactgttccctaatgagtctgcctctgtgctccagtgctgttaacttcaatagatttcctattgtgaggatatgcttccaaaaaataattgacttattttccttagtgactttccatttttatggaattttcattatttctaaaattgtggattttagtttacctacccagaacttctctgatacaaatt

SEQ ID NO: 36294 - DNA, 1096 bp, Homo sapiens
tctgttctggtaccagtcccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcattggtagcttgatggggatggcattgaatctataaattaccttgggcagtatggccattttcacaatattgattctttctacccatgagcatggaatgttcttccatttgtttgtatcctcttttatttcattgagcagtggtttgtagttttccttgaagaggtccttcacatcccttgtaagttggattcctaggtattttattctctttgaagcaattgtgaatgggagttcactcatgatttggctctctgtttgtctgttattggtgtataagaatgcttgtgatttttgtacgttgattttgtatcctgagacttgctgaagttgcttatcagcttaaggagattttggattgagacgatggggttttctagatatacaatcatgtcgtctgcaaacagggacaatgtgacttcctcttttcctaattgaatgccctttatttccttctcctgcctaatttccctggccagaacttccaacactatgttgaataggagtggtgagagagggcatccctgtcttgtgcccattttcaaagggaatgcttccagtttttcccattcagtatgatattggctgtaggtttgtcatagaaagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacatttattgattagcgtatattgaaccagccttgcatcccagggatgaagcccacttgatcatggtggataagctttttgatgtgctgcttgattcggtttgccagtattttattgaggatttttgcatcattgttcatcaaggatattggtctaaaatt

SEQ ID NO: 36295 - DNA, 1033 bp, Homo sapiens
caggatatgcacacatatgcatgcataaacacacacacacagagttgcagacacactcacacagtgctaaacagatcacatcagcatttctgaatctgtagtttagatacactagtttgcaaccttttaaacattaataactgtcttggaaaaccacataagcattgatatttgttttataaaggcaattttttgattaagttttaaattttttgtcaagtgcagtggctaatggctataatctcagtgacctgggaggctgaggtaggaggatcaactgaacccaagaattggaggctatagtgagctgtgatcatgcccctgcactccagcctgggtgactgggcaagaccggaactctaaaaaaaaagttttttttaggtctttaggtgttaccttacttcttgagcatgaaaaatatttcgtattttctaagaaaataattttatagttactcagattgtttctgattttaagaatttatcccatgtgtagttatttttgcttttttgttacttgttttgggaatctgatttttttcttcattttgatttacttaattttgttggtttttgcccaccttaccctcctagaacctgtttatattttaccagtttttactcttgacctatctgctttcatctttcctaattccttctactcactttcactaatgctaaatgagccagtccacttaataagttcatctgtgtgtttaccttttagcaatagtctgactagcttttatgtttttatatgctattttctcattattgtatttttcctacatatttaataactgtactactgttttctttttgacttaggtatgttagaaaaataattttcaatttgcaagtgctattttttcccagttatactttattataaactagctttaatgtcttatggccatagaatatggactgtatactctttttttttttttttttttgagactgagtctcgctctgtcacccaggctgaagtgcactggtgtggtctcagctcactgcaacctctgcctcccagt

SEQ ID NO: 36296 - DNA, 1023 bp, Homo sapiens
tgcatctaggtccttcaagtgcactgagttggaaaatttgtgtatgtttgtgaatatacatacagatacctgtatctatatttttatatttcctcatgaaaaaccataagttagtaccgatatctcctgttgtaatgcaatatcatagggtacattccagtcttccacatttgtagttacttatcttactgtgaaaattctggctcccttgttctcatttgttcaatcttagaatacatgaaagctgccttcagaattgttaaatccgtgctaccacaaaaaccaaagttactaaatagagttcaatatttctttttaatttttggatgtaaattacatatgtgaaatgcacaaatcttatgtggtcagttcttttagttttgacatatgctctttttgagttttgactgtatactcttggtcccctgtagatcctgacttttccttattgtcctttactggctccccatgtctatgttcttctttagtgttgtttacaaagttctagttctctttgttgtcttgtgtgttactttgtgttacacttatttgaatgacagcctctgcaaactagagtcaagatctaatttaactcgtttttgtaactgtggggtctttcatcatcttaggtaaggtgcttaaaaggtgtttgaatgaaaaaaaatacacacagcaatattacttatgtcagtttataagttgtaagtagacactttatttgagaatcccaaataattaaaacatcagatttttataatgctagatgaacaatcttattctaaccagtacatttattatctttttcatttttatttttttacattttatcctctgtgaaattgagatatatctttagtcagtagttcacattattggtgtgagccagctatgagaaatcactggcacctttgtaggtagagtgaaagcaccagcatcataatgacttaagatttaatgaaatatggtatagttattttggcctgttctgccactgtatcataagatgatttggggcttttgtaa

SEQ ID NO: 36297 - DNA, 1032 bp, Homo sapiens
aaattgataaaactggaatattttaggacttacctgataaatttgaacatgttgctttttaaaaaatgttttcgaattaagttgagcttgttcacgtgttcgagttcttaatgaagcagttattttcacttattaaaaatgtaaatttttttgtctttctgttacgtaagcagtacatactcattgctgaaaattggaaatccatacataaataaagggcgggggctatttaaaagctcaggatcatattcgcaaagatagcttttaactactaggtaggtcctccagtctcacttgttggtaggcttctcacctctccaggccaacatgtgataacattgtagttttaattaaaagtaattctgcatcaggaatcagtgctcattttccatatcttattcgttttgtttttatttttgtttcgctttttgaaaattactttttcttttcctgtgcttctttgttggtgaaaagtcccattgactgactcattcttggtaaacatggggtgagactgtagattctcctgggttgcacatcctctcctcaccataagaggaaattttctccaagagtgaatttctccagtgtttttataagtctatgctccacacttcctttgttcttccatcccttttttactccgttcttctcacccagcctctgcagctaatatcatggtatctctcagtgaattctgttacctgaattgggaacagttacggcaggaactggcagccagggatggacatagttttggatgagccagctgtaacttttacggctgctcagtttgtatccctcctggtcagctggcgctggttcatgctggggctttcctgtctctgctatgcttagatagaagaggtagatagagactgagatgtgtgagtatcttccttcagacaggtggccattaaataccgctggggtatatgtactggaagttaaaggggctgctgatttagcacagagctaaatcagcattactttgtgtaaagtaatgacattttgaatattttttgggaaaac

SEQ ID NO: 36298 - DNA, 1046 bp, Homo sapiens
ttttctttatgtttagaacttgttctgtttgaaaaatttttgtttatcatttggttctgaagctacattcttatgaagctatcctctagaagcttaattgtcttgccttcaacatttaggtctataatctatctgaaatggattgctgtgaattgtgtgagggtagggatcaagatacattttggcttatatagatatccagcaccatttattgaaaagaccatactttcttccacagcaccacagtgtcatctttgtcattaatcatgaatgagactgcatttgtgtgtgggtctgtgtctacactctctattcacttttattggtctgtttgactcatctcacactgtcttaattattaacactacagttttataataggttttaatatctgatagtaaaagtcttccagtttgttctccttcccaaaattgcattggttactgttagtcctttgtaattctacataggtgtaggtcatcttttaaatttctaccaaaaaaaaaaaaattgaaggggattttgagtgggattgcattgaatctttggtttgatttgagcacaaataactacaattattgggccatctaatcgatgaacgtggtgtattttgtgtattaatgcaattgatttttgcattttagccttgtatccagtaactttgttaaatttatttattatttttagttatttgtggattctttatggatttcctatatatgagtaatggcatatatatgtcttcctttccaaagctttaaatctttccatctactttcttaccatgtacaatggctgtgtcctctagtataatgttgagtaggcgtggtgaaagcagacataattttctaagagagaaaacattcgttagtcataatgtttgctgtagaattttgtagattccctttatcagattatggaattttccttatattcctcatttacagagtgttttttcatgaccagatactaaattttattattttcttcttctaggacattgctttgtgttaggcctttatgtcttgtgcaatgattgaaccagt

SEQ ID NO: 36299 - DNA, 1049 bp, Homo sapiens
cttatctaaactgctctgggacattgccaagaaggaagtatttttatcttggctcataccaaaaactaattgaaatattttcaaagggtatactttattgttaatactaattctgtagcatgctatagatttctaaactttgaagttcaaaatggtttttattgtctaaataaaatcctttgttttatgtttgaggaaagtgagactcagaaatatttagatcgtagactattttgtcactcttattatttatactttcctgagctcatctgtatctgctggatatgaagttaatgccatatttccttctattcgtgactcatttcttttatggttacacacacacacgcgtgcacacacacacacacacaaacacacacagtcttcttcctagtaatgcttgtgagtaataatactcttagtgttagctaaaacatattgagtgcgtattatttgctgtaaattgcttaaagtactttatttaacttatttagttatctgaacattttctggtaggtcctatgattgttcccattgtagatgaggaaattgaggcacaaatagattaacttgcccaagatcactctctgtttggtgaagccaagatacattggctacaccaaattgaatacagttgaaaattgcttatctttaatataaacataaggatttagaaataatcatctattttgctgtaaaaatatattgcaccacaactagattacagtcacttatatttgccttatcagtatcattgttgtaaatgttccagtcgcaattttgtctttgcagtgaataagtgatagctaaatttataccattattggccagtcatggttgtaagtttttttttgtttgtttttgagatggagtctcgctctgtcacccaggctggaatgcagtggcgtgatctctgctcactgcaaggtcggcctcctgggttcacgccattctcctgcctcagcctcccgagtagctgggactacaggtgcctgccaccacacccagctaatttttttttgtatttttagtagagacggggtttactg

SEQ ID NO: 36300 - DNA, 1032 bp, Homo sapiens
tattagtattctagtacgtaagtatacttttaattgttaatgtgttccctcaatttaatattatattgattagctaatataatgttttgaatagtattgtttagatatttacattgcttagctgtggaaatagtttaaatattttttgtttactatatttctgtttttctccttacactaatttttttttttttttttttgagacagagtctcaccctgtcacccaggctggagtgcagtgatacagtctcggctcactgtaacctccacctcctgggttccagtgattcttgtgcctcagcctcctgagtagctgggactacacacacgcaccaccatgctggctaatttttgtatttttagtagagacaggatgtcgccatgtttgccaggctggtctcgaactccttacctcgggtgatctgcctgcctcggcctcccaaagtgctaggattacaggcatgagccaccacatctggcctccttacactaaatttctaaaagtaggaatcattggattgaaagacagactatttctaagttatagttttttctgattataaaattataaatgctagatataagaaatgtataaagtatgaaaaataattataatgctgccacctaacaataagtattgctaatattttggtaagtcatcaagttatttttctcttctttcttgccatcttttatagatgattttaatattcttttagtatttacatagaaaagcatagatgacttattatagtttaattgaaattattacttttgtgtttttttgtgttgtcatttatattttcttatatatttacccctctttgtgctcttcatttttccctgcaatctcatgtttccctctgatattattttctttctgcctgaagacttaacgtttctttcagtacaagtttgctggtaacccatacactcagtttttgtttctctgaaggcatttttatcattttctaaggatatttttgctggatatagatttttaggctggcagtatttttttgtttcctcacc

SEQ ID NO: 36301 - DNA, 1033 bp, Homo sapiens
acctcggcctcccaaagtactggaattacaggcatgagccaccgcaccggcatgccctccagtttttctctccccacacgagggagcacgctttttggtttccttagactggtgctaagcaacagttaaaagggtgatgccttttgttttctgttctctctctcctgatccacccagtgggggaaggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattttacaaatacaggtataaataatatatatgtgtactcttctgacttcacacattacagatataaagtaaaattcctctggcatctgtgtctgtctccatccactcttcaggagaggaattcagatatatgtgcaagcatacgtgcaccacacggtcttacaactgtagaaaagtatagtattgtgtttgtgtcgattttcagcatagtttatcatgctatacaaatgctacatttagcttttttcttctgatgtttctctgccaagagagacagttacctcattcttctcatttgtgacacagcattccataacatgggtgtatgtgattttatttattcatttccctgttgaagggcatctagtatgtcttcccatttttttgttcctagtgccagtatgcagtgaacatgctggtgtgtgcctcctgggctcaccattatgtacatctcagctaggtacagtggggaggaactgctgtgcaatagagtatctgtctttaatattaaatatgtattactttcttggcttctaaggtgagtgtgccattttaaaagagagttttgggttgttttaaagagtttttggggtctggaagcctcttgtgctttatttcactcaaatagctcttgcaggatatcagatttcagttcagtgccctctgcccttaaaaacaaaaaca

SEQ ID NO: 36302 - DNA, 1050 bp, Homo sapiens
gccacaccctttgccctcctttggtcctctgcccctgaggctggcctcctcttcctcacaaacgaattctcctggatcaactccaaaaaagacatctgccttagctatggggtgcatagcaggaatttttagaggttttggtgtctcaactgatggtctgagttaaaaaggagattggattattaactgttccctgattcactttggcagctctattttcttgatttaattaattaattaatgtgtttacttgtagttttgtgttctgaaaagagaagcctttcagcataagcatacttgggttcaaacttggttgtgccactcgtaatctgaacaacttaacctctgtgagccctcagttttctcatctttaagatgtgtagaagaatcctgtatgggacacataggctaaaaaaaaaaagtttccttccttttcctttttgaacacaggagttttgtctgcttttcagatccccagtctagaaagtttccttcctataattttcctttctgctttccttctgctgacctaaaaactacatataaaagttagaaacactgatacaatttcaagataggacttcggaatcatgacataattattctccatgggatgtcagaaaagctgcaacactgcatgatgtagatattttcaacatccttttttattcataaaatgtgaataatggctacctctttctattcttctggaattgttagaataatagattaatggtattaatattaaatttattgtagaaatcagctttattcttatttcctcgactttgacttggaagtacaataatatttaactaagaagaacagactaacgaatgtctagtgagtaaatgaggatgtgaagaaagatagatgacttacctagctaattgtcatacaattagctttttgactcttcccggtttaaagttatgctttggtggttacaatgaggaggagttccttgacacaagcaggggtttattttgcagccttaacaggtgggtgaatgttaattttgcaacaaagatagacacctaagagacttac

SEQ ID NO: 36303 - DNA, 1050 bp, Homo sapiens
gactcttcatgatgaggatagagaaaaggtttttaaagtagacgtgtgaaggcagaagacaaagagagatcataatgtttgggaatggatttaatggagtacaatgggagcttgaagtgggggttgaagagtaagagaaagatgaaaaagtagccagagaagtaagcaggatccagattctaaagcaccttctaagaactgcacactactagatcttaaaagctacaagagtactgttgaaggtgttttagccatgaccaaaatatcttgaagacctttggattgtttggcaatatctattaaaatttaaaatgtacatgttctttcacttccaggaacttatcccacatagatgtgcacatatatatgcaaaaatatatatacaaggatgtcctatgacattgcatataatagactggaaatgattaaatgtccatcactagggtaccagtgaaataattatggtatattatggtgaaacaccttgtaacctttaaaaataagagggtagctctgtgtatactaatgtggaatgatctccaggatattttttatgtttcaagataatactacctgttaaaaataagcaaaacaaaaatatttctataacatacacacacagatatacttgtatatgcatggattatcccgataaattttaaaactgctgctgaggactgggatgaaaaggagacagacttttcagctgataccctattgcttctttttaattctatcatgtatatctattaataatatagataatatagataaataataggagtattactgatggtatcatgcaaaggggcaaaaccagagacagtgaaacttgtagtcaaattgatataaagtaatagtgttaagtatggagaagagcatggatttgtaagatactaagggagtagaatttgtagaacctggggactgattagataggaagagtgagataaaaatgttttctagatatattgtttggacactaggatgatgaagctgctatctagggaaataggaaatacagcagagaaggaaagaattggtgtggta

SEQ ID NO: 36304 - DNA, 1050 bp, Homo sapiens
ttattaatcccctctgatcctatctcctcatctatgaaatggagaaaatagggttattatgaagattagaaatagttcatgcaaagcactttgcatagtcatggcatttagtaggtgctcacaaagataatagaatataatggtcacaaaattatgtaattgtactaagtaaagataattcagaaattaggtactacataaatgtaatgtgtcagcctgcattagagttacttaacttttttaaaaaattgtcattcttatatactttgtaaagccttttttaatcctgttctttgtttccatatctattctctttcttttaaccaatcatcttaattttcttcctttaatttctcatgtttactttcataatcagttgtgcctcttgcttctctgccagccccttctatcagcacgtatgaaaacaccttgtatttttttctctcaaaccatcacagttgtttacactgtgttctagaaaagaaaatgttcaccattagaatatatttctcctacagattgaaaaaaattagaagttgattactgttttgaaaattgggctaattccagatgttttaaataacatggcttttgttttatttaagtttatttttatgttttagggaggttttacataaatggagtcctaaacaaataggagaacaccttctactgaaatcgtaagtatcaaaaaatggcatttttattgggcattttcactaatttttatagtattagaactggaaacaaatcttattaaataactgtagagaaggaaattagagcagtgaaatgttggtgggactataacttcaaaggacaaagtaacacagagtttaggaataaatcctgaaatatatattatctttaaaataaattcctaatttgaaaggctagaatcacagactaattttgtgtatgttttcttaggaagttagcataggtcttcaatttatttaacccagattttcaaagaaagtataactattttattgttaatcagagatgcaaatgtatttgtatggtgataagcaaacccaaaaaacctta

SEQ ID NO: 36305 - DNA, 1150 bp, Homo sapiens
atgatcgtaggcagaagcaaaattttattataaaatctaaaacaaaactttatagagttgaatctattccatctgacttcaatatttgccaaacgtttattttacctcctagattgatgttggtatagtatccttaatacagtgtagtatattaatgtccttaatacaatcaggaggtttttacctttaagcaaataaattatgtcattattgaaaaagacttaagggatgattagacttggcaatctgtaagcaggagtataaatgttttaaattgcattgtccctatgtaactatcttaatggctatatatatgtattttataaagccatttatgtatacacatgtaacttggaatttccttcatccctacacattttctacacttacatcaccttattgcataaaacaaagtcacgcgctttctgcttgaacatcaaaatatcaaaaaccaaggtacccaaaagatacaagtcagagacaacatccttgtccatatccaaacccagtgtttcagtgctagcaacttaatttctcatacatttatagagtttggtttgctttgctagttgtgtgaatcattgggctgtttttagagccactgttaagagagaatataaaataatcatgacaattactactgtttccacatttacaaattgtgtacttaaatgaacctcatttcccttttatttctgaatggcttgtctgagaggaaacaaaattaaaattcatctgggaatttgtgcctcttgtctagtatatagtcaccactaaataatggcttccgtttttattttctttcaggttttgctttaaattttgttttccaaaatagatgtacgtggagggaaaagcaattattcttatcaccttttatttaaacttctttagatgaatactgaagaaaaatccaaaccttaaaggaaatgtgcccttgtattttatgggtgaggggaaaaagtacatttgtacatttcaacatataataagcaaaaaaattactaatcagtttaataaaaacattttgtctattcctaaatgtaatttggtgggttaagcactttgtgtagtaaaatgatatgtgtctgctctatcattagacattttaaagtttcatgtcttcacgtgaataatcacagttgtatca

SEQ ID NO: 36306 - DNA, 1121 bp, Homo sapiens
tgaaaatagttagttacataaattcattttattgtagaataattataagactgataggctgaaccatacacaaataaggttgatcttgttttcctttttggagaaagagaatacaaattaacattaaaattgaaatgtagaaagtaaaatatgaataattttttacaaccactccaaattagttgaaacaaaatcttgaacggtcacgcacttaaatttaagctagccaaatatgttgcactgaattttgaaaagaatgagtgagataactgtaagatacgctcgttcccttttaaaaattgttatttttctttaacatgggtgccaaatcaaatatccatgggctatacttcttaagataataacagctcaaaataatattttttaattcagtagaactaatagcattatggaaaagattctattaaatgttccacaggcccactggtcctcttatataagccaaattttggccatggagcttgtgatacacttgccttacattgtagggtttcttaatttgagtcaagtacactgaaagcaattaaaaactggtaaatattaatttactatgtaaagtgaacttacgaattaacttactaaatacatatatgtagaccttcccgaaatgccattctcaattttattttatgggctccaaaaaaaattatctgggttaataaggttatctattaaagcccccagaatctcagcactagatgtcataaatatgaaatagtaaaaacaaggtcacttgaaaatgggtatttaataccttagctggtgttttcagaagcatacagaactggaaaggtaagaacttgcttactattgcagatatacctgaccactcacaactgtctttttagcagcagctttgttaaaactgcacaaagcattcactttattgattgagtacaaatgctttagtgtttctacctaagtattagtacatctgttcaggaaatggaaaaaaaaaatgctgcttaaatttgttttatcagctgaggttgtggaggatttttgtccactgatcttttgcaacagaaaagcatactttgtcagcttctaataagatagccaggtttgaattatttgcaaaatttatataagcaaataag

SEQ ID NO: 36307 - DNA, 1022 bp, Homo sapiens
tgtgatacagagctgtgatggcagggaaagttcaatatgtattcactaatgaaggtttcctggtacacaaggtacattgaggaaatccatgtttttccatctcacgtaatgttatgtgtatgtgactttgtggtattgtgtttggggttcactgacttttttttttaaccagtgtttatatcttattgctactaatgaactcagatagatttggtggaagaaggcagaaaataattatgagtccacacttgtgcgtctctgtacattttctttatgcttgtgttacttctggagtcgtgttagcataacagaaagcatctgggctagggcagagttatgggatgccaaggcatagtcatagttacagggtgccaagacactgtcgtattcatggcagctctgggaattacccctaagtctgtcgtcatacactttccaagaatggatctagttggagaagtattttaaacctcgtcagagtcacttgtcttggcttcttcagctgacttgagtggggactctgattgttggctgctgtagtatcatccgtgcctagagatacagggctcttgctgtaaataggatggcataaccataaaccatggggtgagtaccttcttatacatttttgtttagtatggagaagtgtggaggaacacaaagaaaactgcattcttccttgggcttttatgatatgaccagcattttcttacatattttctatagatcctttctcctaaccacctttaaatttaaacatacttttggggaacttgtggttgctggtagagttagtgtaaaaaatatcctatgagtcttataggtcccaaaaggacttacacgtaatactcagtttaagaactctacaatgatattcttagcagtaagctggtaactaacatagtaataataatactacaaaacaagttaatcataatgtaatgttaaccaaaagaacttgtaagaaaaactttgactctattatttgtgactcactacatttttcctggagaaattatttt

SEQ ID NO: 36308 - DNA, 1050 bp, Homo sapiens
aaatgaacaaatgtacatggtgcatttgctaaaatgcttagctacaattttatgatgttgactttattccattttgtgaaaaacagaaaagattagctactgagaggttattgagtatattatatacaggcttttctttcatttttcaatagtaagtgagacaaaaatttccattttaattttctaatttgatattcatatatgcacatggatatttcttcatctgagataagactgtcattatcagcttcatttggttacataatgacaagtcaactcactatttaaaccattcccaaataaatttcaattatttaaattataaattatctgtaatgttatatataagcattttcttttcacctggaaaaagcatttcagaaatctttttgtgtgcagaaataaaactctggtaaaactaccatagtttaagatctgaatattgaatctggtttatgaaaaatagaagctcagaataaattatcattgtcttgattattcccgcacatggatgtggaagtgactcaaattttactcttaaaaggtctgttttggaacttgagggcaagggcctttgttctgccttctagggtataaccagctctgctcctgcttcattaatgtctataagtttgttacaaagacagaaactgacaggaaatgaatttagggtagggggcactgacacccaaagggaagtcactgtggacaagaccctctgggaggctggcagagattgctgccacgtggccatggcagtgtgcgctgtgagatgatcccagatgtctgcacagaatcccttcctggaggtggagagggttgacacccttgtaaaacacagggaacagacctgctaacctcatttaatgccttcacactctgtaatgccagaaactaatattaatatcaaaatacaagttttaaagtgtgtcagagatgatgttcatgcagaatgtgaagaaattaacatattgagaaggaaactgaagaaccaaggggtcagtttctctcagcattcacagaaatcttcctgcacatcccatctactcc

SEQ ID NO: 36309 - DNA, 1044 bp, Homo sapiens
gttacagttacttcagttttggtaggagatcataaattccagcagccctgaaaggatggagatagtcaatgttactttgcaaccaatatagtttttagatgttaaaaaataaattatgaattttaaaaggctggccatgaaactcagtcgtgttttttttctttaagtttatgatacacaattttttgtgtatctcagtggcttctagactgcatgtaccatttcatatgttttataatatcactgcttctattgatgtttaagggaccaaatgattttataaactgcttcttaatggtgagaatctaggatgtgttataaggatttattggtatataaatataaaaactgtgatcctggaaaatttttaaattcagtactgtcataagtaatgtttgatcatttctcaggcatgggtaataattatttaaaaatttcaggatgcagtgtaacttggagaaagaagaaaagttagtatttggtaaaactatgccattgtagaatttgaagaatcaacttattctgttactttatgtttcagaagctgtaataatgtttttagggcattcctctgtatgcgttagttctcttaactgagattataatgtccataaaggcaagggttttccttttgctgccctcctacaggaataattctagtgctttgcacaatgctcagtgaagaaatgcttggtagtgttagagtcactgcatagccctggacacgtgggagtgcctacctttgtgttggaaatggacattgactcaaatccctgtaaatgttgcatttcacagatttatgcaatagtcagtttcattatgaaattaggagaatcaggcttgtttgttttttttacagtgcagcttaaatagttcaaaataatttgggaaaagtcactcacaattatagaaacctttatcttaatggaagaaataaaagacaacatatatactacattatattataaacaaagagcctgttaggttcatgtgaataaactaatacttaaaatttgtagctaaatataaaaacatttacggagt

SEQ ID NO: 36310 - DNA, 1030 bp, Homo sapiens
ttaaaaaaagaaaaataaatctctcagcaaagtaagaaagaaagggaattttcttaatttgacaaaccacatctatgaaaaaactacagctgatgtcatttttattgatgaaaaactgaatgctttcactttaagatcaggaataaggcaaggatatctgctcccactacttcaatagaatattatatttgaggtccaagctagtgcaattggaagagaaaaaggtaaagtttgaagtaaaactatttattcagataaaacatattttttttggtagaagtcctcagaattctactccccaccacccctacaaaaaaacaaacaaataaaaaactctagaagactagtaagttaatttggcaaggttttaagataaatgtcaccatacaaaaataagttgtatttatatatattagaagcaaacacccataaaagaaaattctacaatattattataattacatcaagaaataaaaaacaatgaactgtaactttaacaaaagacataaaagacttttactaggaaaacttcaaaatattgctgagaaataaaaggaaacctaaatggagtgatacacactgtaaatggattggaggactcaacattaagatgtcagttctctccaaattgatctatagattcaatataatcctaattaaaatcctagcaggatctttgtttttctttttttgttgttgttgttgtttggttttttgttgttgttgtttggtaaacatcagtgaattgattctaagtgttacaaggaaaagtagaataaccagaataccccaagttataattaattataagtaatctagagatgatttaaagtataagggggaatgtgcatagattatatgcaaatactataccattttatataagggacttgagcatccatggagtttggtgtcaatagtggatctgagaacaccaatcccccatagataactactgtaaaactacagaaatcagagtagtgaggcgttggcataacaatagagagaatagagtcctggcacagatcca

SEQ ID NO: 36311 - DNA, 1023 bp, Homo sapiens
atgcattaaattacatatcagccagcatcataaagtctgcaatttactttcaaatggttaaacaacaacaaaaaaaatggtttgtgtatgcacaggttgggggagagaggaaaatcaaatatggcaaaactaaacaattattgtagtatattattattcattctggtatttcaacatttcagatacgtgagctttctcataatgagaagtctgtggagaaacataattcaacattgagaccctgttcgcataattgagcatttcttctggctattcagaaagcatttcaagatcttgcactctctaaatgttatgacaaacatcagtgactcactgttataaatgtattgaagtgccagaaaatagaaaatgataactgaaccactttttattgtattgaaaaaaccctggatatttcctgtaacaatatccatttgtctcattgtgccattaatgaggataaagctttcatggtgttaactgtaaacaagagaggaaaatggattgaagtgccttttgggttgtttgtttcctttttttccacttagtattagtgattcttgtactgaagaagtcatcaattccctagacatgacattcatcctctcctcttgtgtggggatggcctaagtgccatttttgttccccatgcatgctacattatcttgtatatattgtctaatttgcttgtgattatcggtggaaatttaactttgtagtttgtaaagcatgaatcaagggtgaaggaaacaaggctaacttttttctttcatgcataagcccttcagtatatccactgtatgtgatatttgaagtagagtagaaagattttattaagttactttgggtctttaagggattttgacagacatggctagtggggacaaccagtgttttataagatgtaacctttttattgttgttaaatgatgaacttaaaactatatcaaaggaaaaaaataaattcgagaaagtgtcaaaatttgaacaaattaagcagttggaaacttcaaactggactga

SEQ ID NO: 36312 - DNA, 1024 bp, Homo sapiens
aaagcccttgttctgacagtacccgagtcttggtggattcatacaatttggtggtcagggagcagtattgacaggtgatttcgcaagcactagttttggagcattgttttcatagtccgtcaaatgagatatttgtactgatgatttgtcaagtctgcatgaatgattacattctctgacaccatctgcatatcgcatccaaagctctgagctcatgcttctcctagagccagctagttcttccttagcatttgcaaatctattcctggtaaacatgctgcaaatcaacactgttccaccccaggtaacatctgaggaaagcaaatagctagggcagagcaacataacacccatccttcctcagcagtggaaggcacctcagttagcactttctgcaggaaggaaatgtctgtggagtgttcctttccatatgtcctaagatcaaaccctggaatctgagaaaatccttgtgatgtgaatgtgtcatcctataaaattaagtataccaatcaggctgcaagaaagtgagtaaagtgcatgccaagtttgcctgtggtagcataaatgcgtcttagctgtttcctgaagataggagctggaactcttatggggaaagctgactgagcgcacacatttcacccttggcctactttgtttatcttgagaccactgaagcatttagtctagaccgtacagtgttttcagtgtgtcctgttcattctttcccaagcatctgttttttctcaagccccatgtgactcaccttacatggccttctgctgggatccaagaactcctgcgaatgtcctatcctgtgcttgggtcattgaagacatctgttaaagcctggggcctgtcctttgaggtgacttctcaagcaatatgaagttgaattttctttctggacagggaatttaaggcctttgcatatgactttatatgggattttagaattcagtgaagggaacggccagggagctcttgcctttggaactcctactacaggtctgccattctgggaact

SEQ ID NO: 36313 - DNA, 1027 bp, Homo sapiens
aaacccaaaccggcttcacttccaagaagtgcagccttggaaaaaggaggaggagatcatctccctgcctcgcgctctctctccaagagtgtgtgtgtctctctctttctctaagagtctctctctctccctttccctctctctcccgctagggtgctagtgaacaatgagctaattctgatggagctggcgcggagccagcgccccagccttgctgccactgtgcagccgcctaggagccagactgcttactcggcaggaatcggcggctctgggccccgtcggcgagcggccaacaggcgcgcgcgccccgacaccccgcacccgcgccccgggcgccccgctcgccgcgccgtccccactgcaccgcgcggcgccccggggagacaaagcggacccgcagctctgcgccccggccccgccccgggagcacggcgcgcgcaaatccccggccttcctccccgcccccggccagcctctccgcctcgacgtgcggttgcttttcagacaaataaggaggtggaggaggcggtttgggggcgcgccaagcgtgaaggcggccagggtgctgcacagcccggcggcccgccagggccgtggggagaggcggcgcggcccgtactgtaataataaacctgcagcagagggcatctgaggaaaagaggacggcgacgggcggcagccgccttccttttatgtgcctgtcctgagcgaagcagaaaatggtgcctgcggcggcgcggagccgcgctcagacacacaaagagtccgcgaaggatgcatttgcacacggcctcgggtcggaccctgcccctcagctgggtacgcgcgccccactcccttccgcggggaagcccggggcggggagcgcccctgaaggccgggcccagaggtcctgtggctgcgcgtgcacacacacacgtgcacacagtcacacgcgcacaaccagccagagctgcggcctggcgtgatcggcccaagacatactcccctggtgcttccttctccttccctatacgctccccca

SEQ ID NO: 36314 - DNA, 1036 bp, Homo sapiens
catagtactggcattctgcatctctttaagatttgtttttatgtgtagtaattgagttttttaaaagcttgtgaaatcgcaggcatattaccaagttcttgattaaaatgtaatacaaaaatatttgctgtcgaattgagtactttattttttctcttaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataagtggagggaatgtcatcacaaatgtaaaacttcactatgagatgagttccgtgataggattttcttagggaaacctgagaaagagttgagactaaaggtatgtgtcatatttttcacaaggcaaaactgggggaatgacatatacagaggcttgggctagaaaaaagataccgttagtccacttacttttgagacagttttggctgctttccctcttcagtgccctgttttagaactgagtccttactgaggcttgtaagatggctattatgggaggtgagagtgttacaaaatgaggctgaagaggtag

SEQ ID NO: 36315 - DNA, 1880 bp, Homo sapiens
atattggtcagtttttatgccagttggtgctctctgctgggtctctagtgttgtgttccttttcttctcatttcctcaggtttttatagcaaataacttaatctcttcctttgctgagaaaaatctcaaccatctgaggtatatttccacttcacttttttcatctcagtgtcatctctttatatatatatatctcagaggaagaaatgaccttctttcttttcaagagcaaccccctccctccagatgtgtccatgtaccctttcccatctttctttctctagaaactgtccattttcacttcctgtccaccttcttcagcctctccctctctagcctacatagatgcttgtatcttctgccatataagtgtgtgtgctgttcaactctaggaggacgttctaaagcttgagtctgctatgccactgtatttctattcttttctttaaagacttattctttcatcccaggaagctgttatagtaggaagaacattgacttttgagcaagatagaacttttgatctgggtttttgaagtcttttaaaaccactttagtagctgtgtaactgtgggtatgttactattcagatttcattctgtatctataaaatatgttatacttagctcacagggtggtggttaaagaaattaatacatgttaaatgtccatccaagtgtttggtacattgtagagttcttactaaatgcttctgtgctttgcactcgtactgcctttaccatttcaccactgaaactactgttttaaaagttatctgtgacctccgaatcaccaaatccaatgacgtttcctctgtcatccttggtttccttagacccaggggtccccaaaccccaggctgcagacaggtatcagtccttggcttgtttggtgttaggaactgggcagcatagcaggaggtgagcagcaggggagcaagcattaccacctgagctccacctcctggcagatcagtggcggcattagattctcatagtagtgccaaccttgttttgaactgcacatgcaagggatcagggttgcatgttctttatgagaatctaactaatgcctgatgatctgaggtggaacattttcatcctgaaaccatcccccacccaactcctgtcccatggaaaaattgtcttccacaaaaccattccctggtgccaaaaaggttggggactgctgccttagatcagttgtgaaatatactgtcttctgtagtcataaaacgatctagatttcttggcttttctgcattatacttcctgattctgtatttctcaggaagtttcttcacattttccttttatcagttaggctgcaaatgggatttaaaaatgaaagataagctgggccatggtgtctcacacctgtaatcccagcagttttggaaggcccaagtgggaggattgcttgaggggcggagttcaaggctgcagtgagctatgattgggccactgcacttcagtctgggtgacagaacgagaccccatctcaaaaaaacaaaaaaacccaaagagatgttttggctcttgcaattggcaagtacatagatagaagtggcttgaagagtgctttgtcatgtcatcagggctaagctcccatttatctgctgttctctcaacattgtccttgtgtttgggctttagacttcccttctaataaaaaaaaaattgccaccaatgatgttcatattatagccccttcatttatttccaaagaaagagagaaggccacttctcctagccttttcccaagaatcctaagctctagtttgattaaacaaacatagatcatgctgccaaacctgtaacaatatctttgtctagagggatggaattatcctaagtggcttagccagtggagtgaatctt

SEQ ID NO: 36316 - DNA, 1039 bp, Homo sapiens
ttgggaatttaagcatcacctggttcgatttaaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacttccagagttctgatctccactactaagctgctagcatagcttttctggtaactatttttaattcaaatataattcgagtgatctatctaacaagtcatcactctgacaactcagtgacttgtaatgtaaaattattcattgtaattcatttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatg

SEQ ID NO: 36317 - DNA, 1025 bp, Homo sapiens
aaactaatctattggtacaatatagttaactacatttatatggttttaattataaaggctttgtacaatattttaatatgttgttggtttactccctgctcttctttcatattttcaattttttaaatgtctagctgcagaaaataaacaaaagctttatatagtatttttactgggactgtaaaatttataagttagcttagggagaaatggcatttttatgttgctgaatcttggtataccagaataagaaacgtctttccatttgttgaagtctacttttctatctttctcatatatgttttggactctttttgtagtttatgcccagatatttgcattttttattgtaaatgggatcttttctttcatttatcttctgtctggtttctctcccctataaatgaatgatttctgtatattttgtactatactgtattgccaaattatattattataataatatttcatcgatgcttttgtatattccaggtatataattgtgttatctgtgaataatgttccctttctaatttttttctaattttattcattaatttgtgttgactaatattatgactaatagaatggtaccctgactgtaggactatatccagtgtttccacattaagtatgctgttggccttggggttgatagatcatgttaaagaaatgttcttttttattcagtattttcaacaagaatgggtattaaatttgtaaagtgtcttttcctcatctttggcatgaacatatgattttttcccatatctattatgttaaatgatataattaattttctaatagtgactttttcattgtaaattatatttttcatctcttttgggatcagttctgatagattatatcttctagtaaattattttgggttttcaaatttgtttgcatagagttgagcagagtcatcttttatgattcttttgctttcctgccttcttattcatattttcctcatttcatctaaaaatgctggaaaatatatctttgtttttccatgaaaacaa

SEQ ID NO: 36318 - DNA, 1114 bp, Homo sapiens
gatgaacctccagaacatgctaagtaaaataagccagagatataagtccatttatatcaaatgtccagaaaaggcaaaatttctaaagacaaaaagtacattagtggttgtctgactgtaagtggaaatgaggattaactgtaaatggacagcaggaattttattggaatgatgaaaatgttctaaaactggattacagctgtgcttgataaatctaaaagtcatttaattgaacacttaaaatggatggattttgtgatatttaaatacctcaccaaaattttttttcaagttctatcacctagagtagaaaaccttggagaagttgtaaagcaactatggaaatgaggaaactagttagaattaatctttcataatagtgaacaaccacttcttttgtcttcagtgtatcgaagcgtgcaggcaggcctgtagcctaggatcagtgaaagaataaaaaaaagtaattaggaaagaggagggaggaaagaaaatgaagatagtaaatgttaaatggtagtttgggttggaattgcctgggttggaattccagctctgactctgccatttactagatatgtgactgaaaacaagttacttatattctctgtgcctccatctctttatctataaaatggggataatggccgggcactgtggctcatgcctgtaatcccagcactttgggaaactgaggtgggcagatcacctgaggtcaggagttcaagaccaacctaaccaacatggtgaaaccctgtctctactaaaaatacaaaacataaccagcatggtggtgggcgcctgtaatcccagctacttgggaggctgaggcatgagaatcgtttgagccgagattgcgccattgcactccagcctgggtgacagggcgagactctgtctcaaaaaaaaaaaaaaaaaaaaaggcactttaatattactcaacatattcaaaacataattaatgatctgttcctcctaagccctctttactaccccaccttgcagcaaaaaaccttcatcctccctcagtattacctatctctgtgaggagtagcaccatcattattgaattgtgtgagctaaggaatgtaggagtaatactccacaccagacc

SEQ ID NO: 36319 - DNA, 1038 bp, Homo sapiens
ctgttatcaatagttatctctgagtgttgggatttttgtgggttttacttattcttttgtgtgtcgttttattttttgtaatgaacatgtattactataatttataacacccaaaacccattttcattttgggaaaatagaagaaagcactgtcttgatttccgttgtatggtagtttaggttgccatacttcagagtcctaccatgacatacatcatgtcatttatgtcagtatagggatggcagaggaaaagatctattgaaaatagtaaatcagggcccggtattcattcctcctttaagtgatgaactctgatagtgctgtgaattcagaggtaaacataagtatgtttgtttagcagtagcaatcatagacttgcccaccatattggtgtttgtatgacactaatgctgctaatactatctggttactttcagtcactgttttaaaacaatattgcagctattcccagatcctgatgtagatgtgtgacctgtatctgtgggactgtgatttgttattccaaaagtcctttcatctaaataggatctatacacatgatcgcctcttggggtttattagtttgttttgttttattatttgctcaaaagacaaaagccaccaacactagttgaaaatgaaaatcagtctctgactttctcaggatcacagtagcatgctctgccaaagttctgtcctagagtaattctcttcaccaccacgtgggaatgtattctaccgcttctctcacctggtttcctgcccacaatcattctctttgaaaaatccttcattggcttcccttgattcttagaaaaatgataaccatttattgtgacccaggtaacctggcccctacctatcttgtcagctttatgtcacatcttgctctcacacctccacactggccttctctcagtacctcatatttactgggccttctcctaccacagcctgtgcacatctatacctgttccatgtagtgtttgtttcatcccattttgctcagttaacaccagttcatgtgtgtctgagct

SEQ ID NO: 36320 - DNA, 1090 bp, Homo sapiens
ttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacata

SEQ ID NO: 36321 - DNA, 1026 bp, Homo sapiens
ctatatatactatgtttttgcctatgtatatatacttgatatggtttggctgctacccaacccaaaatctcatcttgaattataatccccaaatccctatgtgttaagggtgggaccaggtggagataattggatcatgggggcaatttcccctgtgctgttcttgagataatgagtgactctcaggagatctgttggttttataagtgcctggcgtttcccctgcttgcagtcactccatcttgctgccctgtgaaggtgcctgcttctccttgccttctgccatgattgtaagtttcctgaggccttcccagcaatgcggaactgtgagtcagttaaacctgtttcctttataattaatcagttttggatatttcttcatagcagtgtgagaatggattaatacatacctatgataaagtttataaattggacacagtaacagattaacaataaaatagaacaattataataatatactataataaaatgtatgtggaaattgtcagtctctctcaaaatattgtgctatactcacctgttttgggaccaaggtaactgaaaccacagaagtgaaaccacagatgagggatgactgcatagctttttcagtcctgacagccaaggcagctaaggaagaaagtagttgagaatgcatactgggtcaggtacagtggctcacacctataatcgcggcacattgggaggctgaggcaggaggatcactgaagtccaggaagtcgggaccaacctgggcaacatagtgagactgtctctacaaaaaaaagaattagctgggcatggtggcacatgcctatagtcttagctacttgggaggctgaggtgggaggactgcttgagccctggaggtgaggctgcagtgagccgtgatcatgctattccactcacctcagcagagctggaccctgtctcaaaaaaaaaaacgtactgtggtagccaactgaaaagatttgtcacagaaagatggttgaaatctggaaatggtttacttttggggcaataagg

SEQ ID NO: 36322 - DNA, 1068 bp, Homo sapiens
cagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgat

SEQ ID NO: 36323 - DNA, 1024 bp, Homo sapiens
cactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagtt

SEQ ID NO: 36324 - DNA, 1047 bp, Homo sapiens
attttatcccttttgaaaagcatagtatccagttctgagtgttaatctcttagtaaccatcttagcctaaaaccttctactctttactggtattaattcagccaaccccattgtcatattgattcatattgtttttgaaatttttagttctttttttaaacttacgattttattgaattaaattatttaatcatcatgtacttgttttgaatttttttgagcttgagatattctgtttattcattataaattttatcttaaagttagatttggcccgttgtttctgcctaacaattttttaaaaaattctaattgttatctattgcattaataagctttctctgtttgtcaatttgaggtgtctgggtcaattaccaagcatgtggtatgctgcaagggactaggtcaatatttgggtgtggttgttcaagcagttataatcctacacatcttctagtctaacttcttaaaaaataagtgagggttttttgactttttttttctctttgtaaatgtgtgttggctcctattgatttattttttaaagctcattattcttttttgttttgttttgttttgttttgttttgttttgttttgttttgaaacagggtctcactttgtcacccaggctggagtgcagtggtgctattgtggctcactgcagccttgacttctgggctcaggtgattctcccacctcagcctccagagctttggatttagatacttctaatatgccccagactgaatacttcatctcttctgcaaaacctgtttctcttcttttgttgaagagctggccaggctggctttgaacttctgggctcaagcgacctgcccacctttgcctcccaaagtgctgggattacagacatgagccactgtgctgggccctcattattgattttttgaaaaataattgatctccattttttttttttttttttttttttttttttgagacggagtctcgctctgttgcccaggctggagtgcagtggcgggatctcggctcactgcaagctccgcctcccgggttcacgcca

SEQ ID NO: 36325 - DNA, 1027 bp, Homo sapiens
ttaccaaaataaaaaatatgcatgtcctactaatacattaacctcacatatactacctaatatgtatctaaataaatgcaaattaatgaggtattattttttgaatctcagatgggcattgatgaaaatgtttaacagtatgtacaacatagaggaaaaacatgggccaatagtctttcatattttactgatgggagtatagattggtgtgacttcttcagagtgcaatttgaaactatttatccaaatctactctttgaccatagattccacttgtcataatttatcctgagtatgcttgcacacgtgtgcaaagatgtatgtttaagactgttctttgaagcattgtttataataatgtaaagtctgggaacagtgtgatgtccatcaatactgaagtgattaaataaattatagccacacagtggctttctgggtagctgttaaaaggaaaaatgtagatctgtgtgttcttatatggaatgagttttcaggatgcattgttaattgaaaggatacagaacatgcatctagtagtcttttgtggtaagaaaaatatatgtgtgtttgtgtatgtattttgacacaaatgcatcgagaagtctgggagaaacattaaaaaacaatgaatgattgttaactctgagaaggaggatttgtggggttcttggagtaaggagacaattttattttttttgtaatttggttattttactaagtgtttgggttactttttaattttcaaaagataacattaaaaagtatcattttcagtaaatatttatcttgcattttattataattagcaggaaaacatgaaatgctgactttcaaagaatgcctcatatactgaagactcatgtgcattatttctttactttgtaacttcatagaatgcccatgagggctttgttgttgttatgtcagttgttttcttatgaccaatagtggcttgatacattaagctggatgtccctgctattaatagtatattattgtgggtaaggctgggtgtagtggcttatgc

SEQ ID NO: 36326 - DNA, 1051 bp, Homo sapiens
tagaaaattatgcaagtctttatgatgacaggataaatggcattcccttggagctgtgtaatgcataatttgtatgactctaatcactgggcctgaacacagtgcttgatataagctcagtaaaattgattgaatttaaattaccaatattcattcatgctttgttttttgctcacttttatatgtatgctatttcttttgatttttaccataaccctacaagatgtatcaggtaggtgtccttcatgaatctcactgtctgaaataattgagacccagactagtgaagtgctttccaaaatgattgataagaggataagaaacagaataggatttaaactcaggtatcctgatcctggatcatttttctctttcctaaatcacattgcgtttacagtttattgtagcctttattcgttgtttgagtcctaatcttgtactttatttttaagggcagggcgatgtagacctggaatttgttttcgtctgttcagtagactccgattccagaatatgttggaatttcagactccggaacttttgagaatgccattacaggtaaaaatttatttaaatataaaaggcatttttttgggtgagggaagtgaggggccatttcaacttctatggattaggcctttaaaaaatcaatttgtaaaacaaaattattcaatatatattatggagggtggctatgtctataacaaatattttttctatataagaaaatttaattcataaaccatcaaaattttaaagaatcacttgaatatttaaattatggtacagttttaaaggatatatatatattttttatctatctatctatctatctatctatctatatttttttttttttgagtcagagtcttgctttgttgcccaggctagagtgcagtggcgcgatctcggctcactgcaacctccacctcccgggttcaagcgattctctggcctcagcctcccgagtagctgggattacaggcgcccaccaccgtgcccagctaatttttatattttcagtagagacagggtttcaccatcgtgacca

SEQ ID NO: 36327 - DNA, 1022 bp, Homo sapiens
ctcgaacccctgacctcgtaatctgcccgcctcggcttcccaaagtgctgggattacaggcgtgagccactgcacccggactccataccctatgtatcttatataagctggtggttagctctcagggtttgatttgatccagtgttttaacaagaatattttataggtggtgttgtgaactttatattgcaatacatcaggaagtacttaatgtctgtcccagaaagacccatactttaagaaagattatgaaattcctgactgcgatgtttgtggcatttattcatagaattttagaatataaaaatcttggagtttagatataatccttttattttatttaacagataaggaaattaaagttccaataagttacgaggcttgctcaggatctcatacctagttagttgtaaatttagaactgccatagacatctatatttcctgaccttagtatttttaaataatattccataaatcataagatcattgggactttggattgaaatggcatctgctttgtattataaacttatacataactgatctttgtatgacgaacttatatataactgatctttgcttcctccttcttgctcaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaaggtaagagtatctgaaagaaaatgtagtaaggaacagatttgtagcacatgtaatcctaggtaaataaaattgtaaaacaattagagtacttttctaattgtggcctcttctagatgtaagttgaagctagcaaacttgatacagtttgagtaaattttaaagtttttcctgcatgccaaatatttctagttattaccatcttggggtattttagaatgctttaaaactatagatcattcacta

SEQ ID NO: 36328 - DNA, 1027 bp, Homo sapiens
cgcggctgccttcctgccgcccgcggctgcagttagcccgggaggaggaagacggcgtggaactcgttcttctcgcccccctccgccgactcccatcctttccaggtggacttctttctgttctttggacagatgggctaccgtttttcactgtggtcctctcatagcacaggaactttggcttcctgcgtttgataactgcacgttctgtacagtctctcttctgcatgtttcgatacgtgacagactgcccagtgtgactttcaggtgtctccttattgaaaaggaagatatgtgaggacctaatatttttatcaggctttttaccagctggctgcaaattatttaccctcgaagtaaccggcgacgtttgtagttgactgattggagctgtggttctatacctaaaagttatgatttcagcttctggtttggcatttttccacgtatgggaatttgccctcatttatagtttttttctatttatgaagaatagtagcatttgtagaacttctcttttaacgtgtaaatactgtttagtatggacaagtgcaggaggcattaaggtagtagagataagtgatttgttgatgatcgaggaagggttttatagagttatgtgcttacctgagggcagaattcgctagctgaaacacataaaattggactcccagtggtaggattaatgtgaggtataactgttgtgtggtattgtggcactttgcttatagcaagaaatgagctttcaattcaattttgaaattgtgccaaggctaacacttttatgcagataagtcccagatggaaatcaatcttgccattacaaagtaaatgtgaaaatgtcagtttgcctaaaatgataatgcagtctggaggtgttagttgaagtgagaaatcttgagcttattcttcatttttttcagttgttttgcttttgctagctataaagaatattttctgctactcgtgtgtggttttaatttagtataacttcaatactaatggtctgtttaaaaattctacatca

SEQ ID NO: 36329 - DNA, 1008 bp, Homo sapiens
tagtttatcccacctaggggagtagttaattcattttatcattatgtcaagagagcattatatttttacagaaaaaaaattaatatagaaccatgctttctatttctctgtttcccatgactgaagagagtggtagacatgcacactatgttccaaaacactgtttttatttacctgagcctagccactagaattacaggaagaaaaacaggagaaagtgtaccatttcaaatttagtctcttattgaagagaaatgttgctattaagaaagaccaaaacaaatgtgtcttttcctagaggtaaatcagaagtattttatgcttgcgtcctgagattaagtcatcaccattgattattattttgatgctgttgttgatcttcttatgagaaagtagttctatctccaaaggggattagatggggagttttcaaagaacaaacatggtattaatatatcatatccaaagtaaattctgtcatgtactcgtggaaagtagaaactatcttttgtgttttgcaaaattttttatccatgcttcacacgttgatcacttgttttgatattagataacatacagaagaaaggatttcaggaggactttgtcattttccgattactaaagtaggctagagctgtttttacaatacccctgagttaccacatgctgatgtattgtgtcacaaaaaagaagatttctgtaattcaccttataggtactatgtctgtcactatcaggaacatgttggaagttctgtggttgtgatctttccccttcaattaccacagttcattaaatactgaagagggagtgtactgagcacacatgagtcagtcactttaaaaaacatcagttgaataaacaaagatggaagtgcatagcttattatttctgcttctgtttcatcaaatagctattcagagagaactgattttcttaatttgttcatcctctagtttttagaaaggcaattttaatgtaaaaagtaaaagtggaaaattataaacc

SEQ ID NO: 36330 - DNA, 1060 bp, Homo sapiens
ttatgaaaatagatatctaaatgggtaatacaaatgaaaaggtacgcagtcttatatcagagaagtacaaattaataccatcatataccaccacacacccttgagtatggttaaagttaaaagatggataacataaggtggtgaaaaggctatggaactacagaaactctcatatactgctatttaaagtctaagtgcgtataatcgttttgaaagtctatttgacactgtatactaaagcttaacctacacgactctttgacctagcagttctactccaagtatacaatcagtagatatgtgtatacgtatatatatgttcactaaaagatgtgtaagaaatgttcttaacagtactaattgtaatggcaccatactggaaacaacacaaatttatgtcaccagtagaatggacacactgtgatattctaattcagtggcatactgtacaactaagaatgattagctgttgtattatgtaataacctgaataaatctcacaaaaaataacaatgaataaaagaagccactcacaaaagagcatgtatcctataatctcattttaatatggttcagacatagataaaatgtattcatagtgttaggaagttgggtattggttacctttgatggttgataagtgactgatggactctgagaaggcttctataatgctggtaatgttaaaacatgatttgagtgttgattatacagaaaaatttatgttatatgttatgatttttgtacttttctatgtgtatgttacacttaagtaaatacttaggtgggggtggaacttaagtggctttattttccataacttttaactatgattttctaaataagtattcaaatgatttctaagttaaagactattttaaaagtaaatattttcttctttctcaatggaaatgtcaccagtaacttgagttgtttccggagctctggtatcatcccaggctgtctagtttctttaagcagatgtgcccattaataggggtctaggaaaagacctttcccagctgtttcatcagggctgccctggtaacagtgaaaattt

SEQ ID NO: 36331 - DNA, 1087 bp, Homo sapiens
gcacattaatttgtatttaaatctttacattgttatcattgcatgtgttcactgtattttttaatgtgtcactgttttctctttatagattagtatttcaaagtaaccattccataccaattcaaactaccatctggtccctaagcttgttatatgaaaatcttttatcattgtcttccattgtaagtgttttatgatgagctacacctgagttgtacattttctttttcttttatttgcttctgtatacaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaagcagatgttaatgtcgatttattttttactcatatttttaatattcagaaactcagtaaattattcggaaactcaattatttcacaaatcaagagcagtgtatcttaggcatatt

SEQ ID NO: 36332 - DNA, 1023 bp, Homo sapiens
tctcactttagtgcaaaaggtaataatctcagagacaaggctgttcttgagagggagcgggagtgctttgggaaagtaccacattggatcccagtataacatttctaaataagtccatgatagctatgctatttttctttagcagttttgttggaactgttgctgtttctttagttaagcactcagaatacatttatgtatcttttaacattggtatcatctttagcacacatgagatcctggaaacatatgagaccttggcatacattgactgagtaaacagcagattcaccttttccatctcacagtcactctagggcttacactttttcaggggaattgtggacttaattgtctgcattatttagttattctatttctggttgcagagtttatagttgaattaatacaagtgaatcatagttaaattcacataaatatgaagtttctattaactgatgacttgggttgtttgtgcattgtccttatgttttatttatatatgccatcagaatcttcagattctcatttctttgaatttaaaaacgctactattttcattaagaaagtctcctgtctgtttccattttctactgattttagcatcagaggctgttaggggagataaaagattcttaaatatatattctatatttgttagataaatgtatttttgtaaaaattttgtagataaacagacatcctgtgtattctggtaagaaaaagagaggatagtatagatgattgctgctaatttttaaattgacaaagtgaggaatgtgactatattggtttaatgagtgcctaatttgaagaattctaacatagttgttttttcccctccatatgtgttgattgtgattctattgctttcagccaaattattttaattagatttagattcaggaatgactgcctcccacagtttctactcttgtaggctttacttacactgctttaaacaataggggtttacctttatattaggagcattaattatctattaattttcctcatttagaa

SEQ ID NO: 36333 - DNA, 1153 bp, Homo sapiens
ttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatc

SEQ ID NO: 36334 - DNA, 1043 bp, Homo sapiens
ttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacatt

SEQ ID NO: 36335 - DNA, 1068 bp, Homo sapiens
tttcttcagggtaagtgtcccgagttttattttgttcctttgattaggccatatttccctattgctttgtatgctttgtgatttttgctgggcattttgaaagacaactacctcccctagtctttgcatactggctttgtgcaggggaagaccttcactaataccccagctgggagttctagggcctctcaaatgttttctgatattttgctccctctggcacctgcccgtggaactgcagctctaatatgcctctcacctctgttttcagtgccttccaaacgctggtgctgggcgtgtgagtgcccttctttaattaatacagaaaccagttccttgggaatcccccagaaagccagaatgttggatgtatggttcattcttttatttctgtcctgagggaggagctctggcatggggggtggtgggttcttcttggttgctccgctattccacatgggagagaggcatgcatgaatacactgaacactgtgaaattcatttcctaccactttcattggaattccttcttggttttataatggtgtgggtgctgtagcatctcaactggtctctcaagttctcacaagggtattctgatccgtatattgttaacttggtaccttagtggtggaaagagggcctctagctttctagtctacccctatagctattgttcttttaagaagtatgttttcgaagttacatttcttctctttcctcaatgtaacattttaggaaacaccaccttaaaacaaagcaaagcaaaatatagaaaacaagaacctggcttgactgccacctttaggggtacatcagatcagttgtttacgtgctgattcagccttcattctctcctatctttttggatggaggtgagagtgatgaacttgtcttgcttttctcagaactttagggtaaacctaggcttatcatccttccttaactgctaggagggcatatactatgtatagatgatgctgattaaatctttggagctttaatgatgtgtgacagccaatgaatttttctaatatagtataaaaacttcatgattttatatcattc

SEQ ID NO: 36336 - DNA, 1045 bp, Homo sapiens
tgtagggcctcctgaaaactgaggatagaaaaagaaccctgaaacaaatttggggacactctaggaaccaaaccaaatgagataatatcagtacactgcttaagtaagtatgatacactgaatgcaaacatagtaacacatttgtaaactcagtttaactacttgccagattaatttattgacttgacacctatgcatactttgacagccttacagaagaggcatgttctattccaattgctacagttaaatactattgacttgactgtctgcctacactcatgtacagagtttaattttttttaaaaaaattgagaaccacaaagagtagaggaaaagatacacagttaaatgataaaaacgttaacagaaatggacccaaagaaaaagttaacagaaatcgactccaagaaaagccaatgatttggaattattcaaaaggatctataaagagttagttaagttataagaaatagggggaaagttagaatatgtataaaaataagtgaagaattttgacagagaaaaaaagttataaaaattaatcaaataaaaattccacttgcgtgtgtgtgtgagaaagagaggaagaattatttctttcactttcaggaaaaataaatatgaaccaggattctataactagttaagggtatcttttaaaacaaaggtgaaataaaagctttttcagacaaacaatatctgagctaattcattgccagcatgtctaccttaaaacaaatattaaaggacattttttaaacagaagaagtataatccagatataaatttccatgtgcagaaagaaaaaatgcatagaactattaaaagaagaggaggaggaggaagaagaagaggaagaagagagattgaatattagagacttttttcccacatttaatctctaaaaacaattgctgagaataattaagggagacctaaacaaatggagaccactaccatgttcatggattagaaaactcaatattgttaacttctcattttttcccaaattgatattgtagattcaatgtaatccttatca

SEQ ID NO: 36337 - DNA, 1047 bp, Homo sapiens
agaatttcaatgtttgcccattttctcctttcctaattataattgatgaatgtaatgtataaaactcaaaaagaggctggtttattggcttatcagcactgactttgcagaaaggacaataaaaaacttgatgaagaagggcaaaagtggatcaaatggtgaagttatagacttgaaagatgtataaaatctatgattctaaaatatagtttcagaatgtttagatccttgtaaaaatatattctttccttttctttgtatattatggagtattcttgtgaggtggtggtcttcatgagagttgcacatcacaactaccattggatacatgtgcccaaatcctgctctgggaatttctacatctgtagctgtgggattgtgtctatgcacttatatgtcttgttctagagagggttctggtatgtactgtgattgaaagacattcctgcaaggcagtgtttcatgaaagcatattctgtaggtcacctatgtcaaaatcacctggggtgttaaagtacaggtttctgtgccccatcctgaagcttttgaacctgaatttttgggcacaggtctcggaaatttgaatttttagtaacatctcaggctattatttgttgtaccaaagtttgagagccaccacattaagagagtatgaatctcaatctgtaattgggctgtgaactcaacttagtgtaggccacaacccgaatttaaaaagagaatgaaatagagaaaatatcagagtatgtcacatgtaataaggacaaacataggttatatttatttgtatgtgtgtgtgttctgggtcagcatacattgtgtatttcttactgatttgcaggcagaaaaaaagggaaaaatttcgctttaagaagttgtaaggccataaattatatagtagtatcaaaatgttacatcttttattctgaattttcccacatactattatgatctcagatggggacaaaacagtaaaagagaaggaaatgtcaaatagtaaagccacagacacatttaaaattaactttttaactgtaataataaagt

SEQ ID NO: 36338 - DNA, 3066 bp, Homo sapiens
tagtgtgtgttactaaaggttaactgagtggttaaatatagaacatctgcattgagaagccagtttacttattttccagtttaatattaggtcttctaccagtaatccactgactcagtcctgtatggctactgattactcagtgaacttcagtgaccttatattcctggagcaaagttacttttaatgcagagcccatttcttattaatatgaaaactgttatgtttttcatcttgaatccatttataaagatatttgtgtgtgtgtttgtactaattgtattagttttgctaaggcattttatgttcctcacactcaaggcaaagagataaaacataatctgaagaaaaatatatacttcttcaaaataaaaagagtcttcttcattatgcagatctgggcatattgtacaatacttaatggctcaaggggatcaaagtaccagtttgatgctgattcactaaatagaatctcattcatatttgatgactggactgtttgcgggctgtgatagattgaaccattctggtgatatccccagatctcactaaataagaaaaggctctacactagaatatgtgacaattgatctggctataaattatgtctataggctctttattattataaggtggcgaaagaggcccctttcttgagcacatgtttaataaaagtattattgtcatctatagattgctggattgattttgtgttgttataatgaagataaggtgcatataccactgtcagattaagaaagttacataacttggccgggcacagtggctcacgcctgtaatgccagtactttgggaggccgaggcaggtggatcacgaggtcaggagttcaagaccagcttgaccaagatggtgaaaccccgtctctactaaaaagtacaaaaattagccgggcgcagtggcaggcacctgtaatcccagctacttgggaggctgaggcggaattgcttggacccgggcagcagaggttgcagtgagctgagatcacgccactgtactccagctggggcaagagtaagactccgtctcaaaaaaaaaaaaaaaatggagcaagtcccttttctgggttgacaattagtcctatattggcattgctgctggctatgaaactcaccaccaaaggtaaacgattaatttgaactacttggtaggtgttatggtaacaaatgatacttttattttttgaaagtccaagttttctcctttcatctgtgcaagggcaaaagtagataagaaactagatctcaaagtatgctctggagcattatcattaagcattacatttactggtttacttaaagtatattgcaaagaatacggataaagagatgtgtagggtgaggtgtggcggaaggggtacagagcttccatgctctccttaggcatgagatctccatgtgttcagctatccagaagctcggtaattcttaatttatagtaataacctgtttgtatttacttggttcatgaactcttttgcttatagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtactactgttatttctggagagctacttccttgtttatgtgggtactattttctaatacctctttatataattttatatgttctaacacttgctttcttgattctaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtaagtattctggtttttattacagtaatttagatttgctgacattatcatcaaagggtgaaattttaatatttgtaaatactttctaggtgcatactgcaactctcctagtgcatgctttgtagccagtgatggacaatatctgagattatatgaagcagttattgatgctaagaaacttttatctgagctttctaaccctgaaatttctgtaagtaatgtcttttaaaacagcttaagtatataatattatgttttcagatagtttatatttattgggcatgttctacaattgtgacctataatttgtaataagcatttgtatctttgttttattttttcacatttgtactcttgtaatgatttaaagctcctttaaaaggaaaccatttctttcactctttgaaagaaagtagagtctcatctcctgtaatatgtttctgtaacacttctttactcatagataaatgaggactactgacagtataatgtagaagttatatcggcccccctg

SEQ ID NO: 36339 - DNA, 1039 bp, Homo sapiens
ccaaaacagcatagtagtggtacaaaaacaggcacattgaccaatggaacacaatagagaatccagatataagaccacacacctacaactgtctgatctttgacaaacctgacaaaaacaagcaatggggaaaggattccattaataaatgatgctggcagaattggctagccatatgtagaaaattgaaactggatcccttccttacatcatatacagaaatcaactcaaaatggattaaagacttaaatgtaaaacctaaaactctaaaaaccctggaagacaatctaggcgataccattctggacataggaatgggcagtgatttcatgacaaagacatcaaaagcaatcataacagagtaaatagacaacctacagaataggagaaaatatttgcaaactatgcatctgagaaaggtctgaatatccaacatctgtaaggaacttaaatttacaagagaaaaacagctccatcaaaaagtgagtaaaggacatgagcacttttcaaaagaagacatacgtgtggcaacaaacatgataaaaagctcaatcactgatcattagagaaatgcagataaaaaccgcaatgtggcaccatctcacaccagtcagaatggctattattaaaaagtaaaaaaaaaaaaaaaaaaaaagatgctgatgaggttgcagtgaaaagggaacacttacacagtgttgatgggagtgtaaattaattcaaccgttgtggaaagcagtactgtgattcctcaaagagctaaaaacaaaactgccttttgacccagcaatcccattactggctatgtacctagaggagtataaatcattctgtggtaagggcacatgcaggcaaatgttcattgcagcattattcacaatagcaaagacatagaatcaacccaaatgcccatgagtgacagattggattaagaaaatgtggtacatacacatgatggaatactgtgcagccataaaaaagaatgaaatgatgtaatttgcaggaacatgggtggagctggcattcataaagcaacttc

SEQ ID NO: 36340 - DNA, 1029 bp, Homo sapiens
tttgctttttattctgtattataaataaagcagtgtttttaagaattgttattgtgttttgtgatacttgcatttataagaactgtgaattacctctttatcttaataaattcatagtaatgacttttttatgtctccaagttgaggaatggaaatataaaatgaacattttatttgtggtaagcatgtcatatattttttactatgagattgctaatgatattctagacataaagtttatttctgacttattacgctaaaacagatcagaaaatccactttttgctttttcttataaaacttgtgtaaaaacaaaagttctgtattcagtagtcagtgattatcacatgtcattgctaacattcctttagcaaagtaagcaaaacagcaaaatatcttgaccagaaaagacttgagcatattaaaatataaaacaaaataggtgatttaaaatataattgaatatgccaaacatttaactggtggtttattataaggaacttttaaaagactgctgaacttcaaagtaactaattctgtggaagggaatactttccttttcttttctttgtgaggcagagactcgtaccgtcgcccaggctggagtgcagtggcgtgatctcggctcactgcagcctccgcctcccaggttcaagtgattctcccacctcagcctcccaagtagctgggattacaggcgtgcaccaccacacctggctaatttttgtgttttttggtagagacgggctaggctggtctcaatctcctgaccttcagtgatccgcctgccctggcctcctaaagtgcttggattacaagtgtgagccaccacgcctggccaggagtacatttttgttagacttttcattgaagaccatataatataaattttaatttaaagtttaaaaagtgttctattcattcattttacaaatgagtcaggaaggcaaatttttatacaagagtagagaaagcgtagaagataaaagaaactccaagaaatgtgcatgtatagatttttacatgtaa

SEQ ID NO: 36341 - DNA, 1081 bp, Homo sapiens
ataattttaaacctgttgcttctctaattgaaatattccgtaggatcctggtgttaatctattgtaactatctctttctcctccagcttctaagggcagctctgtggaacccaagcaatgttcagatcagtttctgcataattcctttttgtggtaaaatataaataacataaaagttaccattttaaccatttgtaaagcagcccagtggccataagtacatttacactgctctgcaaccaacacaccatccatctccagaactttttcatcctctccaaactgaaactttgtgcccgctaaacaacagctccccattcctctggcgcccactccaggcaaccaccattctgctttttgtatctatgaattttactatccctaggtacctcatgtaaatggaattgtataatagttatccttttgtgactagtttatttcaccaagcataatgtctttgaggttcatccatattttagcatgtgtcagaatttcctttctttttaaggctgaatagtattctaatgtatgttcatacattttgtttatccattcgtcagttagtggacatttgagttgtgtctgtcttggttattgtgaataatggtgctatgaacattgatatacaaatatctgaatctctgctttcagttttttggggtatatacagaagtggaattgctagatcatatagcaattctgtgtttagtttttgatctgcataatctctttaaatctcttttagcgttaatatttggattcttttttcttcacatgtccagcccaatcaaagcatgaaatctttacagagtgtgacttgaaactttaggagatcttttaagaccatattcattgtgattttttttttaactataatgttatgttgtgaggcctttaacaaataaaattacattcatagcacatgcaagttctgtctctatttttagctgactgtatcatgttcctagttccttcccttcccagcttagatttcatgatccatcatggaatcaatcagtcacttgcaaacatccttatccctgttcttcctacttgccttgaaaattcccaaaccttctta

SEQ ID NO: 36342 - DNA, 1054 bp, Homo sapiens
tgagttggagtcttgctctgtctcccaggctgaagtgcagtggtgcaaacttggctcactgcaacctctaactcccgggttcaagcgaagctcctacctcagcctcccgagtagctgggattacaggcaaacaccaccacatctggctaatttttgtatttttagtagagacagggtttcaccatgttggccaggctggtctcgaactcctgacctcaagtgatccacctgccttggcctcccaaagtgttgggattacaggcttgagccaccgcacctggcctgtaagttctgttttttttatggttgcctttagtgatgatagtgttctatataagtgtattagtttttaagggctgccataacaaaataccacagactggtggcttaaacaacagaaatttatattctcacagttctggagactggaagttcaagatcaagacgtcaacaggtttgatttccctgaggcctccctccttgcctttcagatggccacatttctgctgtattctcacaagaacatttctctgtgcacaaccctggtgtctctccctcttcatagagtgccagtcatattagattagggtcccacccttatgatcttatttaaccttaattgtttattaaagcctgtctccaaacacagccatactagagatcagggtttcagtatatgaatttgggtggtacatttcagtctataacaatcgcctttataaaggatattagttgtcctcctttacacagggaggatcttttcaggacctgcagtctatgcctgaaactgcacatagtactgaaccctatataagctatattttttcctatacatatgtacctatgataaaatttaatttataatttaagcacagtaagagattaaccataataccgaataataaaatagaacaattataacaatatattgtaataagatttatataaaaatgatctttctgtcttcactttctctcaaaatatcttgtatactgcactcacctgttttcagactgcatggtctgtggtcacactgcaactgtggaaaccgaga

SEQ ID NO: 36343 - DNA, 1033 bp, Homo sapiens
tgcggtttgttcttaatacaagaaagacaatttgatttttaaaagttttgatttgtagaataatgtaagacaatatgtttctttctactttggtttttccattcaaaagcttacagatgaattcattcgtttaaaactgccaggctgagtgcggtggctcatgcctgtaatcccaacacttcgggagactgaggtgggcggatcacctgaggtccagagttcaagaccagcctgaccaacatggtgaaaccccatctctactaaaaatacaaaattagccgggtgcagtgccacatgcctgtaatcccagctacttgggaggctgaggcaggagaaccacttgaacccaggaggcagaggttgcagtgagccaagattacaccactgcactccagcctgggcaacaagagtgagactttgtctcaaaaaaaaaaaaagaaactctgtctcgaagtaaataaataaatttttaaaaaccaacctgatgtgaagttgaaacacaagacgcggaaataaaaactcagagtataaatatctatattgttaccattatctgggataattgatgatttataagaagctgaggtttcgtcttcctagaaatggacttttattaggccagcaagaatgaccacttagccatttaaatgatttgtcagcatcttttgctgctctcttctaagaccattggttttcactaaaggataaatacctgctaagcaaattataaaatactataagacatttaatctcctggaagaggacttgctgataattggatcaaagttccagcattattgctcttttcgaatcatatggacttagtgttctcatgaccgaggagtcacatttttagcttgctaaaatattcactggagaacatggtgaaatccacgagtggaaacgttccatggtattttcaaacgccacgtgtcaggaatttggcatgccttcctctgggagaggcactggagtgtggccagatggaacccagcagggtacagagggcatttgtgggagcagttaggaaacc

SEQ ID NO: 36344 - DNA, 1049 bp, Homo sapiens
ttctattcctttttaaagtctgtgtcttacctgttagcctttttacatgtacaccatagacaccgtgtttccaagttgcatcacacacactaattttttttttttttttgagatggagtcttgctctgttgcccaggctggagtgcagtggcgtgatcttggctcactgcaacgtctgcctccgggttcaagcagttctctgccttagcctcccaagtagctgggattacaggcgcctgccaccaagcctggctaatttttttttttttttttttaagtaaagatgcggtttcaccatcttggccaggctggtcttgaactcctgacctctttttagaagtggcatgtcacttctaccgacatttcattggccaaaggaaatcatttggctaagccaaaagttaggggcatcatttaagatagtctccaattttgtgttaatatgattgctatgttttatattccataatataaagcttatgggatatttaaatttggtataagaactgctaagccttaggctgatactgtaaaaagggacatttgcttttgtgtaaattacatctttcaggaaatgcttgtgcatttcttaagtaggttattgggaattcagtagttttgaggtttcctcagtaggtgagctatatctagttctctgaatagtaagttttattttgaggacataaacacaagaaggactgacaaaaaggagcaaaaagaactccttagtaaaagaaagggagttctactcttgaactgaagtaacacctttgggtaaattgaattacaatctttttaagtaagattgacatgacttttccgtgctacagttacataataatggtaaagctgagtcttaacttcctgtggcctgatgctagagccattgtttttaacccctatgggatcttgacagctggaaggtgaactgtagtgggcaaggtgcattgcctttgaagtcaggccaagttttaaatcctggctctgctgcctaattatatgacctctctgtttatagctgtcttagctaacttccgggattatggtga

SEQ ID NO: 36345 - DNA, 1091 bp, Homo sapiens
agtatagtacttagtaatcaagaatatatactgattgaataagtgaaactgatataatacagggagaaagatcataagaaggcacatgtgaattccagctgataataaatgagccgtacatgaaatacccacatctcccttggatacctccatgactatcaccaatctggattatgggggaaaacctttgaataaatttagagtagctcttagctatttgtcattttaagagctagagtagttcttagcaagtcgttattttgtcatttgccagttttaaaaaaagtaataaggttaatagacttaacatcaaatagattcatttattcatctaacatgtatttattaagcgtctattatgtagcaaacactgttctagatgccagaggaatatagtgggaataaaacagagtccctactttcatggtgcatatattctagtggggagtagtggagggacagataatcaagaaatacatatgtaaaaatataatagatgtaggtgctgtggagaaaaaaatgagtgaatggaacagaaaatgctttaaggagagactgcaggaagtgaaggagtgcgccttgaggagatctgctgtcgcggcatccctggcagaagaagcagctgaagccaggttactgaggctgcagcaggcatggtatgttttagggttaggaagggagccagtgtggttatatagcgagcaaggtcataagggagacaaaagtgagagatgagggcagaggggtcctagaaggccagatcacataggacctttagttcagagtaaggactaacttttaccctgagatggggtaaaaagcaatgtacataatagtcatcaagtaatattgatgctcagatatgaactttatttctctctcaacatttcagtaaaggaatttatgattcatatcttatgtaacaaagaattaagatcttttataaataaaggacatttacaaatctataagcaagtatcccaaataaaatgtgaactaaataggcaaaacaataataaatataaatataagccatgaaaataaaatattactttactagtgctcaaaaaaatgtagactaaaataatgag

SEQ ID NO: 36346 - DNA, 1045 bp, Homo sapiens
gggtatagagcaaatgaagaaacatttattcaagaaaatctattatattttggtaagaacagtgagactgtgtggcatttgagtcacaacccctccctttgttcttcctctcctggctgagcatgacagaaactgtaccccaggcgtttgcagccaagaacgtaggagccctctgccatgctgtcttcccaggatgggcagactattaacttttcttatccttcccactagctctgaattgcagatgctctattccaggtaaaagtgactgacttgtgagcctctatttctccatccagcccccacttacagagtggagactttaccctacctgtggcaggttgagaatactggggccctgattgcacttgccctagctttcccgtagcgtggaggttccgtggttggagagtcagcagagaagaacagaagctactacacctgccctgcttccttcttgtaaagcaagtgtatcatttggaaagaagtatgtcactactcctgcagaaattctgcctagagggagaggaaggctgtaataacacaaagttctgaccctcttcacaaggaaacagagtctttttgtaactaagtatttggaagttcaagcatagggatgccctcaaaaacaaggtgtgactgtagtgataagcaattaagagaaggctggtagttccgtaacagcagggagctaaagtgtagcccagctagacatttactagaaagaaccagggaaagagatagctaagaaaagccctcctgggattgtaacaaacctcaaagtctggcctcaacgactacccttgcaaagaggcttgaatttaattggatcagattgttgaacaatttataccccaggacactgttgaaaaaaatagaacagtaatctagcaattagtggaaccttacaactgggtatgataccaaaagaggcagacagtttaacagagagaccaacgagagacagtcaaagagagcctgctaaaaccagtgtcatcgtagggtgactgcacctactcaaggtacactctctgaggagcaatat

SEQ ID NO: 36347 - DNA, 1023 bp, Homo sapiens
tcttctctaagatggctagtagactaaccatgcagatatagcataaaatccttaaacctctggagtaacgcagtgtgtgtgcatgtaataacagcaaattgttcagaaaggtcactttaaaaaaatttttggttgtattttagaagagaacaacacagtggggcctactggagggtagaggataggagaagggagaggatcaggaaaaataactaatgggtagtaggtttaatacctgggtgattaaataatatgcacaacaaacccccatgacacacaattatctatgtaacaatcctgcacatgtactcctggacttaaaagttaaaaaattttttttggtatgtttgatatgaaaacttctgcaggacttatgtttcctagcaaatagaattgtaatctcataagccagagagaattaaagttggtacatatgtattttttttctgtaccatataatcaggtgatggagggaacattgttttattcttgcttttaaatattttttccatccattactgtttcttatgaatttcttaagaatgtgctcatatttatgtttacataaggcttaattgagaaactaattctgttagagtactaaaaaacagaaaaggctcatggtttcatggttcagaaaacccaagaaatgcctctttattatactgaaataaaaaatatatctgctacaaataaaagctgaatagtttccaaggtttgaatttctacgcacagtaagtagtggggttttctttcttttgtttttttttcagatgactaaaactttttgttagttttaaggtaggttttaatattttgctgcgtgacaaaagacggtttttaaatcaacaatatttttgtgtgaataatgggcactcatcatttggcagaggttcttggccattttgtattgtatgataattagagaatataatggaggctatataccagttccctaaaaaacattttgcataaaactttgcataaatttcagggaatttgtgggacatttgaaattggatg

SEQ ID NO: 36348 - DNA, 1125 bp, Homo sapiens
ggtgcatggcagtgcagagtttggaaactggcaatatggacgtatggttaagggctttaagaaataagaaaatagataggaggaaagatttatgtacaaaattcttctgctcaaaaatgtccaaaattgatatttttacttctagtaattaggtgttcttgttttaggttgtaaatctctttcagagtttagtacatagcaggctggcctaagtactgactccttccctgcatgagttgcagaccatcgttttgtttgtttgttttttgtaactgcatagtgaaagaaatcttagttttgaaattctggtctcctgtttgaatgcatttgattgtgactgaatgagctctctctgactatttctggaataaaaagttgttgccttttctccagttcacgagggtttgcttctgagactaagtgctgctcgttaacaagtattgttaacaagcattgctgagcaaagaacacctgagtttaagccctggccctacttcttgctggctctgtagacttgagcaggttatttaataagctctctgaaattcagtttctcatctgtcaactggggtaagaactgctgatgtgcccacttcaaattgacagctgtaattcttaaatgagattatatttgtggagctgctttgtaatgctcagtgtatgtaggtatcactattttttccatttagctagaaatctagaggctttttcacttcatattttatgtaagctataaaaactatgattgattatttttattttactgatagggaatttacactgaaggagaacttaaggaacttgcaccagtttctgtatcaggttagatacaaaactgctacaggaacccttcgtttttaacacaccagcttttgcttggtaatgatgaattaatactctcttatcacatgtcaaactactaagctaagcactctacacattactttatttaacacgcacaacagagttgtgttatttagggactgttgttatgccttttatagatgaggagattgaaactcacagaggccacgtatctaagcattttctcaagctcaccttgctattaaggggcacagcctggattttaactcaggcattctgatgctacagctgtgatctatt

SEQ ID NO: 36349 - DNA, 1050 bp, Homo sapiens
ttcccatctcacctcagctacacaatcactcatatgaattttgagctctaaatttggtagcaatatgtacaccttatacttttactatatattaatttctaaataataagacagttgattttgggggcagggagtgtgacttaaaaatatctgctctttttaatttgtacttactctatatcacctagttatctttcttctgctttcaacaatttcggatagtgaattttcatttagaaattatgtttatgacctaaatcccactgggaagttatgctagtaaattatagccagcatatttttgtctgttttattatttttttagttttggaaattctgctgatttgaccacattttatgtagttaagaaccattgctgtcaagaagtatttgacaaagtctaatctaaatttctcttgagccattttgaaaacatgcacatataatccaaaatctcattattatgagcattagtcagcttatttaagttctgaataaagtagtcttaagctgaagtctgtctttatccttttaaaaaagagatattaacaagcattagaagaaccctgaagagaaacctagtgtctaattcaataaaatctatcatatgtggaaatcctctcaaccagaaattcaaaacacaatttttattactatactttattccttaaaaatagcaaatcatggaagctcaggatctagagacttactgctgcagtttgatccctgcctctgtaacttagctactgtaggaccatggacaagttacttatcctccctgcacttaatttttttttttcatatctaagatgaggatgataatgtacctgtcttctcagattgttctgaagataaaatatgataacaaacataaagtatgtttataaaaatacttgtaatttcataaacattataaagttaaactcattaacaagcatgtttctagctctccaaaaaatagtttcttatgtataaaatactaatctgagcattttatatgctgtataatccttataaatgctaaatatcattagtttttttgcagaaggc

SEQ ID NO: 36350 - DNA, 1040 bp, Homo sapiens
tcagcgcatttatttatattaaattatctaattctcaaaacaggtagatgaggaagttactgatattgcccattttacacataagaaatctgaggtccgagatagtaagtcatttgcccaactcacttgtcttgtaagtggagaagtgaagcttcattgccaggtagcttggtgtcaaagaacagcattaaccgccaagctctttcacgtttcctattttttttttaacattttcttagaagtcaaggatctaaaagctttaaaattctcaattcatattgccaaactgtcttccagggagttttcacaaatttttgcttgcagcagcagcgtatgtatggacactgtttcttaaattgggagtgaagctaataaaccatttcattatttcattaaggcttgctgtgtagtttattatcttcatggtaacagtcattatttttgtaggttgcagaaaacagtattgagacaaaattaatagtgaataaattagaccttgcaatttaaaatttgcaaataaagatgtgctgtgattaattacctttaacttattcaacaaaaatgttgataagaatattacatagatttttaatattctggctgagaaaataaaggaacaactaatatggaagctcgttgatacttagcattgtatataattgtttcaaagaatacaaataatttggaatatattattctcttttgttgctatcaaattaccttagaagagaggcactatccttaagttttctgagatgtttgaggtttgacagttctcttgctttctgctatgactgatgaattagagaatcttgttgaattctttactaggaacaacattattgaactggctaatgatgtcatatgtatatattataattcgatttcttgtattaactttagtgctatcgattataaaccacctcctctctcccacatataagggttataagaaatggccttattctaaaattgtttgttttcttttccagtatgttatgaatagaaatgtttttattgtattaaaagttagttcatta

SEQ ID NO: 36351 - DNA, 1089 bp, Homo sapiens
tattgaattcttgatatgtgtaagtcactgtgctgaagaaagtaaaagatgcatatatgaataagcttagtgatctgcccttgaagtaactattttctgtttacttttgatgacagtgataacactgtaggctattatgaattgacataactttgtaattttaaagcccaaatatcagaggtatatttatgtttatccaattatatatagaatgaagtataaatttgattgcctctttattgcatagctcaatgtttttgataaatatttggggttatcttttgttttaaagaataggagaatttttagtctgtgttgctcagtaaggtggcatagtatagaagggtgagagcacaaactctgaagccagtctgctttttttcaaattgctctgctgtgcaatattgagcacattatttaatttctctctgttttcattttctccatagtgtggcgatagtgacagtgttatgtgcagtataggttggttatgaagattaaatgagttctttgtagaacgtttagaatggttcctatgcataaagcaagcattgtatgtgtgtctgtcattagtgttattatttgaatttgtctgagcccctttattcatttattcaacaagtagtgtttaacacctactgtacaccaggcactgttctagtttctagggatatagtggggaacaaaacagacaaaattccttcatggagtttacatagtggatggggagggtagggagaagatagctcagtaaaataaacactagtttacatcaaatattagaaggtgatttatcttatgaagtaatagaagattataatgggatgaatagtgatgaggaggaagtgcaattttaaataggattgttcagaataagcctcactgagaaagtggcatggtggcattggggaaaatgcttgaaggtgaaggagcaagcagtaaggaaatctaggggagcattttcccaagtagggaatagcagcccaagggccttatagtggacaagtttcccatgcatttgcagcagaacaagggcccagggtggcaggagtggacgagcagggcaagagtagcagtgataaggtcaga

SEQ ID NO: 36352 - DNA, 1033 bp, Homo sapiens
tttttaatgcagtctttagcctatagtaaattcacaaatatatcatcttttattgtgcttgtcagtaaaattttaaattaaaaaataaaatattgtttagtttatcatgaatataaatttctgaatatctcagataacaaatctggccaagaacctggaattaagtgggcaaagaaatacctacagttggtgtaagtgattcttaacaaatttgcatgaagatcatgcactcaaacaaacttactttatttcattcagttccaacttggccttaattggcacagaacattaacaatcttaattttcagcctatagtagattgtagataccaaattagaaggggttacaagtcttctttccttctaaaaatttgcatactgtcagaggtatgaaacagcatatagctcaacacaggaaaaacccaggatgacatttttaaaaaagcaagcgtataactaacaatattgtttaatagaagaaaatattcctatttcttaactactcaagttatctgaacaaagtttaattaccattagcatactcacttttaaaatgtgaggcaaatgtataaaacattcgaaatgattaccgactctagtactgaaagttaaaaaagaaaataaatatatgtcttatgtataatatataatatataatttatcttatatataaatgtatatactttgtattacatataaaatatataatacatgaatattatatatatcatttataatatataagaatatataccaattcttatatataatatataccttatatgttagatatattttatatctaatatatgtttatataattagatatgatatataatatataattatatattgtatatataaatgtatgtacaatatgtcatatataattatatattgtatatatgaaatatattcatttatatatagtatataatatataatatattatacatatattgtatatacacttatatataatatatatacacatttttatatatatattttattcctaaaaactggaaccttca

SEQ ID NO: 36353 - DNA, 1421 bp, Homo sapiens
tagatgctctgtgtcaacttaaagaagtttctcagtatttttacttttctgaaaatttttatcctgaatggatatggaattttcacaaatattttcaccaattgatacgattatgtgatttttcttctttagctttttaatatggttgattaaaaaagtattacatcccttgattaaatgctacttgatcatgctgtataattaattttgtatatagctcaattctatttggtaaaaacaattgataaggatttttgtatctgtagatatggtgtggacattcccacgtcttctattttctagaaaatattgtataaaatttgtagtaattcttctatgaatgtttagtagaattccccagtgaaaccctctggaactgcagattttcttacttagggatttaaaaattattaattcaatttccataatggttatagagttattcaaattatttatttcatattggatatggtgaggtagtttatgtttttcaaggaactgatgtattaaatgtaagttgccaaatttatgtttgtagagttgtttttagtattcccttctcattgtttagatatcttcaagacttgtagtgatattcccagtttcattcatagtattggtaatttgtatcttctctcttgttttctttgtcgatctttttcgagatttgtaaatttatttttttttgaagaaaaagggctctatatttgatttattttgattttgtctatattgtttttgattttattggtttttgctcctatatttattgctaacttccttctgcttgctttggtttatttttctcttcctaggctcttgaagtagatgcttagattattgattttagatttttttctcttaactaatttaagtgtgcagtgctacacatttcccactcagcactgctttagctgttctccacatatagtgacttgttgtattttcacttttacacagttcagtgtattttttaattttccttgagatttattcttttacctgtgaattatttgaaagggtgttgtatagtttccaccagtttagagattttaatgttctctttttgttattaatttctaatttgattctattgaagtaagagaacagactctgttatgatttcaattctaataaagtagctgaggcttgtttcacggctcagaatatggtctatttttgtatatgtttcacggacacttaagaagaatgtgcattctgctctttcaaggagtgttgcacagatattgattagattctattggctcatggtactgtttacttcttctgtatccttgctgtatgtttctagttaccccgtcagttttgaggaaggaatgttgaactgttcaactataattgtgttttttttttctcgttttccttttagttctatcagtttttgcttcccctgttttgat

SEQ ID NO: 36354 - DNA, 1038 bp, Homo sapiens
acaagtctctccttaaagctcagctagcctttagttacagttctttgagcaaatttttagaacaatcaataatcaaaagaaaaatattgaaaaatagtgtgcacttttcactactggctaagcgtaactttttcactttagttgaatcagggttgttataaagataaattgggaagtgtctagaaaaataacaactcagttattttaggctgtttgtgttctttctggatgacagagtaacttcagttttaagggtcagatgttactattagccctcaagttttgtgcttgttcttttgttgtcctggaactatcttttatcagtagaactggaaataaattagggcttgacatgttcttttcatggattgattgtaatgtatcattgtgaaggcgtctgacttgctattggccaagaggtgactaaggaatcagggaacagacagtgatatacaccactgcgtgactgccatcctatctgtttttagtatgattccacaaatttgattttgatgcatcgaactgagtttaaacgcactgatacctgagtgctgaaaacattgagacatgctgaaaataaactgtcgcctcttactgtcttttcatgcatgtacacacacacacacacacatgcacactcatatatccatttgacttcgtttcctattataaagccaagttgccattctaaaagagcatattgacctgttttcctcatacctccaagttgcctaaacttgcatgtttctcttttattgattgattgattgagagaggctcctccaggctgtagtgtgatggggtgaatactgctccctgcagcctctacttcctgggttcaagtgatcctcctgcctcagtctcccaagtagctgggtgtatgtgtgtgtgtcacttcacccagctaatttttttgtttttattttgtagagatggcatatcgccatggtcttaaactcctgggcacaagccttgacctctcaaagtgctgaaaatatcgttgtgagccaccacacccagggcccaggctcctttatt

SEQ ID NO: 36355 - DNA, 1033 bp, Homo sapiens
atagccatttccaccattattttgtgtttttcttaaccctcattccttcctttctcattgttaacatgaattttaaaattcagtgtgcctaaagcagggaaggacagaaattggcagatgcctgattatttcagtattttcattcctctttaccagctctcaataccgtttctcctttttgtttactcaagtttactaagtatacctgacaaaaaattgtatatattcaaagtatacaatgtgacgttctgatacatgtagacattgtgaagtgattcatacaatcaagctaattaacatatgtataacttcacatagttaactttgtgtgtgtgtgatgagaatatggaaaatctactctcttaaaaatttcaactgtataatacgttattatctgtaactatagttactgtgctgtgcattagggttccagaacttatgcaccctttgaacaacatgtcttcatttccctgtcatccttggaaatcttctactctatatttctgtgagttctactttttaaaattctgtatataaataagatcatgctgtatttgtcttcctgagtctggcttatttctcttagcataatatctaccaggttcatccatgtttcttcttttaaaagacaaatgaaaatttgacttttatagtcagatgagcttaagttaaaatgccggctctttcgctaactggttgtgagaccgttagccggttatatcatttcacttgccgcttcatcgtctattaaatgtggataataagaactgcctcatcaagttgttgttctcttagcatagggcctggcatataatcaatgtatgatgaatgcatggtagtttcttttgtatactggaaataagtcaaacttaaagttaagctttagcaaatatcactgtgtgttaaatgcaatgttttctacgaactaccaatgattgttttgatcagtggttaagacctgtgcatgtatataaatgtaggatatgatgaacatgctgaagagaaactgctgttgatgtggaactaatgtcaa

SEQ ID NO: 36356 - DNA, 1124 bp, Homo sapiens
gctcttcccttccctttttaaaggcagaggagcttctccctgtggccaccaccaccaacagcccatgaagggttcttccaggccacaggctaatgttcatttaaagcctaagggatcttcattcagcttgtggtgaatgctgccatgtttaagactcaccatgggccagtgtgacctctgccctggacaggtccagaaatgctgtccaagactctaggcttggagttggagatccaaatgcctgcctattgctctaccccactgtggctgagctgctatctatctgatatttatctgtctatctggtgtaagacaatgtcccctttacttttccttctgctttctcaaacagaggaactatttcaccatagccaccatagctgggaatgtgctggttcaaccctgaagttggcatatctcagagcccaaagcacatggcatactaaacgggtattactcctggttattcaaggtttaagggctctttagtcagccagtgatgaatcctgccgggactgtcgtcttctcttcagggcagtgagtcccttttggcccagggtgtgtctggaaatctcatccaggagctagggcatggaataggagccctacgactctgtttagtgccctgtcctactgtggctgagctgctatccaagatggaagacaaagtcctctttactctttgctctcctcttaagcagaaggaatgagtcacttttgttgctgtgagctgcaacgccttcggttgggggaggggtggtacaggcattcccaaaactgctcctggctggtgtctccttaagtcatatgccaccctagtcccctgcctctgagcccagcccaacactagactttgcctaagaaatccagtctttgtgtcctagactgcctttcaagtttacctagcaccccagaacactctggcctgtagtggcgaggcttcccgtgaaactccgaccttccgacctctgggatgagcatgtcccctctagctaggtctggtctaaatgctccctacatgcaagggcgctggctgaggcaagcatgtctttgctctccgctataacaaggcagcactgagttcaatggaaagttccccagtcactgtgctctctcttccccaa

SEQ ID NO: 36357 - DNA, 1835 bp, Homo sapiens
aaaaatgtaaattgacacaactactttgacaactgttcgagagtgtactaaagctgaaaacaatgcaaacattaaaacctagaaattccatttataggtacataacaaaggaatttgttcgtatacagcagtctccccttatacacagtttcagttacccatggtcatccatggtctagaaataggtgagtgcatttcaataaggtgttttgagagagagaaatcacattcatataacttttattatagtgttgtagccttttaattattacttattattgttaatctcagaatataccttatacattaatctttgtcaaaggtatgtatgtgtaggcaaatatagagaatttatgacattcaatattatgcatggtttcaggcacccattggggatcttggaacatggataaatgaggactgatgtatttaccagaagacatgtaaaataatgtttatagtaggattattcaaataatcaaaaactggatgtaaccttgattacaaaaccagacaaggaaacacacacacacacacacacacacacacacacacacgaaaactaccagccaatatctctgatgaacatagatgaaaaaaatcctcaacaaaatactagctagcaaactgaatacaacagcacatcaaaaggattatttatcatgaccaaggggattaatcccaaggatgcaaagtttattcagcatactcaaaccaataaacatggtatgtcagatcaacaaaatgaaggccaaaacatcataattatctcaatagatgcagatgaagcatttgaaaaaatcaacattcttttatgataaaaactcaacaaactatacaagaaacacctcaacataataaaggccatatagacaaacacagagctaccatcatacggaatggggaaaagctgaaaaagctttctctctaagattgagaataagataagtatccccacttttaccacttttattcaacatagtactgggagttctagtcagagcaatcaagcaagagaacaaaatgtaaaaacattcaaattagcaaggaggaagtcaaattattcctgtttgtaaacacatctatagccaattgattttaagcaaaggtgccaggtacacacaatagagaaagaaaaacctctgcaataaatagtgctggtataactggatatgatgcagaagaaggcagttagactcttaatccctcaccatatacaaaaatgaattcaaagtggattaaagacttaaatggaagacccctatactacaaaactataagcataaaggacatgattccatgacattggtctaggcaaagatttttttcgataaaacctcaaaagcacaggcaacaaaagcgaagacaaactaaaaatcttctgcccaagaaagaaaacaatcatcggagtgaagagataaactatggactgggagaatatgtttgtaaactctacatctggtaaaggaatataatccaaaatatataaaagactcaaacaactcagtaacaacaacaacaataacagaaacaacatgaatgaaaactggacagcagttcctgagtagatatttctcaaaagaagatacataagtgaccaacaagtatatgaaaaaatgttcaatatcactaatcattagggaaatgcaaattaaaactacaatgagacattacttcattccagttagaacggccactgtcctaaaattaaagataacaggtgttggtgaggatgtggagtaaaggaaacccttatactctgctggcggaaatgtaaattagtatagccagttgaaatcctgaatagaacaaaaaggttaaccctatgtgtgtca

SEQ ID NO: 36358 - DNA, 1023 bp, Homo sapiens
attttcaagtttttgtcacagtattctaaaacatctttacttggagtgactttttgtttcacttactgattttgttgcctagattagcattcaatttcttaacatgtattatcgttttctgagtttatttttgcttgtgtttttctcactcactgtttacctttccccatctagtgattagtggttgccttgacctggcctctagcccagcgtctttcagtttagaaccaagtctttccccatgtattattgctgacatagtccaaccagtgactcagatcttaggtagatgggtcaatttcctctttctggtttgtaaggagctcctgatattctctaaccctatgcccacaggaccatataaaattcatgtcaaggtttgcaacagattttcttcagccttcacctgtgaatgactcaaatcctctgtatagttttaagccctttaagtttctgtttaaaaattccagagttttatgtacatctaggtgcacttctgaagcataacacttctgattaagttcggctcatcaattatcttttctgttatgattccatttcagggaaatgctcttcgtttcgtagcccagctccatttttgtttaatttttttttctgtttatgttttatcaatcatattatctactatgtttgtaggagaatgggttgtactaagagatgccattctatgccaatttgactagaatgtctccttttttgtttaagcccctttgacttatcttttttgtttaaccccaaagactttaaactgatacaatatgtataccttctcatattttaaaaactttctcaaggtgtttttagttttgtcctttatttattgctccaacaacgcataatgataattgggattatttcaatagttcagaaatttgcaaactgaatagagaatatgagacctgctaagagcagcatgtaagaggtagcagggctaagactaatgtctaatgatatagttctttttttcccaatgattttatttaattttataatttctctttc

SEQ ID NO: 36359 - DNA, 1068 bp, Homo sapiens
gtttttctaagtaatattaaaataaatacataattattaatgatttttttcattaatcacctaaagtcactttggtcatcagttgatgctcttaggacaaatgtgataaaccagctgagtgcagtggttcttgcctataatcccagcatgttgagaggccaagatgggagaattacttgagaccaggagttagagtcaagcttgggcaacatagtgagacctcatctctgcagaaaatgaaaaaagaaatcggtcaagcatggtagaatatgcctgtggtgccagctactcagcaggctgaggtggtaggatcacttgggccacgaaacacaaggctacagtgagctatgatcaccactgtactccagcctgggagacagagcaagaccctttcttaaaaaaaaaaattggggtatgccatactgtttcccttacctaatattatgtattattggctataggcatttaacaatgcaaagatccaaataatttccaaaacatgggcagtgctttttggatccatttggaaaagatcattttattctattagattgttgcatgtagaaattttaagtatcagtgaatttttttttgtaatcgcctcattgaaacctataaatagtggttcccaattcaattgtttcaataaactatttgagacagtaaaatgtacccataatttaaaacaacattgttcatgtaggcagatgtagaatatatatcttagatttctttttcaaagagaggctgtcttttttccccttttactgaaaagtgaagagatcttagtgtttgttttttatatactctgtttcacattcaatgatatgatgtgaaatatgataactatttttatcttgtcagctgtaaatggaagaaactaaaacaaactttttatgtttttctcttttggagataaatagtttctttgaagatattttactatataaagaagatttcatttgagaattacagagattcatgggtgcagatggagttggctcccagagttgtgctgtgaatatggatgctgcagtagggacccttgatctatgcttcattagagtc

SEQ ID NO: 36360 - DNA, 1025 bp, Homo sapiens
aaattttctcctaattatgcctcagggattgtgtgagaaatgggttcttataagaccttcaactaagtggaaattaaaaaaaaatcttgtaaaaagttttctggatgtaagaggggaggcttttctgtgttcaaatgtaattactttgaaaaaacatctcaatatcttcaaaagtattaaaatcatagaagataccttaaccaacaaaattatatgaggaatttataacaaaaaatctgcgtatctcaaacttttgagaaattacccttctgaaaaattgataggttgaaaaagaaattataaaagtaatttaaatgtattttgaactgaaagtaaagaaaagcattacacattgaactttgttggatgtactgaaaatagtacataagaggaaatttttagcaacaaatacttatattagaaaagaataattgtttcaagtcaaagatctatgcatggacccaaagaaactagaaaaagaataaacaaatcccaaaagagcaaaaggaaaggaacactaaagataaggctaaagataaataaattagaaaatggacaaataatataaaaggtagatcaaaccaaaagttagttctttgaaaatattaaaatacattgttaaacccccagctagattgatgagagagacagaaagaaagagagagaggaaaaaagaaacacaatttgacagtgacagaatgaaaggtcctgcagttatttaaagtatagtaaaagagtaatttaaactaaaatttaaagaaaatacataaaagagggggaagagccaagatggccgaataggaacagctctggtctacagctcccacgtgagcgacgcagaagacgggtgatttctacatttccatctgaggtaccgggttcatctcagtagggagtgccagacagtgggcgcaggtcagtgggtgcagcacaccatgtgcgagctgaagcagggcgaggtactgcctcactcgggaagcgcaaggggtcagggagttccccttcctaggcaaagaaaggggtga

SEQ ID NO: 36361 - DNA, 1051 bp, Homo sapiens
taattgaccatcactgacaacagaatatagccacaaagcagaatacaaggattctagtcctagccctgctttgattctttgaatgagtttcttaaagtttcttgggtcatgatttcctcttctataaaatgagtgggtcaggagtccccaagaccactcttgagccttgatgattctctagaaagattcacaggactcatgaaaggctgttatactcacaaaaagtttattactcttcaaggatacagattaaaatcagcaaaaggaagagcacatggggtgaagtccaggaaaaaataggcataattctaggtggcatctctcagtggagtcatatggccacattcccatcataaggtaacaacatgttcaaagtgttgtcaaccaggaaagctcacctgagcctaggtgttgagggtttttattggctgttagtcacgtaagcatgaattgcctgcatggctgacctcagctattcagactgaagccacccaaagtgaaaacacattaaccgtaaatcacattgttaacataaactctctgatcagattggtaccttgtggcccacagactcagaggtcatctcctaggagctggccaaggtccagtcctgatgacaggcctttctcaagtatgtacagagttgagcaacctaaattttctttttccaaattgaaatgtatctaggtatttttttctcctaagttcataatgtataacttttacataaaatttgcatattactatgtagaaaaatgcattatattctgcattcgaaattgcagaatatttagagtatttgcagttatattcaatttagagaaaaatctaaattcaagagaactacatttatctgaaaaaaaaagatattggaatttgtttgtttgtttgtttgtttgtttgagccggagtctagctctattgccaggctggagtgcagtggcatgatctcggctcactgcaacctccacctcccaggttcaagcgattctcctacctcagcctcctgagtagctgggattacaggcacgtgccactacatccagctaat

SEQ ID NO: 36362 - DNA, 1030 bp, Homo sapiens
ggctgggcatggcggctcaccctgtagtcccagtgctttgggaggccaagacagatggatcacttgagccccggagttcaagactagcctgggcaacttggtgaaaccctatctctacaaaaacatccaaaaaataagctgggcatggtgacacacagctgtagtctcaactactcaggaggctacactgggagaaccacatgagcctggaaggtggaggttgtagtgagctgtgatcatgccactgcactccagcatgggcaagagtgagaccctgtctcagagaaaaaaaaaaaaaaaatgaaaaatgttatccctaaaatggttttaaatgtgtgctcaggtcttagacaaaataatgacacgttgaacagaatagtgctaattaaatcaaaatatggcacaatatatttgtttttattttttgagatgtcaaaatacaataattggttttttgccatatatgtccttagcatactgatttcctttcctttggatatatacccatacccagtaatggaattgctgaatcttatggtagttctatttttcattttgttttagaacctccatactattcctcataatggtggtattaatttacattgccatccaacaatgtataagagttcccttttctccacatcctctccatcacttgttatctttaggcttttttgtagtagccattcttatgggttagaggtgatatctcgttacggttttaatttgcatttccctaatgattagtgatattgaacattttttatatatctgttggccgtttgaatgtgtccttttgggaaatgtctgtttaggtcctttgcctatttttaattgggttgtttacttgctagtgagtttccttttgtttgtttctatgttttatttgagacaggatctcgctctgtcacccacactggagtgcagtggcaggatctcagctcactgccacctctacctcccgagttcaagcgatcctcccacctcagcctcccaaggtgggaggtgccagcctagaggctggtgt

SEQ ID NO: 36363 - DNA, 1050 bp, Homo sapiens
gaagacattagaaaaaaaaaattaaaaaaatcttcattcatgagattcgtacataattatagaattgtaaatctttttctagagcctttcagaaaaaaatgaaattcactgaaatgagattactaaatcagcgttagtctgggatatcttccagggcagagaaacagctttgctaaataaaattaatgataaaatgactcttaacaaaatagcatttaccccggagtccacactagacatgcaagtattaccactgctcttctaaaacttgttataactaagatgggaagatatagctaactctggaaagaaatacccagttcagcaaagattttagcaagttgtcaaaacagggatttggaaacagcagtagatgtgtttttcaacaattgtttgaatacattttaatcaaaatctggttaggattcccagaatttcttatgtctgttttatatctgttcatatattgagaattacctttgaagtggatttttagaaactataagaggtaaacatgctgaaagaagcagtaaaaggtaaaaagctgctcctggaatatcttcttttttcctataacctgaagggcagtttcttggggaatacacttctcaggattagtcatttttgttgtcattgtttttacataccaaccttctgtaattaatcctgaggattaaaatatactgcttcttcattggataccaaattgtttctaccaagacagaatctcaaattgtgttaccaatctggaagcacacttactgctataatctgttgctttaatttggcaacagaagtctgtcatggtagtatttttattttaaatttttaaacatcacgggcctactacacagttttttctttcttcctgattttttagttctgccccaccaaggattctacttgcatgtaatttagagcaggcatcacgctttttctgtaaaggacctgaaatgaatgcctttgtaagacacacagcttctgtcacaactacttcgctttaccattgtgtcgtgagtgcagacataggcaatatataaatgaatgact

SEQ ID NO: 36364 - DNA, 1032 bp, Homo sapiens
taaaatgaatacgtctgagcatatcttatgtttggtttttaagaagtcgaaagatttctttgtgaattcagaccgagtatatgtatttaatatcaattccaactgccctcttaaatcttttcaaataattttttaaaatactgtcctaaaacagtcatgttttatatgtttcagtgctaaaatgagtgatgcactgtttctcttgcagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaaggtaagattctttttctattctgaaataatcattagttcttttttaaaaagctataaatgtctacttgtccatacatgaagagactataattctagtttgtacaacccat

SEQ ID NO: 36365 - DNA, 1031 bp, Homo sapiens
agccggtgcttctgctttcttgtttccatttgcctggaagaccttagatattcttttattttcagttttttttttttttttttttttgagacagagtcttgcttcattgcccaggctggagtgcagtggcacgatctcggctcactgcagcctctgcctcctgggttccagcagttctcctgcctcagcctcctgggtagctgggattacaggcacacgccaccacgcccagctaattttcgggtttttagtagagatggtgttttgccatgtgggccaggctggtctcgaactcctgacctcaggtgatccacccgcctcagcctcccatggtgctgggattaaaggcgtgaaccactgcgcccggcctatttttagcctttctaaataattgttttaggtgtttctcttgaatagagcatatagttggttctttatgaacccaaatgaagatcttttccatttaataagtgaagtaagccctttcacatgtgttaagatgaatatgtttgctgtcaaccctgccagattattttatgctgtaattattatatttattacatttagtctgtttttcgttataatgtgtttactgtgctcttctttaaaaacaaaatcttaaatttggtatttaggaaggtttatgtttctgttgtccttttgcttatactttttttaatgcccttagcgccccccccattttttatttagaatctgtattgtccatctttaatgacattctttaactttcacatgttgcttaaataccagttattgagttttcctactttccttttttcatctaccttctcttcctatttttagttgcatcattttttattcatcagaacatacagcacaaaacaaatagcattatcatataacctattattattataccctgttctcaccttaattttgatcttagatttgcaattaagtatatttaatgctaaattgctgaagtttctctagtcatttttttgtttgaataaagtttattttctagcagatttcttaaaaaaaaaaag

SEQ ID NO: 36366 - DNA, 1033 bp, Homo sapiens
gaaccgaaccgagcattgcagcggcgctttcccagctcagctggccttcctcggtgtctcttgcacgtcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaataggtaaatgcatttgcctctttttgtttgtctttagttcctagacttttaaaaggtcatagtatttataaaatgtaaagctgaaggcaggattagtccaggaaactgctgttgtgtgtgtgtgtgttttcgaagttaccaagggagaaatagaaacagatctccactcctttttcctcttttctcgcttgatcagcgatctctgaagctgtgtgttcctgtttttgtcaaaggaagcaccctctataaacttaactgtattgggccctccttatatccagttccatttgaattgctttgcgtttgatgagagcacccacacctcacagcctaattttaagtgtgtgtatgtgaattaaaatgtatgaaatttcccagaggattgtttactgtgggctatacttgcttttaaagtattttcaataagctttcttggcttgtttaactctgcaccaaatcaattggaaattactgtaaaatatccattatctgaaattcagttacctgaaactggaaacccggaaacagttttcagcactgatcacattctgctaattgtatatgcagtgtcccacccaaaccccacctcccctcaggttataggttttctgcagcttagtgttaatttcctgatcatctttgtgtctctcacaaaatcttgaacatgtgtatttattaggttggtgcaaaagtaattgtggtttttgccatcccttttaata

SEQ ID NO: 36367 - DNA, 1081 bp, Homo sapiens
tagtatcttgacatacaaagggacacattgttacgatttaattgatttaatatagcattgttagaagtttgactggtgctggttcttttttattttctgttattttgttacaaaggaaagaaaacaaacgaagaaaaagttaatttgtatatttaagattaatttttttttcctgaaataacctgactttagtagtcttacctttatcatagctcctacatctgtaccacaataaacatgtcctggttctagaatactatgagataataaattggacagggaccaaattagtttagatttagcatatcaatggaaaagccggttgatgtatacattgagaacttaagcaaatattgaattaaagggcatgttcattagctttttccctgtattggtacatattttaaggaatcaaatttttactgaacagaggaatttataaatgaagaaaagatatggccctgttcccctaaagcaagactaggtctaaaatcttacattactttttggtggtcgtgtgtatgtgggtgtgtgtgtgtgtgtgtgtcggaagtgagagggattgtcttaagctttccaacatgtggtcgtgtgtgtgtgtgtgtgtgtgtgtgtgtgtgtatgtgtaggaagtgagagggattgtttgtgttaagctttccaacatgcggccggggacagctttgaatgcagcccaactcaaattcacaaactttattaaaatgtcatggccgggcgcggtggctcatgcctgtaatcccagcactttgggaggccgaggcaggcagatcatgagatcaggagatcgagaccatcctggctaacacagtgaaaccccgtctcttctaaaaataaaaataaattagctgggcatggtggcgggtgcctgtagtcccagctactcaggaggctgaggcaggagaatggcgtgaacctgggagttggagctcgcagtgagctgagatcgcgccactgcactccagcctgggcaacagagcgagactctgtctcaaaaaaaaaaaaaaaaaagaaaattgtaaaaaacactgatgacattttttttttaaagctcatcacttag

SEQ ID NO: 36368 - DNA, 1026 bp, Homo sapiens
cccaaagtgctaggattacaggcatgagtcacagcgcctggccccattgcttttcttcaagtgattttcttagatgaatatgggtaggcagtaggtttttgagctggccacagtactgacattttgaaagtgtatatattttacaattttttagatttggaagggtttttaaaagcagcctttgcctagagatgtattcattttcattggccattaatgtcagcgtataaaaatgaaaaatattagtttttgaaggcatcatattttgaactgattaattgcttaattaatatattggtaatgctgtaagatagttcattttaaggaatagtttcattaaaaatagctggagatattaaaaagtgccatttaacctcttgtgatcttactctcaacaaagtttcaacattgaagcaaagcgtttatgtttatgttataaagtagcataattaatataacccagtaagtgaagtgttttgagtgtctgctttgtgcttactacaggccattgacaactatcaagtatgattctatacctcaaggagtttttagtttagctctgcacaaaatcacacaatacttgttgatctataatgaatgccctatggtaatagcttgttttgaatggagattttgaaaatgagatcaatgaggagtggagtgcagtacccggaagacctcctgcaagagatggtgcttaagctgcattttgaagactaggtaggatttaaataagtgtgtggaaaggacagggctttgtcaaggaacgcaccctcagtaaagttagaaagataaaatgaacattatatcatggacgatagaaagggagcagtgtcctgtgtgcaggaggtcagtggtggttagagagtggaaatattttggatacatggggcagagccacattgaggaggtccctgaggaggactacctttgttctttgtcctcctggagggtgggcatctgccattgttgaagctgtcaaagttaacccttagacttttgatgggcactggggagaggagggca

SEQ ID NO: 36369 - DNA, 1049 bp, Homo sapiens
tgtgaaacaattcacctgcagataatttctgtggtacaaggattatgaattttgtttgttggattttttttttttttttgagacaaggtcccactctgtcactcaggctggactgcagcaatgtgacaaactcctgggctcaagtgatcctctcaccttgacctctggagtagctaggaatataggtgcttgccaccatgcccaactaatttttaagttttttatagagacagagtctgactctgttgcccaggctggtctccgactccttgcctcaagagattctcccaccccagcctcccaaaatgctggtattataggcatgagccaccacacacactgaattttgaattttatagatgaactttagccaactgtggctgaatttagcattaggatgcctctactccttcccacataccttgttagccttttttcctacagcgtctttctgttgtgatttagagtatatggtagagccatagacagtgctggctacttggagagttgtgtaaaatgtaccaccccctaactcttggagattggacttggtcgcatctcagtgtcagccagattctggatagagagccctctaggccttccggccttggcacagcacagagctcctgccctcatctctttgttctgtgttctggacccactgtgaatgcttggggctctctgtgtcttgaaacatcctgattgtcacaggtggggacacagtcattttttcctagtatggacctatgggaaaaaatatagagataaaaattaagggccagatataaaataattttttcccttgaaaaacactgttttttcctcctttcctttttttaatcttacaattaatctctcaatctctgtctgtaaatgtcaatttttcagctcactggcttttaaattatgaataataacataaaaatttagttaattaggtcacccaagtatatgatttattttcatatcagaccagttaaggacatgggggtgggagcatatatagggaaaaatgggagtaggagaggaattggagaaagctgggcagg

SEQ ID NO: 36370 - DNA, 1005 bp, Homo sapiens
gagaccttggttttcaccttaaagtgtgtggggtttttttgttgtttgtttgtttgtttttcaataggagtgaaaacagtccttgtccacccacagccagtctgaaattccagaggcaacacattcaactctttttttcttttttttttttccacgatctctgctcaccacaccctccgcctcctgggttcaagcgattctcctgcctcagcctgccaagtagctgggattacaggcacgcaccaccacacccagctaatttttgtgtttttagtagagacagggtttcatcatattggccaggcttgtcttgaactcctgacctcaggtgatacgcccgtctcagcccccataaaggctgacctcttgtctgtcttgttcagtgctgaatcccagagcctagaacaacccctgggcttcctggctcgcaggccctcagtaaatatctgttgaataaataaacagatgaatggtgcattctgtgctgagtgctttcccagcgccgtcctggaggccgccacctcacgaggtgcctaatcactactaggagtttaccagcagagccaagcaagaaaagatatttccaggcagcagggacaacatatgtaggaaaattggaaagactttacaaaaatgacctggcatggtattcaggaaaataggatttattaaatttttctttttttggaaacagagtctcgctcggttgcccaggctagagttcagtggcacgatcttggctcactgcaacctctgcctcctaggttcaagcgattctcatgcctcagcctcccaagcagctggatctacaggcacacaccactatgcccagctaatttttgtatttttagtagaaatggggtttcaccattttggccacactggtctcaaactcctgacctcatgatccacctgcctcggcctcgcaaagtgctgggattacaggcgtgagccattgcgcctggccggatttattaaattgactccatttctttcttcactttg

SEQ ID NO: 36371 - DNA, 1032 bp, Homo sapiens
tgtttaattccatgaagtagacaataagaaccaaaaacctgccatgtggggtcaaaccagtagcacagcaccctgtacattctcttcaaagggaaccctgaggaagtagcggtggcaatacagggggaaagatgggattttatccccaagtgtttcccgcttctttaacttttcttttctttttcattctttttattcatgtacttgggaaaagtatttctgcttctttgtggaaaatggttactataaccaatgtatgcagtgataggtctgtgtggaataagttctgtgtaaattcttctagcagtataaaaaaggaaaagggagtggtcacaccaggaaaaggagattgtgtttgtggtatcgtggaatctggtacttatctgcgtggatcagacaggcagtttgcctggacacagcagggccaggaccgttaatcatcggatgaagtgacagaggagtatttatcttgtaagcagctgagccctactggaaacatattgtctcgggtttgtctctcatctaaagcaattcattactcacctacaaatgctgtcatggatcccagcagctatgatcatacgcttcctcagtactcctgacataaataaaaaaggaaaaatattttcagttgctagatcttctaaattttttttaaaaggagagacatataatagagttgattttctattctgaaatatatgttgtgattcaatagttcaaaaggaagtttctttatgtttaaagtgaaacttaagcttattaccacagaataatttagcattttggccttgttattatggagaactgcctcggacagtatagagattaaatatgtatttattcccctgcaagcaattctaaattcccctccttctctctcccttgcattatcagtttccccctcaatactgaatcagtctcatcactatatgaacctatcgcagtagtttctgtttcacataataaagcctgccttcagccccatgcttccctcctgtgctcatcccgttgtactccttccttctcttt

SEQ ID NO: 36372 - DNA, 1005 bp, Homo sapiens
ctccatccctgacaccatggccactttgttcatgggcccattgggcaatgacaggaatagctgaggaaagagaccgagtggtgtccacagaacgagtcatcctatccacttgattattaaaatgctcctctgctgaggtcatcctttggtgaacactcatatgggatagaaatatcttcacaggttttgaccactcagaggggtccatccacatacctcttccccagatttctttgtcaccaattttccaatcatgcttcttccaagtccctgaccatcaagccaaaccattggctatagcccgtgaatcagtatataatcacacatcagaccatttctcctcccatgcaaagtgtacagccaggttcactgctcaaagttctgcccactgggaagatttgccttcaccactgtccttcagggctgtcctagaaagggactgtagtgctgcagctgtccactttcaggtggtgcctgcatatcatgcagaaccatatgtgaaccaggacctagtcatctcttccactgatcatagggaactccctgtgaagccattggtgcaggctggggaggagaaggctgggtggcagtagtgggaaccatgggcatttgagccacttcctcatgtaacttacttgtgccttcaggacctgctcaagcctgattacgtatatatcacttccatttaatggtgaaaagctgctgtgcatgacccactttatggctagatggatcaaaaagcatcctgctcgtgataggcagttcaggttgcatggtaagttggcaacccatagtcaagcgttcagtttctacaaaagccaagtaacaggccaagagctgtctctcaaaaggagagtagttatctgcagatgatggcagggccttgctccaaaaatcttagaggcctttgctgtaattcacctatgagggcctgccaaagtatccctatctgccactgacacctcaagcaccattggatctgctgggtcatatggctcaagtggc

SEQ ID NO: 36373 - DNA, 1018 bp, Homo sapiens
aaagttgattgactttgtctagcctgctgtggacctaacacacagatagtcttctagatattgggagagcctcagtttttcacttttaatagtagcataatgctactattaagtttttcaactctttatggagacaaatgaaacaataagttgaagacggctttagaggacttcttggagaaaggccttagccacagttttattatcatgcattacaaatattagaagtgtgctttttgtctatggaggtagtggctggagttggtacctatgctgatgtcgttgatgggatgacacgtgtggagaagcatgttggaagttgactgtctctggcacaggctgctagggaatgaaaactaaacactcttctgaccatttgcatcattgagtcaagcagaaaaaaaaatcagttaagtaactccctggagtgacttatttctatttccatgggcatattgcctttgcttattgtcatttgcttttagctatttttgcaaaggtgctgaaaggctgtctctgaagtcagacagtaacattcaaaattatagacattatctatgtattttcctatccaatctcttactttaatgtccgaaaacacaagagtgtgggaaagagagaaacctctataactcaatcatgctacagcaattttcatggcccccaaagttacttcagtgaaatatttcaattcaattgagtcatgagtttgaatgttaaatttccccagctttcattagtcttttaaaaatctctgggtttagaggccttgcagtcaggcagccttgactgtgaatcctttctctgccactttctagcttctggttcttggtggagtagtagtgcttgggaattgctttatctgcagaatgggaatcatgatacttagataatatgctggtttttggttctagacaggtgtctgacacatggtatgcactgtaattgtgtttattgtctttcatgtaattcccaaaatgtcttgaagtttttattttcacaatcaataagcttgaga

SEQ ID NO: 36374 - DNA, 1106 bp, Homo sapiens
aatgcatcgtttctgcaagagattgcctctcatacttggcttgctggcctgtcaaaatgatctttttcactgtgagctgccttatattcactaaataaagctcatgggactcattaatccactcaaatttttgatgagtgcccactctggccagcactatattaggccatggagatacagtatgaaaaacagacctggtatccggaaccctcctgtgactgttggggatggggtcctgaggcctgtgtctgcaaagcctcttttgatggaggaggagctgagtgtatgagtctacagcccagcagcccaaaatgaggacgtggaagccaatgaactacctaccctatagttatctgctggagtgccccggctcaaagcatctggtttggaaacattttggtttttgtttctgactaattaattgtaacctccaatgtggtttaaagtttataaaacacttttaggtacttctcatgttccagtagtgttattaggaactctaatatcatatagttaaaggtctgccaatatttttctaagaaaatcgtacagcaattgttcaatagtacaaatttactctacctgaaaatgttaaaactgaacactattatattgccctttgatgcctatctatttttagagtgccaggggacaaagacataaacatgaacaaaaatctcatagttcattgtgggttttttcccccccagaaggctttgaatgattgggatgttggcaggaggccactacacatatagactataacaatgcatattaacactgaaaactatgaaacctttcttttctacctttacttgtacttgatgaagttaaaattttgttgtagtaaagagactggggaatttagtcagtgtttttctttttcttgatacttcagtagatataaagtgaattttatctattgttcagggcatgtgagttgagtgtgctgggatggttcttagagttggttctctgttagaaaaaagacttgctgggtgtatgcttggatgatctacaggatccaactcctaaattcaggacataatctattttttttaattatctgtaacaacagttagaataaggtacatttgggaattgaa

SEQ ID NO: 36375 - DNA, 1065 bp, Homo sapiens
ggtgtgagtgagatagggaagctgtggatcccggaggctgcttgctcagttcctctgaaggtcgggtggagctggctcttttgacccacatgctccaggggagctttccatctgtccaaatgttagcctggaactaaacgcctccacacagtgatgaaatccctaacaaatgtagtgacaacactgaacataaggccttaatttttttcaaattgcttgcatttacagttaattcagtttgaattataagtcacctccatgtgaatgactcatgcactcattattaggagctttgcattctaaaatgtacaaaacagagaggagctggtttgcaaactcggcatcaccaaggtaatattaaactagtttcaaactaagaaagtggtttcctgtcattgcacatcttgtattccagatccagagttatcaaagaaaaccgtcatatcttttaagaacacctttggatcactgtatacagtagttattggaggggatatgtatggaaatcaaactcaattatgtagcataagtgaaaaaaaaaattatttttctgttacaagacaatttgctttaggccagttgaaaaccttttccaagtccagacctgttgggacctagagggacggtcaggctaggctttgtaagttgtgatggaagtgaaaaaatgacttcaaaagcaaataattttaacactgtataatagactggggagaaatagtaaggaaatgcccagaaaacaaccatataaatagataattgctgaaatatttggataatttcaagaaaaagtgcaggctaaatttttggacagtgaaatcagctttccataataactctgtctcccagccagtaatttccttgttctccctaatttacttcacttctctgtagctggaaaattcctttgttttgtaccctaataagctggctctgcagccactaagttctattgtgagattttgtcttgcctcctgcttttatgcacataactggtccctgccagggagctctggagcccccaaatagctttaagctttctaatgacttttcccaggggtcctccag

SEQ ID NO: 36376 - DNA, 1062 bp, Homo sapiens
tccccatcacctttcctgtttggttagagtcactgatggattttcctcagattcgtcctgctggtgtaagaactctaaagctaaagttctgtttaatcttgccaaagttgccagagcaaagagcagccacggagtgtgtcacgttgggatgaatgtgaaggcctaaacagcatttgctcatttgctttgcatgtgcagtgactatcataccaagagctggaccagaaattgtggattatgtaaagtgctaatgggcgcagttccgattttggaggagcttacaatgtgataggggtgagccattcattcaattattcaacatatatttgataagcttctcaatgtgccaggcactttaaagggttgtctgaagatagcattgtcttagaaagacacagtccatgactagatggagcttacagtctgtgagggagacattggatacctgaggaagatgtttaagtgaacctgggcacctgattttgaaaatccagagggataactgaggagatgaatgaagagccagttggggaggtgagtcaactcaagcctcctctggatgttagtttgcaatcaggtttttcaggattagtgtatgtggaatagtaatcatgaagagagatggaattcaagttgggataaatggcaaatgcaaaagcccagaggaggaatgagcaagttgttttgtttagaaggttgacttggagtgtggctgtctctcaataggctgatattaagaaataaggctgataaattggagtcgcatcagtgaacttcttgaaaactaggtagagagttgcggtttgagatgcaaataggaaactacaacataatctttaggaggaaaacttgaggagggcagcttgcaaatgaagagaacatgggtttgactcaacaagtaaggtaaaactaggttttgcaagtttcaccaccatccaagctctccccttcatttgggctgataaagattacgataagtctggggacatccctgaacccttgtgaatttcaatgaccaaagcacagactgtcttacacatgagctgtcagtcagggtgcaca

SEQ ID NO: 36377 - DNA, 1046 bp, Homo sapiens
gattctggaatcaagatgtggttggagaggagcatgagggatggggtgggtgatgtgggagtacgacctggaaggaggaaggatgggtggtaaaaaggatgctgcaggaagggcttctgtttgatataaatgtttttatgatttgtttgtagaaaagatgctgacacacttgtaacccttatttcaaagggcagcaaatcttgcacttgatttttctgtgtaaatgaactgtgtaattggtaatagtttatatcaaaccattcaaaaattttctaagcactgttgcaagctcgtagacttcccaagtgatatcataataatatcataattaccgcggcttatgaaaaaaatgggttaagttctaagatgtagtaacatctttaatctgaaatatctgcgcttggccaaatcagctttcctgtattttctttcacaaaacatttggtcccaattgtagttttctttctttcagaaaaaaaaaaaaggtcagaaaaagttcaaaatgacatgatggaatatatatttgtttggaaaaatgatctggttattgccatggcagctatattaaatttttagggttatgtgatatagtttttatattaataccatctttgaaatttatttacatgatgtaacagctctgatggttacattacatctttgaaagcaaaaatgtacaaactagccaagatttatgcagcttctcagcagggcaaaattattcactttaaagggaaaaaaagatatttgttggattttaattataccatttagatgttgacatgtattaaatttattacaaaagaaatgcaaagatgacttacagaaaaacaaattcttacctaataaaaaatggcacatatcttgataggctatgaatttttgctttccgatgaaattgttacaaagtaaatgtctgaaaaacaggtttcatgaataagacagaatctttacattcagtctttcttctggtgcataggattgttttatgtgtttactcttgctgagacttaggcttgtaaatggcttactaataaacagaaggc

SEQ ID NO: 36378 - DNA, 1035 bp, Homo sapiens
tgtcacagctaacagctggatgcagaaatatttctctttaatttggatggataaaatttttttcacagcagggcactctcaaaagagtacaacatcaaagagggcgggtctcaccagtcagacatcagctggctccaggatggagcaaaatgaatgaactgtcaggacttttccagcatatatgcttttgccaagtgaaaagttaaaggttcagtggcttgttcagatcacagacagaatcctgataatggaagcctgattccccaaagtcttcctctgatcaacagacagagcatgcctgaagaagactccagaatgatggatggcaggcttcatatcgacggctgccgccgccttcagagataagtggaattcaccaaatgctcaacagttctcaggagtgcctgagtccccatgtcataatcctcagagtcaccgactctcctctgctaacttgacacttagcagtagctgacccacagtgtgaccaaaatacccatttccatttcttcacatggccggctctctgatgaaggctttgcaaacaacaccacaggtgttttacagttcattgacacttttcaactgtttttctgattaccatatttcagtcttgacttatatgttagtattatctgcacactcaacataaacctctaatgattttctaatatttctggaacttgatgaatgtgaattgacaaagtacagtatatagctttatatcagcattactgaaaatacagcaatggtgtatataaccattactcacttattttatggggtatttattacttgacctttgaagccacattttagaatcttggcattcgagacattccaaaatattccagaccaaagtgaaaggaaaggatttccttattagaaacaacaacaaagtaagttaattgtaataggtggaggagggagaaactattaaaatgaaaaaatgtataatatatatttgagaaaaaataaaaagctgaacacacataatatgggcacactagtcggtgtttaatgaagaagctttat

SEQ ID NO: 36379 - DNA, 1102 bp, Homo sapiens
atttactcattcagttatgtatgtgttcattcattcagctggtatttaccaagtatgtacttttttgctaggcaccctggtaggtacaagagatacaaaggtgaatgacatttagctgttcctccttttctccatctttgaaaacctcatagtctaaggggaagcccaattagtaaacgtattatagggtgaaaagtacaacagtaagacatgtatgtatgatgtttcacagtagcacagaaatggagtaatcaatgctatctggtggaaatgatgtttcagatatgttttgaaggataagtaggagatttctagacatacggggcatgggggaaggtatttctggccgtccaaacagcaggtggaaaggcctgagagtgtgagtcagcatgcatggttgattggtgttctcagagcagtttttatggtctgtgtgatgaactcttttcagttcaaccctcttacagctctcttcactcatttgctctactggctttttctgtttgagaaggagaattaaaagagcatagagttaccgccttatgtaccttctgtaggacatgatcaagcaagagaggaaatgattcaggcagtaggagactaatccccctgctcagtctcagccaagaagtcttcccagagcctcattacccaggattttccatccagacctgctgtcgtggcgcactttgtgctcagcctgaggccaggctcagcttgggaaacagagttctctggtctgggtcctgccttcctctctgtctgccagtgaagggagaagttcataaaagatagtcattgtccctcttctcctcaataattagttactttattcagcattcttaactattctccaacatagtttaatttatggtgttaataatcaaaatagtgataatttttgttgcggtacataggtgcagcttgttcactgcataagagcatctggctaagtgggcaggatggggcctaaaatcaagtctgtactatgccacccatgctgtgccgcctgaggctgcaatagcccaaagagggcatctttttctaatccaccctaaggagctgcatgggctaccacagtcctaggagttccctatcacca

SEQ ID NO: 36380 - DNA, 1054 bp, Homo sapiens
atcagagctgcagcaggacagggctctctggagaaatcaccttccccctgcctattgacagatccctctgttctgcatcagacgggctttgtcccatcacaggcatccaggccttggaaggagccaccaattaaacctcttgagctggtaaaatctgaagccactttggagtgtctgttctgattaggcaggatgagaggaagcccatcaccctgcaggccccgctccctggtctcaattttctctcttgcctccaccaggtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggttaacatttccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagtt

SEQ ID NO: 36381 - DNA, 1123 bp, Homo sapiens
gaaaacatcccccgagcccagaagtttgagttcagcttgagcagcatagtaaaagcctgtccctaaacctaattgttttttaaatatcaaagacaaagaacactgaaagcatcaagacaaaagaaacgtatcacattcaacaaagccccagtacagctttccacagatttctcagcagaatccttgcagggcaggagagagtgggatgatatattcaaagtgctaaaagaaaaaaaaaaacctgacagcctaggatactgtaccccagaaagatatcctttaaacacgaaggagtgatacagactttcccagatgaacaaaagctgagggagttcatcaataccagatctgtcttacaagaaatactaaagggaattctgaaagaaaagaatactaatgtgcagcaaggaaacatctgaacgtataaaaaaatcactcataaaagtatatagagaaattcagaataacactgtaattgtggcatgtaaaccacttctatttttagtgtgaagactgaagaacaaaactattaaatacaataataactgtaacaattggttaagaaatagacaatgtaaaaatatgtaaataaagcaatcagaaattcaaaatgtgggggtggggaatggtgttaaagtgtagaggctttttatttctttgtgctcaaagttaagttgttatcaatttaaaacaatttgttatgaaatattttttgtaagtttcacagtaaccacaaaccaaatacctataatacatacactaaaaataaatagtatgacaccaaaacatactactaaagaaaaccacatgaacacaaaggaagagtaactgaagaaaagaagaaaaaaatatcctcaaaacaaccagataacacagagaaaaaatgcagtggtatgctagtaggagtgtaaattagttcaaccattgtggaaaatggtgtggtgattcctcaaagacctaaagacagaaatgccattcaacccagcagtccctttactgggtatatacccaaaggaatataaatctttctattataaagacatgcacatatatgttcactacagcactattcacaatagcaaagacatggaatcaacccagatgcccatcagcgatagactgg

SEQ ID NO: 36382 - DNA, 1033 bp, Homo sapiens
tctcctttccggtcggcgatccgaccaatccaagaaggttggtgcaatcttcggctctactcggctgttttcgctgatgcgggcagcttgggggccgccgccgctaaacagacgctttcctttttaattttttttccatgtgttcacttccgggtccggcgtcgatccggatgcccgaggcagaaggatgtttgacctccggataagcgaggcgctgctgtgcattcattccgggctgcatcggtggcgacagcagaggctcgggcggcgactctccggccagcggcggcggtaggaggcaccagcggcagtgcagggaccgaatccgagcagcgctgcgttacctctctctctcgctccttcccccctacctcgctcgctcgctcgctcgctccctgcgtggctcgctttcctcctccggccgccggcgggtgtgatgtgccgccgccgctgcccccgccggcgctgacggactgggggcgccgcccgcgcccgggaccgacccctctgctcgcggccgcgcctttgaggtaaagccccctgcgcgtaggtgctccgctgccagccccggcccggcggctgcctcggcgcggccgcggcgccctccctcccgggtggggctggggtcccgggcgggtggggtggggtgcggcgggggcggcgccgcaggcgcgggtgtcgggggaggggtgggcgaggaccatggcgggtggcccggaggcgtgggcaggagggggccgcggtcggaggctgagggcgcggagggctagggggcagcgggggccgcgggtggcgggtcgggctgggtgcaaaagttgccggagtggtgcggcgcgactggggcggcgagggaggtgggccaactgggccggcgggggcttccttaggagagattgggaggtggggagtgtcgcccacggtgctccttgactgtgtccagacaattacctttggagtaggggcttcaggcaggaaggaggcatggataggctgggaggaggcgacgggggccagcgttcagctcagggataaa

SEQ ID NO: 36383 - DNA, 1031 bp, Homo sapiens
tttctttaacagttgttgaaaactctcctgggtttttgatactaagttattaactctggtcctgtgggtcccactgtagttccagaagcgttgtgtaattaggatgcttgagacggaaaatgttttgggtaactttggcatgactgagtattcatcaaacactctttttagtccttggggttacataattttacctttgcacatgataacttcatgccaaagcgcctacaggcagccctctcttttacatatcttggcttacttttttaataatagaaagaagcaggggtgtggttgcaatccctctgttttagtttccttaaacttccttaatttgtttttaagacttcgtttcaagtatatttatatctgctttggcttattcttattttttgcctccggttcctattcccatactttgtggttcttctcatttcttttcctcttcctcctcctcccccactgtaagataatattcctcaagaagaaaaacttatagttatcgtattctgtatcagaaaaattttctgcctgccagaaaggtgacaaataaatctgtatattttagtattatagttttctgaagaggaccttgttttaagggaatggttattgtacttcttgtgcagaggtagtgttctgtgtatgtggtctcttttctttccatccttaaacactgaaggataatgggtgggggggagcactggtgttatatgctttttaagctgtgttttcaagttcagcaagataccaggcactctctagatcctaataggagcatgtgaaccttataggtagccattcttctccacctcaagaataagatttaaaacttaacacagttaggttatatgcactggctttgtgctcggaaagcactataattctattgtagttcgtatcatattttctgttgttgctcatttaaactatgtgatgtcagacaggttgtcttgtttgccatttgtatttcctgcctttagcacataataggtctttaatgatcacttatttgttgaatggattgtttc

SEQ ID NO: 36384 - DNA, 1067 bp, Homo sapiens
acttcatgatccacctgcctcagcctcccaaagtgttgggattacaggcatgagccaccacgcccggccatgatcttcttctgctcagaatatccttaatatgtggatgtgataaatattctttcttgtttttagcttatatttaactcaagatatttggaattaattttgttgtaaggtgaggcaccagtaactatttttctcctcaaagtggttagtttatcacagccaattattgaatgtttttaaatattatttcagatattttatgtttatttaatatacttactggattaaatatgagccctagtaagattacatctcataataatgatgaatttaaaatgaaatgatagttggaagaggaatttggtattcttattcttatataggagttctcgttttgaaattttttgaccatgcatttgactattgattacttttaaattgtatacaatattccaagaaagtcagaatctttccatttttataagtgggctactagtatctgtagtgtctgtatcactttctactctgaatctaggtgaaatactaaatacatcgagttgataataagtttgaatatttccttgttaagtttttttgccaaatagaagcaaaaacctatgctttagttaaatgtattatgtgctttttttcagagtacagttttatataatgtatctttaaaatcaattactggcagaatctgatttttttttctttttcaagggaaaaatttatacacaaatgaatatgtggcaattaagttggtaagttcctgtttcttaatttttcttaatgatttctttgttactttttaagtaacttatatattttaattattttttgttttcatgtcatttataatttggatgtttatttgacagttatatgcatagctaatctttgttgctaagctcctaacatcatcctgctcttaaagtatatggtaatgtgtaggacattcatgtttgtctgtgccacaaaaactcaatccctttactttggcagcattgtagaactggatcttggccctatttttaatttagggaaggatttttaat

SEQ ID NO: 36385 - DNA, 1079 bp, Homo sapiens
aatcactttgcaaggctatgtttactatacgttttcttactatggtcttaggatcccttttttattttatgacaaatttggagctttttatgtttatgctgatatgagtagagaacattgtgaaaaaatttaatttgcaaatataaaatgcatacttcttccatattcttagtctttttggaggcactattatagctgttgaagtgacttacaatatagtggtaggctgaaaaatggccacatagaagttatctgtatcataatccctagaacctctacatgttactgtatgacaaagactttgcaagtatgataaattaaggattttgagatggagagattattctggattatctggtgggggcagagggacatttacacacacagaaaaggagtaggcattgtgactgtggagcagagtggagagaacctggaagaggcttctagtactttcgcctagagtctctagagggagtgtggccttgcgaagacattgattcagaccaatgaaactgatttcagactcttacctccataactgtaaaaaaataaatttctgttgttgtaagccaccaaatttgtagtaatttgttacagcagccgtaggcaactaatatgggtatgtttttagataaactctaaattcaagtgagattatttcatgccactagagaaaattcatggaaaaaatttctattgtttgttacatttcctttatgttaaaaggttctcacagcacttttctgtatacttctattcaattaattgtaagaattttacttgtatagcttcttgtataatacaggtagaggaattttgtttctccagatttaataaaatggaatttcttcatgtatctttttgtaagcatgtttacattctagtgggtagagctgtccatttcatactgatatcagttttacattctgttttttctaagagcacactttgcaaatgagtagtcattgtaggggcaataagttttaaatgttgtagtaatgtgttcatcactacagacttcttataatacatatttaagtctgatacagacaggcctcagggagttatcaaaattatca

SEQ ID NO: 36386 - DNA, 1081 bp, Homo sapiens
ttaaaatctctcttgacttaattctcttccagtccccattgttacttttcttcgaattgggcttccttttgaatatctcaaccagctttttacctctacctgcacagaggggcacatcatttagtataaagtccaaattcgtttctctttctactgacctactttttagttgcactacacttactattccttgagtagatcttactattttcacgtctgtattctttctcgaatatctttcttttctaatgaattctatttttctttaagccctagctaaatgtcacctgcttagcaatgcattttctgacatcttttcctctccagaaaatcttcttatttgatctgatattttgaatatgtaaacctttgaaacctttatttttcttttatcgtatggtaattattatttgtctatgtctgtcttctccactgaattttgaactctttgagggcagtgataatgatatgttcatctttttcttcttggtagcagaatgattggcacttgtaggttcttggtaaatggttgaaagaataaattcttaactaacaataatagactgttttctttcattagatgtgaagttgggatgtataatcttcaaatttcctatattttctaacttctgtgaccctgtgattaaagtttgatattttaatattacacaaaattgtcgtattattaattttgagtttattctatttctggacaaataatacaatttcaaatttttaaattctaaaaattaatttcatttgtattatcctatgattaggtaaatttattttctcattttggacaactagagatcaaaggaaaaaattattggtgagaattttttaattaatggaagtggtaaccaaggagatatgcagaaagttttatattaaaacttgctgaactatacaactcagccatctaaaattagtcactttcttgagaagggtgggctttaattattagaattaactcagtttcttcatttacttgaaagtaagtatatctgaattgttgatatttcatgaaaatgcatagaacatatttgaaatttatgggaaaattgtttttggaggtctg

SEQ ID NO: 36387 - DNA, 1028 bp, Homo sapiens
agtggtcatttcttaaaggtcagttacaatgtagagtatagaaatcataccaaaaaactttttctattctcatacattaaaatccattgtagtttgaatgaaccatttctgactacatgcattgtcttttggaggacactggttcattgagttatgcatgtatttcaaatactaacacatttcactacccaacattaaatcataatagctaatatcaccacaatttcatcagaacaagcttttaagtattggaaaactgtcaaggtcatcatagcatataaaaatttttacaaaattcaaattgcttgaaagctttaattttattattggtaataaatgtcagtttttcttgaagtaagagtctcttcattcattcttgagaatgctttttatttatttatttgttttgcttcgttgtactcttgaatagaaaagttaaaagttctcttgctctcagtcattaatggaaagcattcaatctttcaccattaaatgtgatgttagttggtaacttttcctagattccctttatcagatttagaaaccttctattccaaatttttgagtgttaaatcagatgctttcttagcaccctttaagataatcttaaggtttttgccatttcttctattattatggtgaattatattggtggatttttgaatattaacccaactttgtattcctggattaaaacattcttagcatggtttctcattcacttatgtatccgtaatgcccaacccagtcccataaagatatagtatatgtccagtaagtatttgttcaattaattaagacagtgaaattccttaaatggttttcctgttttggaaactgttgaaaacttttgaaaaaaccagtcattttataaaccaaaacatactgctatctatcttattcagaagtcatttctcaacaacgttaactattgggaatatagatggtgattcagaaggaagtagagaacgttttgacagtcctttctttttttttttttttttttctttttgaaacagagtcttgct

SEQ ID NO: 36388 - DNA, 1048 bp, Homo sapiens
gtcaccagtgaaatacaaattaagtcagttaatccatactttgaagtttgcttttctgaaaggatttattactgcttatacttcatagccactagcatggctaaaatttaaaagaccatacagaggttggacaggtgcaactgaaactcccatacattgctggtagaaatgtgaaatgacataacccctttggaaaatcatatagaagttttttataaagttaaacctatacttacaacatcatgtagcaatcccccttctagatattaacccaacataaatgaaaatgtatgtcaacatagactagtacaagaagaatgttcataacagctttattcacaatagccccaaactggaacctattcaaatgtctgtcaacagatgaataaacacattgtaatatactactcagcattaaaaagtaatgagctatggttgcacgtaacaacatggataaatcctgaaaacatagtaagtgaaagaatttggacacgaatctatactgtatgattccattcatgtgcacctgtctaatctgtagtgatgaaggcagataagtggttgcctgaggctgatggtattgtgggggttgggggagagtaataggcaagagacattttggagcattagaaatgcctcttgattgtggtggtagttatgcaggtgtgtttgttgttaaaacttaccaaactataccctcaggactacgagaatctaatgaagtaaaattttcgttataaaagttataactagtttttttcatattctcatccccactttcattagtggatgtagatggactttaaggccactacttattttggaaaatttgctatttttaatagcatatacttacattttataataaaaagtacaagaaataaaaaaacctctccgttatatcacatttttagcatgcgaaatgggaagttgaaatctcttctctagtcttccaatcttgtagccttaatgactgtcaattttgatgtatacttctgcaacttgcagtctggtggaagcatatatattgattaaataaaaacacaaa

SEQ ID NO: 36389 - DNA, 1050 bp, Homo sapiens
ggtttatttagtctgttatatatgagaagcagagctaaaggaatatgcttttgttattttatgttttgttttgctttcttgaaatccagtggtaaaaagcacacactaggaaggatctaagctttctttaatataaaaaaaattatacttctctgaactgtttaatagagcaataattaaatacatcttctgataaattaagggaaatagcatcatttttcctttttgagaatggaatcatactattatgttcacagaaattaagcattattccagttttaagtgaatgactttaaaatcattgtagatggggagcccatatttctaacagtatctcatagttcatcattgtgctaggtgctttaagggattttacaaaatggcattaatggtacgctacttactgagggatgctacaggtaagaaaaggcaaagcagccctctctcaccctgtgaatattgtgtccattaagcagcagagaccttcagaagcaggagaaagatctggagatgacacaaaactgttaaaggctctatttagaaaaattcgactttaagattgggatttcagtctgaatgaatgtatagttgcattagtcagaactctttgaattgaaagtgacagaatttaacctggcttgagcaataagagtgtacattatttcatttaactgaaaagttcagtggtaggactgccttcagacatgcttaatcctggagttaagacaggaatcttctccatatcttttggttttgctttcctaccctgctgttttcactgtcaggaagactttccatgtgtcatggtaaagtggtcatccagcagcttgagacttctaccctaccatcttagtagtctcagcaaaaacaaagggccatttttctcaatatttccaacagaagcttaagactgacattcccttattggttgatgtgcccacccctgagccaattactatggacaagggaatattgttctcccagtagctgagcctgagtcatggtttgaccttgaggagacacaatggtgatggaactggttgagaagag

SEQ ID NO: 36390 - DNA, 1039 bp, Homo sapiens
gagcgaaggagagtttgtaattcacctaagcgagtgcgagttttcattccagtgcacaaggatacatttgcagacctttgctggccttattttgactttctgataagcaaaatggcctgtcatcagtaggcaacaagtgttgatgtcatgctttagagatttgcaaaatttgggtctgaaattcatggtcgccattagcactgccagctgaaatttctggaggtaccttattctcactttgacaccctttgcccctggatgtctttctgtctgtatctgcgtgaatgtccctgtccgaagtctctgagattttgtgtatttttacttatccctcctatcatatgttttcggttcataaaaaagcatgtgcacgtggtaagaataaaatagtatagactggtttgtagcgaaaaacgataactgcactacctctttccggaggcaatcacatttatccctttttgtttttatttctttggatatttagttatacaactcgaaaataatactaagcttgtatttccctttcttggatttactaagccttggtttcatcttttaaaatgagcagtcagttaactcacactattatttctatgttcctccaaattttttgccactgaattccttcaaatcttagatatcgttgcttgtaagacttgccattattatgtgtaccactaagaaaataaaaacatcaggaccaactgtgtaggatccatcctgttggacccatcatgatgggtttcatagatattaaaatgtcaaacagggccgggcgtggtggctcacgcctgtaatcccagcgctttgggaggcgaggtgagcggatcacttgaggtcaggagttcgagaccagcctgaccaatatggtgaaaccccgtctctactaaaaatacaaaaattggccggacgcgggggctcacgcctgtaatcccagcactttgggaggccgaggcgggcggatcacgaggtcaggagatcgaggccatcctggctaacaaggtgaaaccccgtctctactaaaaatacaaaaaat

SEQ ID NO: 36391 - DNA, 1046 bp, Homo sapiens
gagggaggcattcttaagggtcaatttaaactagattcttactcagtgtttatgtaacaaaacattggacaggggaccagaacccttatctctctaaggttgtgtcctaaaatgtgatcatttcaccccttttggtataaaacattttagtagcttctagggtaaagactaagaccctactaatagtagggtgaccatataatttggcatccaaattgggatacttttgtgtatgaaagagggagctgttaataattatgcagtgacagctcgcataaatggaacttgtccttggcaatctgggacatatttgcccaggttatcctacctaaaagttctttccctacatgggctggtcccagtctgaccctccagcttcatctcataccacagttgaacttgtttactcctctttagccatgaaatcctttattcagtcccgtttactgtgatcctcttaaaatagggactttgcatttggagtttcctttgaattttttttttgaggacgagacttgctgtgtcttcttggctggagtgcagtggtgtgaccttggctcactgcaacctctgccttccagtttcaagtgattctcctgcctcagcctcctgagtagctgggactacaggcacctaccaacgagcccgactaattttttgtatttttagtagagatggggtttcaccgtgttggccaggttggtctcgatctcctgacctcatgatccacctgcctcggcctcccaaagtgctgggattacaggcgtgagccactgtgcccggcctaattttacatttttaatagagatgaggtttcttcatgttaggctggtcttgaactcccgacctcagatgatccgcccacctcagccttccaaagtgctgagattacagacatgagccactgagcccggccttattttattttatttttgagacagtcttgctctgttgcccagactggagagtagtgagtggtatgatctctgctcagtataacctccacctcccacgttcaagtgattcttgtgcttcagcctctccag

SEQ ID NO: 36392 - DNA, 1034 bp, Homo sapiens
tgggattataggtgtgagctaccgtgcccggccctggatgcattttttaatctcctttttttgccttgccctgtcttcttatggtgctgactgatctctactttctgactggtaggactagtctggagtagggtacacctagacaaatgaaggacacccagggagtgagagagagtcatcctcacagaaggactagtgcagaggccaagcaaagttcagacactaagttccagaaccaagtagttcaatgcagaagccagggttggaaatgaccttaaaacaagtcaaggtcaaactggcggcatgttgaacaaccagcatgattaaagcagcagagtatatggtattgctggtggtagaaggtgcttaggagcattttagaaagtgttaaccaactggatttagattagttctataggcctcaggagaggataggcatgtgtcccagatacatggtactaggttttattgggaaagtacaaccatagtaaagctgtgtatgttagtcttaagtcactgctgtagaatgttagcaggaatataaatatatcctttctagctaattttctttttctttttcttttttctttcttttttttttttttttttttgagatagagcttcgctctttgacccagttggagtgcagtggcacgatctcagctcactgcaacctccacacccccagattcaagcgattctcctgcctcagcctcccgagtagctgggattataggcatggaccaccatgtccggctaatttttgtatttttagcagagatggggtttcgccatgttggccaggctggtcttgaactcctggcctcatatgatccacccgctgcagcctcccaaagtgctgggattacaagagtgagccactgcacccagcctggctaattttctttttaatggccagatacttgattacacctggttacttgttagaccaataaaattcaagcttacttgaaatgaaagctaatttggtttattaagggaggaaattcttaattagcatagaatgccagtta

SEQ ID NO: 36393 - DNA, 1018 bp, Homo sapiens
cgagacccgctctgtcgcccaggctggaatgcagtggcatgatcttggctcactgcaacctctgcctcctgggttcaagctattctcctgccttagcccccctagtagctgggactacaggcgcatgcacccacgccctgctaattttttgtatttttaatagagacgaggttccaccgtgttagccaggatggtctcaatctcctgaccttgtgattggcccgcctcagcctcccaaagtgctgggattacaggcgtgagccaccgtgcccggctcactcatgtggaaatcttaaaatatcacttataagccttaactgctgtggtcaaggggcaggggcaaaaccgttgtcaaacaaaggaagtaataaaattgaggaaaggggaatgtatatttcatgaaaattgtagagggttgaaatcaactcatgggggagaacatgctgttaatgtgctaggcttaatgtttttagaagtagtgtaattttgaaaacagtgcaaataggaattcattgtagcagttagcaaaccagttttttagttggaggaaaaataatagaaatctgattattttttaaaattacaggctttaaacaaaatagatattagtgcaaggtgcaccagacaagcagtcagaccttggacaactcttagtgtcagtttcttatttaaaatgaaatactaatactgctatttttttcttcaatgagtggtaaggatcaaagtggaatactgtgtgtgaaaactctttggatactgtagcaagtgctgtcatataattgttactaagtgttgctttgttaaagcagatattttgatatgaggttgacttacatttttgttttgttttgtaaaaattgtgatttatcattacttatttctgatgttgtgtgtagacaaccaggagtagggttttttttctttgtaaggtcactggttctatataaaaaatagcatcagtaaaaagtaatttaatatttttagagtgcatagcatctttgaatttttggcctttgcc

SEQ ID NO: 36394 - DNA, 1058 bp, Homo sapiens
ctgaaaggaagtgtttctatctggtttgaacgaatctataaactagtattttctgcttgttggtttacattctgtattggatttggtgggttagggatatgtgatgtttcttttcttacagacaccaccacagtcaagttgctattgcccagtcttcttattatcagtgttatcttagacattaaaggtttaatagatgaaatattgaagtaataagctttgggtaaaggcctaggtatattagcattcttaaagctcattatttaggaagtgactctaaaagtcacacagaattaccatcattcacaccatatcagcaaacttcatgatgcttttcctgtgtttcatctaccagttaccagcaggacttaggtttgaaatgccttgaggtgaatcatgcttccttttttgtttcagttctagataagactgactatgctttgcttcttcttttagcttgagaatgccagactgtcatcagagatgaatacttctactgtcaacagtgccagggaagaactgatggaaagccgcatgagaattgagagcctttcatcccagctttctaatctacagaaagaggtaaataatcatctttctgtaagaagttagacttgaaggctaccttcaccacgggcacctacctgctttgcttgggctgatgtcactcctccctctgtttgttacagaggatggtgtcatcctgtgctttcgtcttcacagtacttttctagattcgttcattttgcattgcataaacatcctgtgagcagatactattgttcctaattagtagattacacagagctaagggacttgcccttgaggaaggagcctgctagtttattcactgtacttaccctaggacccggatcttccgacctgtctaacagcttcatctctacagagttattctcaacaccttccttttttatatcatttgaaaaccaaaatgaagaaaaacatgcaaaaattctttgtgggtggtgaatgctttgtgtttctagacaaattctttagtgcttaaagtatataacaattaggatccaggaaagtag

SEQ ID NO: 36395 - DNA, 1053 bp, Homo sapiens
atgattcagcaattaactcgtcaccttaattattttggaaataacttccgcttctattttcctcaagggaggaaatcttgttttgaattttccacatgagaataaactttattttacttttttttttttttttttttttttctttttgagatggagtctcactctgtcgcccaggctggagtgcagtggtacgatctcggctcactgtgagctccgcctcccgggttcacgccattctcctgcctcagcctcccaagtagctgggactacaagtgcgtgccaccacgcccggctaatttttgtatttttagtagagacggggtttcaccgtgttagccaggatggtctcgatctcctgacctcatgatccacccgcctcggcttcccagagtgctgggattacaggcgtgagccaccgtgcccagcctattttactcttgattgggcttttcttccttcctttttctttttaccatttttagtaaaatatttttctaattataaaactgatgacctctgttgcaggaacttagaaataaagcagaaaatgagtcccataaaatggggtgatataaaataatttagttaacacaggggcttttacactgtctatcatgtgctttgttacttacggcacaaatttttaaattattttaaacctattttgtgctgatagtgttttgaagattttcatttaatagcagagctggaagcacctctgagttcattccatgtaaccacagatctaggtgagtttaatgatttgcccgttgcccagaggctgcagactgataaatgggtttctctactccttcccagtttttccttttataactcattttcttcaaagaagatttacttttagaaatttaacagataatctttttttccattgcaccatctgtcttagtccttttgggctgctataacaaactactattgacttggtagcttataaacaacagatatgtcagaaattatttctcacagttttggaggctgggaagtccaagatcaaggcactggcagattggatatctgcctggtgagggc

SEQ ID NO: 36396 - DNA, 1750 bp, Homo sapiens
cctttagccaaaatagtttttaatttctctggggtgaatctttcctctgttcattattggtaacagactttatggtaaacagtatattttgaggaatatttttattagttgataaattttagccttagaaaaatcatcaaaaataaaaatgttatctttttgaatattttcctattgtttgtcttaatagtgtttgttgctgagtcatatcagtttcatcatgctgcctattaggccataagaatttccttttggttaaataactcaggttagtgaagtacttcttaaattttacttaaaattgacatggctttaaaatactggttttacaagatatatttaaataatatatagatggtagcagtgttatgttttggaattagaaattttacattgcttatagcatctctagatttttgacttgggaccaaatgaattggttggttagagtctgcttgccttagagaagagtacagtatggtacttaaaaacacctctaacttttgtttttctaacacccagattctggagactttggttgcagctagaccttaataaaccagtacaattacattacatactataaaatatttaaaaaccccaagatcatcagaagtcataaaatttagggttagtggcaagatctgagagatcatctagatagttagagctcttcattttccttatgtggaaactggtttagtgagattagttacagcttgcttatagcctcataggtagtttcaatggcagaattagaaaggagaatctaggtctaacttctcatactgtgttccttatatttcactacacaggtgtaagtgcagctactgaaaatagaatttaaatatttctatttaaaatacagaatgattcagagtaactttaaaatttttatacctagattttgatttttccctcttaaagagctctacaacatcaaaggcagtcaaacagagacatcattgggtttataaatctcggctcaggttatctgtgaatcttgggtagtttatatctctcatcaactctcctttagattctacctttttgcccattcaaatatatcttctacctctgatatatgaaataaagggaggcattttgaacttacatgactttttttttttcttttggagaaaaagaaaatacaaggaacatggtagcggggaaatggatttctccatttatagcatgatttttgcaaacgcagttaaatgcaagttctctgaggttcagggactacctttgtaatatccatcttaagaggagtgcctgtctaaatagcatgtcaagtcatatactactctggaatttaattaattgattggtcaattttttttctttaaaaatatatttttgtgtgtgcgtgtgaaccaggcaccccctctgcccccaaataggtttacagtgactcttgattattttttaaataaccttgttattttggcataattttagatttacagaaaagttggcaaagtactatagacagttcttgttttcctctcacccattttcccctgttgttagcatcttatgttaccatagtatatttgtcaaaactaagaaactgacattggtatattactgtgaactcgtctccagactatttggatttcaccagttcttctgttatcttctttctgttccaggtgccacatgcctcccctggtctgtgacagtttcttgggctttccttgttttttatgagcttgagtcttgagtaagattgtccaggtatcctgta

SEQ ID NO: 36397 - DNA, 1061 bp, Homo sapiens
accatgcccagccccactgaccctttttttgagccccttatgctttcatgtatgagagctgaatgtgggcagaagtgggacagatgcagaaggaaaatgacagattttcttctgtttctaagcttatgtgtctattttaaaagcttgaagtaatccaatacttgatgtttaaaaattgtgattatgacagctagatagtgctgtaaatttgaaagacccaccttatctagcagtgaatttgaccatttaatttggttcataccctgttcttccagttctgtcctctttaaagtcaagtaccttactaattaactcattgttgaagttactgtttgacaaaatgacagaatcgtgttttctttttatagtaggaaaacctgaaatgtgggaagatgaccataaagcggtcttagtttaactgcctgtatggattaatttatttgattattccacaactttctttatctttgaagtaacacccctcaccctcctttctgtgtgtaggatcaaccaatgggaggctgggagatgatcagaaaaattggagacacatcagtcagttataaatatacctcaagatatgtgctgaaggcaggccagactgttacagtaagtgaatctagtcatcatttaatttaacttcattgtgttaactaacaaagtaactcaaaaagttttttggctaaaagagaagcattttagaaatggccgttaaagtactttttatattattagggcattacaagtgctataaaagatttttaaaattctgtcttattgagagtagtgaagaatggacctttgaattatttttatcttgtctattccagtagatataaaagctatctctaggctgatacttatagcccagtgtcattcaggagacactgcttggcataaagaactgttaagaatttagcattaacatatgcctaaaacagcaatctctagccttgggtgagcttcagaatcatttgggtagtattttggtgttcaggccctacttcaccctttgctatctttagggttggggtaggagcctaggttttgaataaaagtcc

SEQ ID NO: 36398 - DNA, 1030 bp, Homo sapiens
aattttaaattttcttatagccgcattaaagtaaaaaagaaagacatgaattttagaactatattttatgaaacccaatatatccaaaatattgctttaacatgtaatcagtctaaaaagtcagatatttttacattcttttttttttatgtttagctaagtcttcaaaatctagtgtgtattttacccttacagcacattcatttcagactagccatattttaagtgctaacaagccacattttgctgcggtattgaatgacatggctataggacatattagttttaggttaagttagccagcaaggatactgacattttatgatgatgattactaacataaatcaactatgtgattacatataggctagtgagaaatattgcttacaattagggaaacactaacattccacatagtctgaatgttggaccagattcagttctttttttcagtttaatcccagttaatatcttgtgcccttttccatttgtaatgctgatgaaagatctggatgcttcaggggaacatctcaaaagtaagggctctctcctaatcagtaattcatagattttttttttcctgtttccaccccacccccccaccctttcttttttttgatagagacaggatttcaccattttgcccaggctggttttaaactccttagctcaagtgatctgcccgcctcggcctcccaaagtgctgtgattacaggctggagccactacacctggcccccattttgaaataatacttggctttgccatcttcagctttccttttgcagtcataaagtcttttatattctataacaatgtatggattacaaacttttctgtttctatttgtttttaaatgatctttctaagagatcagggctagtagtatccctgtagctaaaggcattgagtttcctagaggtgtagtgatttgtccagaattcaaacctaggctttctgactgccaggtgttcttcactctatccattctcttttgccagtagatatataaaaagaatttcatgctcat

SEQ ID NO: 36399 - DNA, 1031 bp, Homo sapiens
gtgaaggagtttcactctgttgcccaggctggagtggagtggcatagcacgatctcggctcactgcaacctccgcctcctgcctcagcctcctgagtagctggaactacaggtgcgtgccaacacacctggctaatttttatatttttagtagagatggggttttaccatattggccaggatggtctcaatctcttgaccttgtgatccgtcacctcggcctcccaaagtgctgggattacaggtgtgagccaccatgcccggccaaggttggtccattcttttaacaaacttctaataccttcagcttgcgaggctctgttttaagtgagttctgtcagaaatgaggagagaaagtattatgaatacaggtcttatttcactagacagttacttttggcatttattcatttaattcgataagaccatatttgtcagtagggaccagaccacattaggaacaatctataaacaatccccgccataaagaccagtttgcagtaagattgttggtaactggcttagtcagttttgtttcttatgtttttttttttcttcttgctggggcattggaaatgtcagaaaacccaattaaactggcttagaaataatggaaattttttgggctcacataataaaaaatttaaatagtggacctaatccagtggctcacagcatgtccccggggatctgtctgttgtttctcttctggttgcctcccttggggacgcaggatagctgctggctgctcccagaggtacgtcttttctatttgctttttgtgggaaggtgatctttcaaaaaagtgctctttatggtggagtttatagattgttgctaacgtggtccggtactactgacagataaacatggtcttacccaattaaatgaatacataccaaaagtaactgtctaatgaaataagacctgtattcataccactttctctcctcgttcctgacagaactctctcagaacagcctagcaagcagaaggcagtagaagtttgttaaaagaatggacaatccagcc

SEQ ID NO: 36400 - DNA, 1030 bp, Homo sapiens
gtgaataggagtatgactagacagaagatagtagggatgacaagttttttgggggcacagtctaagttggtctggtgtctggaatgatactggggcctaataaaaaggagcgtctatataggagcttaaatgggctgtaccctgtagcagtccgaggacaggcctgaattctgagaagggaaagtggtaaaagtattgtccagtcctttttaagttggtggctgagcttggtgaggtgtgtttttttaaaagacctttagtcctacttttcttgaagacggaggaccgtaagggatataaaggtttcactgaatactaagagcctgaaaaactgcttggctgatttgactaataaaggctcgtctgttatcagactgtattgaggtgggaggctaaactgaggaattaagtctgacagaagggaagaaatgcctgcagtggccttctcagaccctgtaggaaaggcctctacctatccactgaaagtatctacctagactaagaggtgttttagttatctgactcggggcatgttgagtaaagctaatttgccagtcctgggtggggcaaatcctcgagcctgatgtgtagggaagggaggggtcctgaataatccctgaggagtagtagaatagcagatggaacactgagaagttatttccttgaggatagatttccacaatggaaaggaaatgagaggttctaagaggcgggctagtggcttatactatagcataacctgcctttgctggtgtgtggcgattaggcctggtggacccaccatcaataaatcaagcgtgatcagggtgaggaacagaaaagaaggaaatttggggaactggggtgaatgtcaggtggatcagagagatacagtcatgggggtcaggtgtggtatcaggaataatgtgggaggccagattgaagtctgggtcaggaacaacggtaattgtgggagactcaacaaagagtgagtacagctgaaggagccgggaagcagaaagtatatgcgtcaggtatgaggaagaaaata

SEQ ID NO: 36401 - DNA, 1077 bp, Homo sapiens
ggccagatttccagcaagtgtagcaagctcctgtgggaggaggttctggaggaacgcctggccgctgcagttcaggcatttggaagttcttatgtgctggagatgtggctggggtttgtctcacagtggaggcaaggaattgcaacttttttctattatggtacaccttgaaggcgaggttaattaaatcctgttgtggggtttgagagccggaatttaatttttggagttttatttaatgtcgggagcagattgggcaataaaatgtattttgagaataagacggccttttgaccttttagggtctagggctgtaaagtgtctcagggttgctgccaaacaagtcatgaactgggctggatttttatattcgatgaaaaagagcctaaacgctatccgatttgggataaagaaaaaggagcattaaccttgactgtgcttttagctccagccacctttttaagagtaaattgctgggcaggagggggagggctagtcacggaacgaaactgaaagccggaccaggtgtgaggaggggaggtgataaaaagattatagggtggaggagcggaggctgaggaagaattggcacctagctcggcctggcgaggagcaagcaggctggggaggaagggagaggtcagatgggtctgtagaaaaggaagattagaaagactcagcgacacttggggttggtactgaggggacaggcgggagggaaagaaggaagatttggcacgagttgcactgggcacagagactaggaagggactgatgtgtaaaagaatgcctggacgtcaggcacctcagaccgtttgcctattttacgacaagaattatttagattttgcaggatggaaaaattcaaagtgccattttctggctatttggaattactgtcgagtttgtactggggtcaagcggcattgcagaaaataaggcatttaggttttaggtcaggtgtgagttgaagaggttttaagtttttgagaacacaggccaagggagtagaaggaggaatggagggtggaaagttgcccatagtgaaggaagcaagcctagagaaaagagagtaga

SEQ ID NO: 36402 - DNA, 1044 bp, Homo sapiens
cttcaggcatcagaatcacaactctacatttctcatctagcactagggactacaagttgtgtggcagatcttcaggcagcttctaggaacactctggattgaagtggaaaggaagcatttcctgatttcattttctagctgtctttcctactcaggttctttgggccatgggtcatttcctagtgtggacagctccataagctgtgtggagtgtcaggcaaggctgagcggattccaatatgggagaaagatgcacggtgcaggcgcagacccagagcccagccagggtcagtgtcccaatgggaacaataaggatctaggaggaagtggaaccggaagctggctgcttgcccaactgtggggtcacttgggctgcgatttcacctccattttctcctttggctcctccatgccgcagatgaattattttcactgaaaatgaaatgcctatggctacagccccactgaaagtgacaatccacggcagggcccaggcactaggggcaggggagactaggacaatgaaagacaaatcaaagtaacttccaaatcatgccatttatttttccttaatggattttacagctcatctgagtctctgctgtgttctctgaggagctgtagaatttgtgtcgatgctctgtgtcctccgtccttccccaaatgagcacatatgcagggcaggcaagagcatgctggatttgtcttagttgttaattcaccttctggcttcactgtgacacacatttatctctacatgacattctcaagaaaaatgattaggacagaatcacagcaaggagtgtggaagagggagtttttttaaaaagtcagttaaagagaagcaatgaaccacgagggtcctttaggtaaaggacccccactcctcatctcttcctcttcattcttgatctttcaaaaagaagcacaggaagaggactaggctagcaagggtgctggtaggctgcatggtgcctctgtacccattaatacctgttaacaaaaggcaccccttcctgcaggaggtgtagccctttccatggg

SEQ ID NO: 36403 - DNA, 1059 bp, Homo sapiens
aatacatgatggtagaagcagtgacataatggtgcctgagagatccttgtcttttttttttttttttttttttgagacagagttttgctcttgttgcccaggcggaagtgcaatggcgcgatctcggctcaccgcaacctctgtctcccaggttcaagcgattcacctgcctcagcctcccgagtagccaccatgcctggctgattttgtatttttagtagagacagggtttctccatgttggtcaggctggtctcgaactcccgaccttaggtgatccacccacctctgcctcccaaagtgctgggattacaggcgtgaaccatggtgcccggccaaggtgcttgctttttatgtacatatattggaatgagatgcttaaacctgtagtctgttttggagaaggctggcataaaacattgatggaccgtccaagaaattcagagtctgatgtgtaggtaagtgctggaaaggaaggagaccatgagcttggagtgacaaatcaggtctgggctgtttaattatctgggagtaggtgtgttgtgttgatcccactaaaggtctatggtggtcagaaagtaggctggcctgatgacttggtctcgagtttctggaagtagatgaaaggcaggcccttgatcagaatgggctttttagtcttcatggcaggatcatgaaattcaaggccacttattcaaatttctgaggctagaaagcagatgccacgggccgagtgccagagagggttgagtatgaaaatatacgcttttaaactcacacagaagtgcttttctccaaaagtccctgaacatgctaaagtggatcagtttggtttttttttcaagtgtgattctcttgtatctattctgtcctgctgctgcttggtgccactcacgaatgtaggagaggcaggctgggaagccagctgttcagggccaacagcgggaaagaggtggaatgcagacaattattatactaataaggaactttggcaatataagaagtctggaatctgggaacattacgggaaagctggatttcaaatcaagagtcccctttt

SEQ ID NO: 36404 - DNA, 1027 bp, Homo sapiens
agctgcttcttttacttatgggagttgaaagtcatttacactcaattatatttgttgtatattttaaattacacattttaaaataattcttgggatatgctttggtaagttaaaaattttgcaagaagaaagtaattagacagtttgaaaactaaataaaaaacatttctaattctgtgcttttatcctctccacttttttctagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtaattctttctgatactttgaaatacatggctattaattaatgttttattcttttttaaaataatagctttgttgagatataatttatgtactctacaattcacccaattcaaagcatacagttccatagttagtttacatcagaattgtgcatcccttgtcgcaattttataaccttttcatcactttaagaaagaaaccctataccttttagcagtcagcccctactgtcccccaaatcctcacagctctaggcaactactaatctactttctatgtatatggatttgcttatcctggtcatttcatatagatggaatcatataatacgtggtcttttgtgactggcaactttcacttaaatattttcacttaaatatttaacttaaatattttcaaggttcatccatgttgtagcatttgtcagtact

SEQ ID NO: 36405 - DNA, 1043 bp, Homo sapiens
gactttttaaaagtattttgtctagatgtccaactgtaggggaaaagataaatatccttggtgcatcttgctatattatatagccattctaggaccagtaggcatgagttctccatttatgagttattggggaagggggtatcttagatgttgacaacatgcttgtgacattgtgggattatgtggtgattagcaaaccagttactgcttctgcctagacagacattaacaaagtagttggacaaataacatagttaataactgttttttaagtgttacgaaagaaaaggatacttgtaaagatagaataggacctaattttaattgggttttgggaaggcgtttttttgagaagtatgacattgaagctgagacctgaagggtaagttgatgattgggtggaatgacagtcctgaccaaagggacagcgcacatgaaggtaatggggtgagaaagagtggtatattaacataactaaaaggagataactatttttcattataaatgtagtgggacgctattgaagaattttgtgtggggtagccacatgacccattttgttttaacatctttaggctctgggtggagaatggattggcaggggcaagaatggaagcaaagagactcaagtgattactgtggtctggttgagagatagtaaaggttggtggcacaaaggattggatgtgggagtgagaaagaagctgacttgtagattttgaacttgagaaacttaatagatgttggtactgttgcttgagatgagaaatactggaggaggaatagatttggtggttgggagaagtttgtatttgaggctattctgtttcagtagcctataaagacaaagacaacttattccaagagtcgtggaggaggctctgtgtgtgtgtgtgtgtgtgtgtgtgtgtgtgtctgtatataaacatatgtaaatatatatatttacatataaagatttggttgcttaaggtcatggactaaattacttagggagagtggtagataagagaacagaaaatagggtctggcattggacttgg

SEQ ID NO: 36406 - DNA, 1032 bp, Homo sapiens
tttttctactttggggtcttcatatatgttgtttctcttttctggtatactctttttccctgatgatcacatggctgattcttgctcagcaaactcttagcttaagtattgtctccttccttatatttgcttagccttctgtaaccacattgaattagattctctctctctctcatttgttattcacaaatccctgtttccatcagaacatttactgctgtttataattacctgttattttggtcatttgctattgagactcttaaattccatgaaggcaggaacaatgtctaacttgtttatattgcatctccaagtactttgaggtgctagaaagctctagtacaggacctgacacatagtagctgctgaagtattgaatggatagatggatacattacagttagtcggttatcttagagtcagagatgaaaacactaggtctagttgaagcttttattgttgttgaaatagaaaggaactttacttagggtagctaattgtctgacagcctcaaaaatcaataggtgactagacagcagagaaagctgtggaccaaaatctatacagatagtaaagtaagttggaagctatcaaaaagttgattctatattattatgatgttgcttttgttttccttttttttttttttcttgagatggggtctcactctgtcacccaggctggagtgcaatggcatgatcatgggtcactggagtgtcgactgtccaggcttaaatgattctctcaccccagcctcccaagtagctgggaccacaggcatgtgccaccactcctggctaattttttaattatttctagagtcaaggtcttccttgtgttgcccaggctggtctcaaactgctgggctcaagaaatctgcctgcttcggtctcccaacgtgctgaaattacaggcgtgaggcaccacgccatgcccccttttgtttttctacctcccttcttgcttcttttacctcagagattgaggggattatccacattttgatttgcatttgggctagtcataaca

SEQ ID NO: 36407 - DNA, 1079 bp, Homo sapiens
tttttttaatttttaattttttcttgagatagagtctcactctgtcgcccaggctgtagtgcggtggtgctatcttggcttgctgcaagctccgcctcctaggttcaaatgattctcttgccccaatctcccgcgtagctgggactataggcgccagccaccacacccggctaatttttgtatttttagtaaggatggggttttaccatgttggttaggctggtctcgaactcctgacgtcaagtgatccacctgcatgggcctcccaaagtgctgggatggcaggtgtgagccactgcgtctggccagttgttctgtatatcccctaaaactgtaaatatctaattggacaaactaaaatatgaatggataaaatctgaggatgttcaagagcaaagagcccctaggaggtaatgcttttataacagcatgtaatatatatatatatattagtgtgtgtgtttttatatatgtaatatgtaagtgtactgttttagaaagcatggaatcatcttgcacatggtcatatttgtatgggtctgtttttggattcttgattctgttctgttgatcttcgtgtctgtccttgtgccagtaccacacattcctaattactgtagttaaatgataagttttgaggtcaggtagattaattcctcccattttagcctttctaaaaaaattgttctagctattttagttccttggtctttccatataaaaatttaaaataaccttatgtgtgtgtgtgttttaattaattaatttactttttaatatattttcacttcagtagtttttggggtacatgtggtttctggttacatggatgaattgtgttgtggtggagtctgagattttggtgcccctatcacccaagcaccttacgtttatttttaaaaagtcttgggattttgataggaattacgttaaactggtatatcagtttggagagaattgactttgttgagtgttcaattcataaatatcatctctccatttatttgtattttctttgattttctttcagtcagcattttgtagttttcagcatatacgtcctgtatgtattttgttag

SEQ ID NO: 36408 - DNA, 1052 bp, Homo sapiens
ctctcagtttgaattcacctgaattcatgatcttagtgatcaatcctatgttgttggtgttttttttttttttaagtcttctaagaggaaatgtttgaacatgtacacagagaaagcaatataatatacctagtatctacattacccagctttatcagttatcaatgcatggttaattttgtttcatgtgtaactcttcctatcccagattatttagagcaaaaccctagactttatatcatatcttttcgctggaaatatttccacatttagctctagaagataaaaggttagaaaaaaataaccacaatactatcttaacataagaaacagccttcctaatagaagtacatgatggcacttacacagtattcttgccaaaacttgtacctcattttgattaactgtctagatagaaccagtttactagaattatagaaatgagaagaggttaagcaatacaatgatgatgaagtcagaaaaatccagagtatgagatctccatgggagaaatgatagaaaaataataaaaggaaaaggaaatgtgaacctgttgattgaaaaagactgaagagacgcataaaccaaatataatgtgtaacctttttttttttttttttggatcctgatttgaacagactatttttaaaagataagaaaggacaatttagggaatttgaatgctgacttgccttttttgtggtactgttaagcaattattaagtttctaagctgcgacagtggcattgtagttaagttttcaaaagtccttacctgttagagatacgtactgacatatttatgtgctaaaggatatctgggacttgtttcaaaatattgtggggaatagccctaagttgatcattgttgaaattaggtgatggatgttagcagttcattacactcttctctctgccattgtgtgtgtttaacattttacgaatgaaaaggttttcttaaggtaagggctagtggtaaataaatttgtttcagatatttgtaatgcacatagcgttgttgttattattattataaaatgatccctagtgtta

SEQ ID NO: 36409 - DNA, 1555 bp, Homo sapiens
atgacaattttttttatttatcttttgctacaataaaatactaaaacttgtgtgtgcacacaatcttggaaatagaattttctaatgtgtttaaaaatcttagattgagtgaattttgggggatactttggccctctgtgtctgcaggttccacatctaaagattcaaccaaccatggcttgaaattatttgaaaaaataataatacaacaataaaaataatacaaattttaaaaatacaatataactttatattgtattagctattatgagtaatcttgagatgatttatagaataaggggggttatgtgttgtttatatgcaaatactatgccattttatataagggacttgagcatttgcagattttggtatcctggaagggctgaagggagaccctgaaaccaattccctattgttaaacatactgagttgcaaatcctgatgaggttgcaagaaaaattgatggaataactgaggaaggaaattaactagccagatgtcagcaaaaacttttgcatgattggtagaacaaattcagattttagtattgatgtgattcagaactgcattcatttggacttttgtttatagtttttaatggctgttatcacaatatataaatgagaatgccactgtattataatttttaaaaagattatattctctttctcttagtaaaaatatgaaaattttggtagatcataaaagtacaaaaatatgtacatttagaatttttcaagtgttttatttttaaattatatttttgtgtatgtttaattttaagtaatatcaatggaatagtatatgtaatttataagtaaatatgaatatggaatgctgaagaatttttgttaagagtgtctatagaagctgtcaatttggaggacagttttatcacttcagaaaacattttgttgaaaataatatatctgtaaagttatattgaccctatattttaggctgctggtcttggtcgtatgaagccaaacacacttgtccttggatttaagaaagattggttgcaagcagatatgagggatgtggatatgtatataaacttatttcagtaagtatctttttaattcaataatttagttcatttagaaaatgttaattttgaaagcttgtcctaatttttggagactgtttctcatatagtctcttgtaatggaaatataagaacgaaaagaatcacacaaagcatctgggttttaaattgataatctattaacaattttttattgatctttatatgtctctttacatacatgcatatatatatatatacacacacacacacatatatgtatgtatatgtatatatgtatacactctggcttctcatttaagtttgtaaactttttcctatccctccagctgttgctgagcagagttcccaaatgtcagacccatcacctcctaaactatgtcattataatgtgctgaggaagagtgttttatcgctgtttaggcttgttccccttccaaacaaattttgcagttaatcatttggttcattcattaagttatttacatttcttttatttaaatg

SEQ ID NO: 36410 - DNA, 1046 bp, Homo sapiens
aatgttgtggaatttgaaactaacatacatatctcaacaagtgattttcaaagcatgttttaaaaatcagacgtttaaagccgaaagtaattttagagatcatctattatttattttaaagaggataacacaaatttttgtgattttttttttggttttttcattttttgtttttttgttcttagtgatgcttttgacatacaatatggagtagtggttattcgcctaaaagaaggtctggatatatctcatcttcaaggacaaggtaaattttgttggcaataagttttttatttacaaaaatataaactactttgttagaaaattatattctcacaaactgggctcttcgttacttttaataattatgtatcgtggacttattgtatggcattttaagatcacatctgtttggctccactaaagtttgtgttttctcgttgtaccaacctggatgatggttagtgattatttggattgaataaaattcaatccaaagcataagcttaagagaaacagacattagttatgtctttaaaaaacctggccaacagacaaacctaagtaaaatagcctgaggaaaaatttttaaatgaccactaaatcattagacattttcatatttatgaaagtatgctttgtacagagtcatattgatagaagcctaaagtttgtcataacgttttctatcttcagcagacctaataaattttttaaaaacattttttaatttaaaaatatttatagattcacaagaagttgcaaaaaatagtagagaggtcctctgtacctttcatccagtttcccccaatgataacatcttgccttatcctaaggtactatatccaagccaggaaattgacattagaacaatccacagacctttttcagatttcagcagtttacaaagacttgtatgtggttgtgtagttgtgtgccacttatgtgttcatttgtgtaaccaccattgcaataaagatacagaactgttctgtcactacagaggtctccctatgtgttccccctttctacttcccactatgtac

SEQ ID NO: 36411 - DNA, 1034 bp, Homo sapiens
aaaataacctgttctcaaacttgtactggtcatttctagctggtcaggtaaaatttatggctttcaaaaatggctacaaaatgactagctgtgtaaggtattagagtagatcatcaaacagaaaccatgctagttatttactaatatggcttctgtgtttttatttatagttgctttaaataaaacattttaatttgaagcataagttaaatctgaatttggaaagaacatggtaattttaaagtaacaaactcatgactttcacataatttcatccacaaatctgtgtcatgtttgagaagaaaagagggatgacttccaaatcttactctcccaccctcactctcctacctctgttcagtctagtatctccatctgtcctattcccagctgacacgcaacaagaaaataatctgcgctgtgaatcatcaaactgtaacatacttttgattcctgcaaaatatttcccattctttttctgaaattgtaaccttggaccaatcatgtctctgtacagtttatctcttctatattatttagaagcagtaatgttgctttttatttctttccttctcatttaccttgttggcttagagtattagtaaagtttagttcacacccattttccttttcagttctttgctgacttgattataatttattttgtttttcctcaaaattctataaactgattctgataactgttcctatattccagcatttattttagtttacactatacattctttcatttcctcttttttgtttttttcttttgcttcaaacattctttttctacagaatctgttgggaattaataggtgaagtttaatgggagggtaagaagaaatacatatcaagcatctactccgtgcacccaacattataatggatgttacccatacattagctaattaatatatgttacgatcttatgaaatcattatttttatagaacaggaaactgggtcagtacatttctacttacctttttattgtaaaaatctaaatgcctttaacttactttataattg

SEQ ID NO: 36412 - DNA, 1035 bp, Homo sapiens
ccatctttctgtggttcagagaaagatgtggttatatggctttagaattgggtgccacatattggggacaaaacataggtaaaaatgagaagtctttccttagactaaggtttcactgtgataattgtaagaatgtgttagtatgtcttcaactcccatctttcatttatattgcagataacaactttgtcttttaaaaagttttgagctttaaattattgagataccagattaccaaagaaatagtttcacagaacaggtataaacttgatttgtccagtttgactaaaacagcttttcaaaacaaaatctagcagctcactgtaattttttttattgttatttatgattctcttacattcattcagaatgcttgaaaatattagtaagtaggcagataatttggattggtttagctattgtaaagagttatttctctctagccatttataaagtatacttttattataaacaactgaaagtttatggtagatgccgtatacaattgtctgaattatctgtagtataaacatctgaatatacaaacattaggaaatgataggaattcagcaaaagggactttaatatttactttgcttacattttatattttgcttaatcctttagaatccaaaggccctattgtgcctttaaatgtagctgaccaaaagcttcttgaagctagtacacagtttcagaaaaaacaaggaaagaatactattgatgtctggtggctttttgatgatggaggtaaggttgttaatttttttaaaatgattttaaatttactgacattgtgagaatagtaagaaatgacatgcactctttacctgtggaccccattcaaattttgccagcattcccaaaagcaaaaggattaatttcagaatcaggcacagcctttagttgtctggtctcttcagtatccctaatgcggaggttgttcagtagtatttccttgagcttcatgaccttaacttttttttaatatgaaccattttgttgactgtaacccaatttgaagtgctagttaat

SEQ ID NO: 36413 - DNA, 1935 bp, Homo sapiens
ccccacaaaaaaagccaagtaatgaaaaaaactaccaaaagattgttagtttaacaacattcaataaatcaaaaagtttcaagttttgctgatgataatcaaatacctgtaaatggaaaagacaccaaaacatagaaatttagagaaaaactatacagcaattggtcactgctgccaccatccataaatagaaattaaaactaagagaagataaaaattgcatttatccatatatagcttctgttttctaaattttgatagtaaacatacctttcacctaaaagaattctattcttattaaagaaggggaaacctaggatttagtgttagatatcagaggtactgtggtttatagaaatacttactgttcttatgaacaaattttgaaaaatcttttgttgaaagattatagtcttttatatatgcatatatgatggtggtaccataagattataataccatatgttaagctgggcatggtggtgtgcacctgtagtctcagctacttgggagactgaggtgggaggattgcttgagatctggagttttggagttttgagtccagcctgggcaatgtattaagaccccatctctcttaaaaaaatatatatatatttttactgtatcttttctgtatttagatatgcaaatgcttaccatcgtgttacagttgcctatagtattcactacagtaacgtactatacaggtttgtagcttaggagcaacaggctgtgtcatatagcctagatgtgtagtaggctataccatctaggtttgtgtaagtactcctgtgatgttttcacgagggcaaaattgcctgacagtaagttctgagaaatgcgtctccatcgctaagcaacacaactgtggttgttattctatttgcagaattctcctgcactcagaaatattctgtaattatagtaatttacagtaactgttattgtaatctactttataatttttgctacattttattctgtaaatgcattgctcagggttttttttttttctttttctctttttgataccaggagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgctt

SEQ ID NO: 36414 - DNA, 1028 bp, Homo sapiens
ccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtccattcttatatctgtttaataagtctttgccagctttgtggttttatctcatttcgataactattgcttcattcatttctgaatttttaaaatagcttttaccttaatattcacgccctggaaaagtcgttcactattcttaaacctttgcaataatcactgttgatgctcacagtatgactgaaccatctgagatgcagctcattatggtatttttttaagtgacctagcttttctaattctgctttatctttgggccagatctctcatttgtgaatgaggaaactggaagattaaaagcgattcatagtccctgaatataatctgat

SEQ ID NO: 36415 - DNA, 1052 bp, Homo sapiens
atgttagcattcctataaatatatttataggtttctaaagggatcttaattgtaaatatttatcctcattagagggtaagttttttaacatatgctaagttttagagtgtagtgtttaatatatgagggacatcagaatagcctaatacatttattgattgattatatgaagcccatttaatccttgaaatacccctatgatgtagatactatttttcttgctgtgttacagataaggaaattgcatatggagatatttacctaagttcatgtaatcgaaattagtgaaattgagatttgcactcagattctaatgcctactgaggcttgtgctataaaggggatctttgtaacctgggggagtcacatcacagacctctgttgtaagtgagttgacattggagccaggccttactatagctgtggtcatcggatttcctcagaaacacttgggagtgaaataacgatgccccaggtccccttccagactttctcccaaacagatcatgcctattttgtgactctaattgactaccaaattttttaaacatcgcatttacagtttcaaattttaattattccaaatccctatagtaatttgctatgggctgggtgatgtgaaaagtcttttgagtatgaaatctaaggtcaaatcccagctatgacaattcttaagaaagtagacaaaatatttatacttgaatctgatctcttaaactcttgcttgaggaagccattggctatgatcaactttttatatttaaatatatatatatttgtatatgtatcatgtgcaaatgtgtgtgtaggactatgtgtaggcatatagatatacgaaggtgtgtggatacatatatttatatgtgatttgtttatattccttaaatatgcatagatctgtaattgctatgcttttactcctggtgacatttggtccagtccacttttaatttgctgaggcaggactggctgtcttacagttgcaacatgtaaatgtttggctactggcgatattttttaattaccttaaagattttggtttaagagaactt

SEQ ID NO: 36416 - DNA, 1032 bp, Homo sapiens
gttttgctgtgtgatgggtggagtgttctagagatatcagttaggtcagtggggttgatactgtttttcaagtttctatatccccactaattttctgcctagtttctctttctgttattaagagtgcaatattgaaatagccaatcattattgttgagtactttatattttccttcaattctgtcatatttttacttcatgtattttgagactatgttgttacctccatatatgtttgtatattttatattttcctgttgaatcaatcattttattattatcaaattttcttctttctcctaggagcaattttttggtctgaaagtgtgtttcttttttctgttattggtgtagccagtccatctctcttttggatactgcctgcatggtacagttttcctattcttttacttttagcctccttggttgatatggttaggctttgtgtccataccccaatctcatcttgaattgtaatccccatgtgtcaaggctgggaacaggtggaggtaattaaatcatggagggcattttatcccatactgttctagtaatagtgagttattgcaagatctgatggttttataagcatctggcatttctcctgcttgcattcactctgtcctgccaccctatgaaaaaggtgcctgcttctcctttgctttctgccatgatgttaagtttcctgaggcctcctcagcaatgcagaactgtaagtcaatgaaacccctttcctttataaattacccagtctcaggtatttctccatagcagtgtgagaaaagactaatacagtgtcatttaaactaaagtttatctcttgtgaatagaataggattgtatcatggagtgttttttgttgttgttggttggttggttaggtttttttttaatgtctattttgccagtctctacctttggattggagtatatgaaccatattatatataatgtaaatattgatatggttagatttatatcagccattttgttatttgcagtttctcttttattcctttcttttgctttaag

SEQ ID NO: 36417 - DNA, 1035 bp, Homo sapiens
attttcttgttctctgatcttccttaaaatagttattttgaattcctttttaggaagtttatacgtctcattttttttggggggggcatgtcattggcactttatctttttgtttatactatttttctttattctttattgttgtggtcatgcatttacgtcattgcagtcttcgtagactggctttatctgggaattcccttcaccagtcagcccatctagaaattcttggaaggctgtctggcatagtcccaaagcccaaggttgctgaggccagcacaacgctgaggtaggataaaagcctagggccactgggatgagctagaagcctgcggctactgaggcctgctgctgctgaggtatttccagatcctggggctgctgaagtttgtccagtgatggtataaacccgggattgactccacctttcttacctgaagtctggggctttgggggtcctgcttggtgctgggacaggtctgtaggctcagtcttcaggtgccagccaggattctggggctgtggtggcctgctcagtgctgggctttacactgaggcaagcttggtgttggtgtccaaaacaaagtcctgtgctcacattcctctctttcctgcaagcagagagtatctgttcctgcattgtgctgcctgggtttggaagagaggtgacatggttaatttcaaactcttttctaccctcttcagttcagtgtgtcttttcttattgtgctacaaacaggtcctgtaattgtttgcctggtttccttagctcttgtgaaggtattttcatttatagactgtttttcagatcaatgtttctgtaggggtatgatcactagagagtcctattacactatctggctctgcccttctgtttttaaattttaatattatctatttataagccagaaaaatattatattctagattgtgtataatatatataatctttgccaatttctgcaaatccttacaataccttaattttcttattttagtttgctaaaattgtatgacaagccttcacagcaaatt

SEQ ID NO: 36418 - DNA, 1042 bp, Homo sapiens
agtttgagaccagcctggcctacatggcgaaaccccatctgtactaaaaatacaaaaattagcagagcagggtggtgggcacctgtaatcccagctactcaggagactcaggcatgagaattgcttgaagctgggagggagaggttgcagtaagccaagattgtaccactgcacttcagcctgggagacagaggagactccatctcaaaataaaaataaattgttttggccattctggcctctttatatttctatatacattttaggatcagattgtcagtatcttcaaagaaacttcctggactttgataggagggtttaagcttaatctgaaattcagttttctgaaattccattttggaagagattttatcttaaacaatgcaaaaccgattatttttttttctctgtgaaaatgattattactagagaattggtagggtgtgtttttgaatacgctgtttatttgtttgcttgatttgaaccctgaccctaacaactttggtctttttcatagcagtaggcctgaaacacaatagtggagtcttgattaaaaagaacaaaataagctactggtagtccatattacagtatttaaaatgaacaatttcaaaccactaacaagatttaaattccataaaggatttatgagaacaagtaatctaagctactcatttggaggcatacaaataaggaatacaaaataggaaatcacacagatagtgtttttgcaggattaggacatgaacccaggattcagactccagattccactcttatttcagtcctactgctatgagaaagaccaaagttgttagggtcagggttcaaatcaagcaaacaaatacggacaaatgaacaaaacccaaactaatcttttcaggaagtggatttcactcacaaacattcagagttattctctaaatgtaagcttgtacaaaattattgtatgtgtttagttaaacagaaccaaggatatcagtacagtactttttattaaaaaccaaaccaatatctcctctctggtaatgtaagtttcaag

SEQ ID NO: 36419 - DNA, 1078 bp, Homo sapiens
gaaccaaagacaaaaaccacatgattatctcaatagatgcagaaaaggcctgtgacaaaattcaacagtccttcatgctaaaaactctcaataaattaggtcttgatgggacgtatctcaaaataataagagatatttatgacaaacccacagccaatatcatactgaatgggcaaaaactggaagcattccctttgaaaactggcacaagacagggatgtactctctcaccactcctattcaatctagtgttggaagttctggccagggcaatcaggcaggagaaagaaataaagggtattcaattaggaaaagaggaagtcaaattgtccctgtttgcagacgacatgattgtatatctagaaaaccccattgtctcagcccaaaatctccttaagctgataagcaacttcagccaagtctcaggatacaaaagcaatgtgcaaaaatcacaagcattcttatacaccaataacagacaaacagagagccaaatcatgagtgaactcccattcacaattgattcaacgagaatgaaatacctaggaatccaacttacaagggacgtgaaggacctcttcaaggagaactacaaaccactgctcagcaaaataaaagaggatacaaacaaatggaagaacattccatgctcatggataggaagaatcagtatcgtgaaaatggccatactgcccaaggtaatttatagattcaatgccatccccatcaagctaccaatgactttcttcacagaattggaaaaaactactttaaagttcatatggaaccaaaaaagagcccacattgccaagacaaccctaagccaaaagaatggaaggtattctaatggaaaggaactatacaaaaggttaggctggaattaactatgaaaatcagattgatatcagtttacagatattttgaataatgagataaagagtggatttcatcctgtagatcattgctttccagaattttaagtaaataagaatcatctaaaaatgtatcaaaatgccatttcttagaccttacctctaaatattctattttaattcgttgggggcaggcccatgaatct

SEQ ID NO: 36420 - DNA, 1048 bp, Homo sapiens
attcccttatatgatttatgatacctagaaaatgctaagtaacaattaactgcaagaaaataagaaacaacataatgtttgggaaactacaagtcatttggtattgctgaagtaaaaaactaataatgatgtcgaagaatatgaaggggatatgtatcatgttaaagagctggaaattgtcttatggataatgagaaaacataggaatggcataggcagattgtgttttaaatagatctcactggagcagggtaggaggaggggaagggagaatgttggtaaagattagagggacagaattcaggtacaataccataaaaattcaagactttgtatatactgtcataaggatacgatacaataattttaatagtaactataggatagaagggagatgacagttgagtgaaacacttagaaggtagagttggcaaggcttgcctctaacagtaaacaaaatagaggctatgtgataattcaggaaaggaaaaaaataaatgatgacttgaagattctttatttggtggaacttagtagctagcaaaagcataaaaagagagcaagagaaaaatagaatagaggagtaagtagagaattgaaagagaaagtaagaaaggcagtctttagacgtactaaattgaaggtatttctagaacatctatttagaaataagtccgacttttagaatagaatttcaacagattcaggattcattaaaaaaagacaaagaaggccaggataatttgtgctatatgatgtgggaggaagaagatggtctaatgaaagacataggaaattaatagattaatgaggtttcaaatttggtaaaagatgtgtttgttttcaaatcaaattttgaagaaaatttgattcaggcaacagcaagaatctagtgtggttaaacataaatgtattatttctgagtttcatacatactattatgcaaagaatatatctgtaggtcatttccgtataaaggacctaaacatgtcattttataggttgattagggaaatgttttttattaaataaaaatatttaccttaaa

SEQ ID NO: 36421 - DNA, 1025 bp, Homo sapiens
tcactgttagatattttgaaatatacagtaaattgttgttaaaaaaagcttacaaacagttcagaaatctaaagtataggaaaataatattttgggatttgcaacaaagtaagtattagggtaattaaatattaatatattgaaagaatgtatgtttcaaataggtctgttacaatttaaatatattcttcaaatatatctaatagatttgggtcataagttgactttaattttgctgtgatttttagtctattttgaacaccaacaccagaataagtttcctaaaataacctattatcttatcaatctgctgctggtcaactgctaaatggcttatttttccctacaaacataaagtccctagtctttcctggctcttctgtcttttcagccttgttctttactactctcccccatgatattcctactccctttgcaccagtctgctcaccttttcataactatgccttccccatttctacttgttctgtctttattgacctgttctcctccactctcttctcccagtatctggataggtagtaacacagtcatcttcactacagatttaatactcaacttacttttttttttcttttttgagacagagtctcaccctgtcacccaggctggagtacagtggcacggtctcagctcactgcaacctctgcctcccgggttcaagcaattctcgtgcctcagcctcctgagtagctgggattatgggtgtgcaccaccacactcagctaaatttttaagtcacttttaaatgtcctttatggatttcatatttctgtacaattgttaacaatatgtgtgagtctaaaaaatgtcaaccaccttacagaaatagaaagtctttattaatatgtgtgttggcctcttcatatctatgtctctgagctgaccacaattatagctgtctaaggtttttgacaatttttcttttacatttcctcagagttatctttgcttattgttgccatgtttcagctgccttatccaagtattttttattcccttta

SEQ ID NO: 36422 - DNA, 1031 bp, Homo sapiens
tttcctaaaggctcctttgggtataggaaggaagtcattggaaatattcatcttgaaatagctttagcaaaaagaaaagaaaatagaaccttggcaaactgatcattcttaaagaaattaacctgtctacatcaaactatatattattttatagagataattaatcccttcccaatacaattattgtttttcatcattccttctttaaactgtattcttaattgcaattattatttgcttttctgaagattctggcattattgtcttgttcgtaatttatcaaaaagcctaaaatggaaaatacttcagatagacctatgttatatctttgcaaaatcattccatctcatgagttttttaaaaaatctcaaaaaggtcatatgggtctacttaccttccacgcagttttgtatgtaaagcactatggacaacttctcactaaaaaaaaattaaaatgagcaaaattcaaaagaaaaaacactttttataatgtacctgtcatttagtctctttgggctgctataacaaagtgccatggactttgtggcttataaacaacagaaatttatttcccacagttctggaggccagaagtgtgagatcaagggtgccagcatggtgggcttctggtgagggccttccttctgaattgcatactgccgacttctagctgtgtcttcacatggcaaagagagagaggaaacaagctctcttgggactcttataagaacactaatcccattcatgaaaacttcactctcatgacctcatctaatcctaattacctcccgaagactccacctcctaataagaacacattagggggtagggttttaacatgaatttgggggagggcaccaatgtttaatccttaacacctctgaactggaaagaaattaaagaacccttagatactaaaaacaaagtgggaacaggaagccagagaattaagctaactataaagacccacctatacttgattctggtaagcaggtgtagactttgagagccacagggactctgtggacaga

SEQ ID NO: 36423 - DNA, 1050 bp, Homo sapiens
ggttataagcatatagttgataaatactcttgttggtatacatatttgttacataatatttatatattcaattcactaacttctgcatgtcgattgtctaacacctggtcaagtgtataaataattttaaatttattgaaattgatctgttgttttatttaaagagcatttaacagtataccacaaattggttttgttgaaacctaggcgacctaatgaatcatagtgtattaataataaaacaaacttacttgaaacaaacaataaatgtagatattttcatgaggtcctataaggccctgatttacgtaaattttagtattctgtttttttcttaactaagttctaatttttttaaatttcaactgaattttcattttatgttctttatgcctctaatatttctttgttttctggtcttcatattgttcagtgctatcagcaggttttattttgcctcaattcattttagaaatggttcattttctgttaaatactaccacattgctctggaattcttggacacattatgaatttcaattacatttttcttaaaaaaaacttttgacatttgtaacaaatggtcacaagaactaagttttgtgtttgggacattgtgtttgtagattaaaaaatcaacctacccaaaacccttaaaatatccaagcttgtaaaacttgaattgcatttgaattacaccaaatatccatttcatcaagtatgtcgtttgcagaattgattgaaacagttgatatcgagtgaaattgagttcatcaaatttggcagacaactgtaataattgaaggaaaatgtctgtgaatgattgaaggaaaatgcatttcgttgtatttcaggttttattgtatagtggcacatatcagtttcgtgtgtaaataagtaataatactgacaattcctggttatgtaaaacatttacacttgtattttttttaaagaaactgtattttcattttatttttttcccaaaagatttgtggttgaacacattacaggaacatttttttaaaggattggagtggttaatccctt

SEQ ID NO: 36424 - DNA, 1035 bp, Homo sapiens
catttttattttaaaactgcaatgtcagattggaatagacaagttcaagtatatataatataaggaaatgggaaagaaaagaggtaggtgacaaaggtcagacagtaaaggcccagaatgaactactgtcatccattttagcattctctctactagacagttggagctagagtcactttgttgttctaggagagatctgtgaggagtgaaagagatcaaaattgctacatttcttctagtccttagcatgtttacaggaaaaatatgtaagaataaagttttcattttcggtagaaacagaaaattgtatcttttactgtgcctcagggcaagaataaaaatataggctgtcagttttatttaatgtaattgtttttctttcagctatactatttaggaacaaagtgcacatgggacatgggcacacacatcacactagaatttcacttgatgggctgtattctgaaaactcatcattgtagtggaacatgttccttgttctggtgattagtgtaggttagaatgaagatttctcatttactgctcaaaaatatatacacatagtggaaatttctcaggaatagttaaatagcaaaaataaaaaaaaaccacaaactagctacaactttgttgaaatccttattgctccaggaatttttaacattagtgtttaataatttttaatttctaggagtgtcttttacatttctttatattgttagtaaatccttgtgaaaatctctatggataaatggggttattaccacctttattaaaattaccatagtaagcaagtttgtgttgaatttagccatatgcttagctgttgatagaatatgaaaatgatgatgctccagataatctctttagaaaggtacaactatttctcgagtttaaacaaaatgttaactcgtacagtaaaaatatcaggacatcagagtatacctgaatgaatgtattggaagtacttaccaggtataaaattctatgccttcgggcatggtggcttaagcaagcatggatggaatcttagca

SEQ ID NO: 36425 - DNA, 1046 bp, Homo sapiens
ttatatttttgaatatggattttatttagatgtaataacatcaaataattatctctaaattttcttcccaaaggaaatagtacagattagctagaatgaaagaagagatttatatttattgtaccagacaccctgcctaacatgatctatgttagcttgtttcatttttacaatagcctgagtgtatattttatctccgttttatagataatgaaactgcctcttaggggaggttacctaatatttctaaaagttttctgatttcaaagcctattatctttgcattctacctaaccagatcaaggagagagtgtacgctttggtttgaatgtttaaaactatgttttatttggtcatggatttggcagatagaatttacatttaatgttttcttcacttatgacatgttgcaagttgagtagttaatggatatatatgagaatagcttttattgactcatgtgtttatcctgccttcaaccaaaattcttctttagagtgttttcttggatgtaaaagagtgacatttgcattcgtatgggtctgaaagttttccacaaaagttatatatttttttatcttgatgataatgaaataatatatattggcacattgaacagattctgcatcgtttttatgatgccattataacagttttggcattcagtagtagtatgcatatttgtgtccattttttctttcatttgaactaaataggtctcttttcattatcatgagctaaggttaacagaagagagtcagactaatatggagctaatgcattagcaccaaatgaatattaaaatatcatcaatgcatactgtgagaaaggttttgcagtaattcagttactgaaaactgctggaggaattgatttatcaaatgttgatcaaaaaatcatgccgaactccaaagagcctgtgccattgtatgcaatactctaaataaattgcaaaacagcgattgtcatattaaattaatgctaaaattttcgtcagttcaaattttattggtttgccatgctggcatttaatttgtaaattaaat

SEQ ID NO: 36426 - DNA, 1035 bp, Homo sapiens
aatccctaaaagaataaaatataggactcagtatttccttgttagcctaaataaatgacatattaatctagtttgttagctaaacatagcaaactctactattcattcaaatttcagcttgaatcttgcccttctgaatcccaagtgaatatgctctctttagtgaatttgcatattcatatatttatttttccttctcatgataattaacgtatttcgcatttactagttactgctagacattaatcttgtcctgaataagatttgaattttcatttatctttcttcatttttagatacttttgcctagtatatatgtaaataatattggttagatgactagagagatgatctcatcatcatattccagtagtaatttattacttgctttctaagcaaaaatctttgcccatatatccagaatgttgttttttgatgctttcacatttcctatagctacctatgggattgtagtttgtattttgatttatgatttgcatcttgaaatttggatgttatgaataaaaaatttgaaaacaaggactctcttctctattttcttcactttcatatttattcagtagagcagagattcttaatttgcatgtaaaactataagacgttaatttcaatatcgttaaatagggaggaataacaataaacatatatttatgatctggaatagttgagtttattgttattcagtttgaatatgcagctaaagaagcaagattataaataagtggtttccatagatagcatgtttagacttatttgcattaagatttctatgtcatcagcataggaaagatgctgagagctataataaatttgaaatttttttccgattacagtttttactttgcatgttcattttgttacagtttaaggtactgttttctttttccttttattgcaagtgatgcgtatctttttttacttgataacaacactttaaaatttctctgatatcatacttgattattgcattgccatgaagttaagtggtgttgagtgtttaagcatatttgatac

SEQ ID NO: 36427 - DNA, 1035 bp, Homo sapiens
tagatttatttgttttaaagttttaagactctcaatgtaataatctctgataatttggtaaatatgaagctttgtatcaacatctttttaggaaatcatttgttttatgtatgaaatattttttaaaaaaataatgcatgccattgtttaaaaagtaaactagtttttatttttcctgcaaaattaacagatttttgtgaaacattttatatgtaccctactccaaataataacataaataagaaagggcattataaaagactgcccttgtaattattttactttgtgcctagtgttcgtagttatcaaattataatttattttccaagttactctgaaagccgtgtccaccagtggatatgatcaaaccagtagacaatttccgcagtatgttctgagttgaaattcttcccagagtgacttgaattggaatgtttggttgattgcggcaagtctgacttgcttttcaccataaatggtacagacatgagttttcagaaaacgggcaatggaaattacagctaatgcatggaacacaccaaaaggggtaattgcttccttccttccctctttaaattcagtatttctgacattgctaacgttgctcaaaatgcttacttttctaattgcaacatataaagtcagtaaaagcagggaaggtatgtaacagtgatgaaaagggtttgaattgagacagaataaaatgtgtgttcatattggcctattatttcttaaaatagttttatgtgaaatagcaatatacagagaattattccttgaattgtgtgaacttttcaaattgaactctcatttgagaaaaatagtttagaccacttactgcccccttttaagaaatgataatcagtgatgatcatccatttctttttatatctgagcatactgtacacagtatgcacttagccctagaagtttttctctgatacccaaaagttctaaactgctccaggctttccacaccttttgtttctgattttaaacactacctcagataaccccttctctgatcacacattt

SEQ ID NO: 36428 - DNA, 1050 bp, Homo sapiens
tcatgctttttattactcacctcattttctacaggtgactctactccttccatccagaagaaaataaaagtcatttgggaactctcatattctctcagcccaaaccaggaaactatccatacctgcagccaatctttcaactttgtccctaagttacatacataacaggggtcctactcatctcataccaatccctgcttctgggttttgtttcctgtatccccaaccctctcagaaaattttcattatgaattattttctcctctcttcggtaccaactattgcatctcaaaagaatcattccaatcaagactcagactcaacactactatggctgaacgcataaccttcagcatcaagccttgccttttcttctctaatctcagcaaatggtaccaccaccaagccaattgaacagaaacctaagtcattcatgagatctcctcctctctccctgaattcaatctgtccccaagtcttgttgctattgcctcctaaatatctcctttaaatccacttgttttcctctctcctcttaacaccctcatctaggctggcatcatctgtttccagagacactgcacaaacttcctaatgcatcaagattgttctctgatttgcagctgtatttatcttttctgattgtaaatatgacctgtcactgccctgcttaaaactatttagttgtttcccataaaacacaatataaagaccacactcctttctgtagcccatgagatcctgcatggtctgacacctgtgtgcttttgcagctctgtctcatgctctctgctctctgctctccaaccaccacagccttctctagtcaagcaaagaaatcctgcttcctcctctttgatggtgacatcaagtctctggactctggctttttttgtacatattaacttgatggctgaattccggcttcaaggattgcattcaaatgataactccagcagaaagagcagaattatcatccagaagagccagttgactctatgagaggttagaacacatgggttgtgatgtaggctgcacctaactttggta

SEQ ID NO: 36429 - DNA, 1072 bp, Homo sapiens
tttatataaccaatttagagtggcagagttgtaacagaaaaagatactcaaaatccaaagcccttgtttaacatcagaattcactccttaactggcttcagtatcttcataaaataaaaatcatgtacctatctcatagactctgtagtttaatatgcccatgccacatttatatagggtgagaaagactttgaagcagggaagatggaattagttaatggagagcctttttacatgtcttaagagtcaacatttgatacaagaggaatcaagtcatgtaaataaggactattttcaaatgattatacttgatgaaaagtcttatgtggaataccattttagatatgtgtatatatatgcttatcttgtttacttttaaatatcattttaagagaattaaacacacttatttctgtaaaattgaaaagtcatttctaacagttccttttcctgctaaatatggcatttatttaaaagatctaatatttaccagtcgctgctatttggttctctgaaaaccctcctaattatctgtgaaagccaaatgtgatctgagctttcttggcaaaaggatattgactttcattaagactgaattgcagtacagacctttaagcctttatctgcatctcattaattggcatgtgatttgggagagtggctattaattatacagaagacggtgagtgaatagaaaggatcattcaaaggcaaactatgcttaaacctgaccatgtccacagacagtatatacttcatctggcagtcattaattttcctaagtgtttgaaatcagccatagtaagggtttttaaatggcacatctagaaataacattaatgtctagatttttacaatttaatttcctggaaagtcatttttttaaacttgcatgaatttttggttgaagtggcaataagagagtatacataatatgataagctacagatccatttttaataataaaatctctcttcccctgacaataaactatggtagtgtagtcttcaaaaaatccactaagttaaaataaagttttcaagttaaaataaagatacaagaagagacaatc

SEQ ID NO: 36430 - DNA, 1052 bp, Homo sapiens
cagttattcctggtatgtttcccttcctgctttctatttgtagtattctgggatgcagttatgcaagcccagtttagtcctctcagtcacatatagatatatgtatgtatatgctatatatgtctatacatcctattatttttgtacaatctaaaatttttgatgttaatagccttttttttcccctaagtaaaagtcttaatgtctgttttagggactctccaagaaatctgcatcatgaaaacagctactggcctgatctctgcagtgtgtgtgtgtgtgtatgtgtgtgtggtctgtgtgtgtcttcatgaatatggaaaaatgctctgcaactgaacccttaaggttaactcccccacacccactctcctactcacaaagctttcaaaaccagacctataataggcaagaaatgagtggggaaaccatctttatttcttttcaaatatctaattctgacatattgccatcttgagtgctgtctgttgttgcctgtgtcttagttttgtgccttgcatcttctcatggctgtcttctctgtttcataggcctatcttgcctcctctgctcttttctcccatgcactgccctgtcccttcttacttgatctttagcccacagatagagtcttgtgatgagtcaatcatgctttttcatggtgagttttatgccttgtgttgctctcatattgtgattgtaactctctcacatgatgctcctgctcctctatcccctcaataactctttcattaaattgcttttttgtgagttatcttttagctatggtgtttatgaaacctttgtgtcatagattctacactgataatgtgttatcaggaatgtagtcctatcagccatgattgttgattcacattatattattcaatccaagatcataagctttccaaaaagaacatattatccttgtatttcttctaatttaattacactttttatgaagaatttcagagaatctagaattctatccatagtcttaacttacccacctctaactacatattcaaatgaactgagaaaattttgcctgt

SEQ ID NO: 36431 - DNA, 1050 bp, Homo sapiens
catttacttaattaaaaaaaataagaaagcagaacagaaaaataatcccaatgaataagaagagagggattttaaagttcctctataggcaatttgagaccctgtggtctatctagttttctcgaaattttctgttatgagggcattgaagtatatgactgccaagttggtttaagcaccttgaacatgtcaatggttaatttgatgtacacaaaacctgtttgtgcctcatattttttgggaaaaatccaacccttgtgatgtcatgaatcagcgtttatcatgtattttgaattgttctcaatatttcatttaacagatatttatttaaaaattggtttgacaggatatgcattttttggtttcgtatttttcctttgagaactttatttatttaaaatctctggaaaatgttctgaaacattcaaggccattgataaattagatatatttcagggtttatgtgatctttaaacttgctttaaaatattcacattttaattcttaaaatttattcagactataactcttgaaaagctaaaatgcagaaaggaagttgtttctcatttgtttttgtatcttccatatagtggccattcaacctacttttcttaaatgatattcttttcttaactgaaccacgcaacataaagttgactgctgagtggcaaataatgaataatgcaatgtctttctttaaataagcttgtgtttttcaacgtttacaatttttatatatttgagtataagtgatatatttctgttactttgaaatttttaaaccatctagaattagaaatattgattggaactttgtctttattaatcatgacttaaagtaaaaagtatgtaaatgcatagaagcaatagttacccatttatttgcctgtttgtcctgtttgtatttgttgatagtatctactaaatgaggaaagagaaaaggtgatgcaaaaatgtaagactcgattttggtaataattaggatagcccaaattaatctagttttaaaaattgatatttaggggttgagttggctctgaattatttgca

SEQ ID NO: 36432 - DNA, 1052 bp, Homo sapiens
atacacaaaatcctgaatttaaaaaactgtatatgctaaaaaaattgtttatcaggaagtcaagtaaacttacttttattgttaaaactgtattttgaggttaattttccaaaaggagcatgtgccacaactctgatataatactggtgcttagaacattattcaaaaatagggaaattttaatgttattctttagtcattattattttggtttctgaaaataacttgttaattcaatagaggtttttaaatactgtttttgaaaagttgatatgtaaatagtaatttaatgtgtttaattccaatatccatttttggaatactagtaaaactattatctgagacctaatcccacagagccttccaggtggactctactaagtcaggacagttttaagagctttgggggctttagtgttattccccggagctaggttcttagagtgtttatgaacctagtcccttgatctgaactttccattgaagatttgaggatggtctaaagaatggtaattaaggcttgttataatacattttgttgtaagaataatgaatgaaagtttttgcctcattgtatgtccctacaaatcagggatagtttttactttttttaattttaatagctagagtatagtgggcttatcctagaagaattaaacctattacttatggagtataagaagcagatggtgtcatataaagaagaccaaatgagattggctcattccgagtggtatgaaaaataaataaataagtaaataaataaaacaaaatggaatttctaagataaacagttaaaaaaagatgaagactgggattctgcttctctggatgtgtatcctgatgagccattaatttctctatatttttgctaacacatgagagggctgaagatctgtccaaggagttatattattagactctaattgtctttattcatccaagatatacttatttatttgctgttatctcatactttaatggattttatgcatatatgaattatctaactttgaaatagtgtgatatacaacattattatctcactgtgt

SEQ ID NO: 36433 - DNA, 1070 bp, Homo sapiens
aataaatataggaccttttccttatggagacgttggaccgctaatatccatatatgttttatgcagaattaatattctccactattcagggcagtacatttatttcagcaagctaacgaggaagaagagtttgaaagttatttctcaatgcatataatatgttgtatacaagcaggtgttctatactagtaaatggaaatttgaacttatcagagaagtctgaatatcaaaagcggataattcacaattactgactagcgatcctgtatctctttaaattactgtgtctaactttttaataaacctacttgtagttctgacatatatatgtgtgtatatatatatacacacatatatatacacacatacatttatatatattcttttttgtgagaatacatattgaaaaaaagttttattttatataacaaatagaaatctcctaggaaaactatttctaaagaaacctaaatgtgaatatgtagccataataactaacacctattgagcacttaatacttgccagtcactgtgctaagcaatgcattttctctgttgaactgtattacaatactttgaagtattatttccattttatggataagaaaactgagatttggagagttaaaataactcatgcaaggtgaaatatcttataagtgttggtgataggattttgaatcagattgtctgatcccaggttccaaatacaccatgttggggggccatccgtacaactttacctggcagtatctgtgtttcctgaatcacaaatgcctctccgccagcctacccacttgggcttcagaaacaccaaatataattttcataaattttatgtgatcatgatgctgagatgcttttattccatgggtgtgtgtattgtttcatgaagaaaacagtgagtacttgcctatagaactgccacataaagagatacatatcccggtccctgcaaagcagctgccccatcttgctaatatgatcactctaggattaaaaggtaattcatttttggaatcatttttaaaatattttaaagacttacacgtcagttttgtcattgatgg

SEQ ID NO: 36434 - DNA, 1028 bp, Homo sapiens
gccctctgttgctggaccccactatgcactgcagcagacagctccaggaggcagatgggcctatgctctgaaatcctaaaaacactgggtctgctctaaattcctcatgtgtgacatgggagaataattttctctctaccctgctacaatttatcacactgtggaaaagggtttagttttggggacaaatcttgagttacagatgccatacacagaaagcattggcaggcctacactactaataagctagacctgcataagtgggccgaaacccactgtgaattcatcatagtcttgagttggaatgattatgtttaggttcacacctctttataaaatacttagagctttgtttactgtatagactcaaaagaactacatattccactaaccctaaaattaagtattctgattcctcaaagtaccaaaatatggacaattttaatgtacccaagaagtttcctgtccatctttcactttaaatattggcctttgctataatctgaacataatctgaatctaattttttaaccaagataccaggggtttggtataggtcctgctgcttgcattacagaaaaccaattactgacacaagtattgccaggaaagaaggctttaatcaggtgctgtggcagaggagatgggagatcagtctcatatccatctccctgaccaactaaaattcagggtttatataccagggaagaaatggaaccatgtgtaggaaaacaggaattagggagtggtaagaaagaggagttgatcaacaggaggcaggtagtcagttaggcaatcataacagccaaggtgtctggcatctcattgttcaaatccaatgatctggtgagtatcagctcctagctaccatctgggaggcctcatggttggtttccttagaaaggaactcagataaaacaaatgtaactttctcaagttttaagactgggagaatcaatttatgggtttattcaaaaaattataaataccatctctatgggacaattgggttagtttcaatctaaaca

SEQ ID NO: 36435 - DNA, 1044 bp, Homo sapiens
aattcttacttctgtgtacatcatctctgtagccccagtcaaatcaatggcatgttacataaaagcaactactgataggctaagtgcagcggctcacacctgtaatcagtcccagcattttaggaggctgaggcgggcagatcacttgaaatcaggagttcgagaccagcctggccaaagtggtgaaaccctgcctctactaaaaatacaaaaattagctgggtgtggtggtgcacacctgtggtcctggctacttgggaggctgagacacgagaattgcttgagtctggaaggcggaggttgcagtgaggcagtgagcagagatcacactactgcactctagcctggggacctgggcaacacagcaagactctaaaataaaatttagagtcctatttttcttgccccaacctggaaaattaccattcttgagaaaaaaaaaacatacgacataattcaccaactgcttaaaactacataaatttgttgcctttgtatacccttctcctagccattctgacctctgatgttttctcaaaacatcattctctctcagcctttaagttttgcaagttgaatcttacctgcttataaataccttctcctattacctctcttcccatttttttcacctttgatcctttaaatctcagcgtataatccccaatctgggaagccttttttcattgctccaacaggtagtccctttttaatttacagctccttgaaggcaggattctacttcagcatgcatcacactgtgcttcctcctgatgtcacctctgcaagtgccacagctggtcttgatcatcgtggagcccccattgtgagcactgctgccaagcctctgttgggtcaaaatgctagagtttagagtttgcaaactattggttcttggcaagctcttagttttatttacttggttcattgttcatttagtttttgtttttcgtttttttgtttgttttattttttttctgtaatcattacgtaaacattaggaaattgcacataccatagaaatttggatttctggctgttttt

SEQ ID NO: 36436 - DNA, 1029 bp, Homo sapiens
ttgcatagcaatgtgtatagcagtctagtaacttatccagggttttacttaaaatcaggtttttaaataataaatcttaatgccatttgcttaccagtcttaatattttcattacaacaaatgcattgataaagtatctacatgatttcaaggggtaattttacttaaaatgtgttctgcagagaagtatggaaatctacttttggtttgcaatgtatggcaaataaaagtagttttaaaatcctttacataagaatgatgaaagtcctttcaagtatggagtttattatctggcaggtagatatttgtggaggtttatacatcagcataggtaatgtggtaatgtagaacacaaaagctaaccttgaggttttgtttctggggtttgtttatttgtttgtttgttttttaagaaaatgatcaaacagaatggcagataggaccacattaacgaagctttcaacctatctaaagtctatgtcattttaatatttataaaacatctggctgaatatattttggatactattcggattcttgatgaactagcctcagaatttaataggcatgtgtgtttgtgttttcaaaaaaaaggtttagattgaaggactggattgtcactgtatttcagatagtgatcacagtccacaagacagctctgaaaaataaaataaatgatgtaatgcagtgagacagacaatcagtatctattatgtgattaaggaatgaaactgttttcaagaacaaatcagaactttttgaaaaatgtattagagatacaaacttttatgaaataaaatatatagaattagaaccgctgatagtactgtcacataccagctgggagaatatttctgccaactttggaatatgctcaaaaataaatagctctaactttagaaaaagaaatttcaggccgggcatggtggctcatgcctgtaatcccagcactttgggaggccgaagcggatggatcacgaggtcacgagatcgagaccagcctgaccaacatggtgaaaccccatctct

SEQ ID NO: 36437 - DNA, 1147 bp, Homo sapiens
agtctgtcgccaggctggagtgcagtggtcccatctcggcttactgcaacctctgcctcctgagttcaagcaactgtcctccctcagcctctcgagtagcagggactacaggcgtgtgccaccatgcctggctaatttttgtatttttagtagagccggggtttcaccttgttggccaggatggtctcgatcgcttgacctcgtgatccgcccaccttggccttccaaagtgctggtattacaagcgtgagccaccgtgccaggcgaggaatttagcttttaaattattagttttatgcatcctgctaccttggttcaaagcttaagtatacttgtatctttctataatactaacaaataatgagtagtgcaggatttagctgagactgctttgggccctcatccaaagggagttcctgaattgaaatgccaagaagacttggtaataagttgtcttaatcctgacactgtaaaatacctgttaatgtattttagtcaaatagattatggtaaaacatactccctctttttcctagaaagtattaggttaatttcatattaaatctaggtacctttgaaataactaaattatgagccctgatatatctgttttcttgcttacccacttagaaactcatgctgtgatttcatatttaatctgtatgatcgaatttttttatcttgtactaaaacataaaattattggccgggcgtggtggctcattcctgtaatcccagcactttgggtggctgaggtgggtggatcacctaaggtcaggagttcgagaccagcctggcctatgaaaccttgtctttactaaaaatacaaaaattagccaagcatggtggcacatgcctgtaatcccagctacttgggaggctgaggcaggagaatcatgtgaacccgggagacagaggctgcagtgagccgagattgcgccactgcactcctgcctgggcaacagagcgagactccatctcaaaaaaaacaaaacaggcagggtgccctggctcacgcctgtaatcctagcactttgggaggccgaggtgggtggatcatctgagttcgggaatttgagaccaacctggccaacatggtgaaaccccatctctactaaaaatacaagagttagccgggcgcggtggc

SEQ ID NO: 36438 - DNA, 1050 bp, Homo sapiens
caacctgtacgaagcctttgctcaggttctaaaatatgtttgtccttgcacgaattttgtatatttcaaatatttctgtaaaggtttcttcttttctgttagagtgtggtgttaagccagagtcagtggtttgtgttctcattaaaatgtttgtttaaatcctatgtccaattcaagcctatctaactacatttggtaggattaacatttcatataacaaatggggcttaattaaaaactttaacttggaataaaggaacagggatcactttatcttctgccttcatttaccttagtccaagattcttgcaaaacaggcaactgaacaaacattaggtttatgtaggtaaaatgtgaaagcatttctcctccactttttaaaatttaatttacccagtacagcggggcaccagattacttgatctttgtattttgcagttttgagcctttgtgtcaatcccaagcacagagaggatctgccaaggaaaaacatttgcatcttcggagtagacattttgcagtttgtttaataacaacttctaaagtaagttgaattcatccattgtcactgattcaccaagtggatgttgcattgtggaatttgcctgagtactgttgtcattctgctcagccaggcacggtcagtttcttggccagggacattgctatgtgctgtgtgcaagctctttagaagagagattggattttcttggcattatcagcactcatgctatttagtctacttctattttgactgactctttaaattagtacaatttttctacttgtcatataactcctggaacaatagtacgggaagccgtgatccttttccctgactcatgattttagtctttttccaaatcgctgttttttttttttttttttttttttttgctgctccaacgaccagcatgtgttggagcagatctccatggtaagccaaaagtggacttgtcagcctataactactctgcagctgccactaactctacaggcacagtaactacactttatacaggagcacatgccaaagtgcctgggaggtgc

SEQ ID NO: 36439 - DNA, 1034 bp, Homo sapiens
tcaagaggtcatttgttccccatagcagcatatctcatttttaaattgaagcgaattaaataggattttactactcaacattcattatactgttaatctttgctgaaatatatgctaacaaatgttaagcaagggaaactgaagacttagtcatgtggattgttagcagtgatctgcattctgtaaaagaggtactttcccatgatgtaggcatgaagtggtgccagtaagcgtagagcggaaatgttgactttagttaacattgggtttagcatttccagtgcagcattatcagtgggcctttaaaaatacttcgtaagtacattagctttcactttgttgttaaattatagcagactcattatagagaacaagtttgccttgattttgtttaaaatgacttctgctaagcacccagaagataaaattgacatatttttataatataagcatactttttttgtacattgtgttcattcttgaataaaatgagttctgtgttggcttgtagatactaaaaagaaagtattgattttgattcaataaatgttttctttcaatcctggttggcctttcctttaaattttgtttagtttttcttttctttcaaggaaggaattatttaccagaattcagttagagcaccttttttgcattcttatattttcagtcatgattcctatcatgcaaaaaacaacttaaaactttttgatttaaaagagaatttaaatttctatcattgtaatctttaacttcacagttcacctcttaatttaacaaatacctagtcagaatgaaaattaaatggatagaaataggactaataaaacatttatgcctggtgcagtgactcacaactgtaatcccagctcttttggagatggaggtgggtggatagtttgagaccagcctggacaacatggtgaaaccctttctgtaagtttttattgcctatcaaccacatgatttttaacagaggtatcagatatctacacagctttccatgatgaagcatcttgtccttatagtatatg

SEQ ID NO: 36440 - DNA, 1048 bp, Homo sapiens
caaaataaatccagagatacacagaaataacatgactaagtaggaagtttattctaacaaaacgaatggtgaggtaggagggcaggagtagacacggaggaattaacactatgaaatatattattaattcactagactaacaggtaagagaaaaataatttgatcatctcaataaattcaagaaaagcatttgacataattcaacagcatatactttcttagcaaggtataaataaaacttccttaaactcataaataccaccaaaatcctacagcaatcactatgctcaacggtgacatccgaatgcgttctcgctgagatcaggaacaaagaaaggaattccattctgaccactttttgagacagggtctcactctgtcacccaggctggaatgcagtagtgtgatcaaagctcacctcctaggctcaagtgatccttctaccaactaagccttttaagtagctgggaccacagctgtgcactggcacacccagctaattttttgtagagatggggtttcaccatgttgtccaggatggtctcgaactcccgggctcaagcaatcctcccacctcggcctcccaaggtgctgggattacaggtgtgagccactggatctggcccactctgaccacttctattcaacactatactgggcattttggccagtgcagtaagacaagaaaagaaaccagcactttgggaggccgaggcgggcggatcacgaggtcaggagatcgagaccaccctggctaacacggtgaaactctgtctctacttaaaaaaaaaaaaatacgaaaaattagccaggcgcagtggtgggtgcctgtagtcccagctactcgggaggctgaggcaggagaatggcgtgaacctgggaggcagagcttgcagtgagccgagatagcaccacgcagtccggcctgggcaaaagagcgagactccgtctcaataacaacaacaacaacaacaacaaaagacaagaaaagaaaatacaaaatgactagaaataaataagttattatgaacagatatgagtatgcaga

SEQ ID NO: 36441 - DNA, 1080 bp, Homo sapiens
tgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtccttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttg

SEQ ID NO: 36442 - DNA, 1131 bp, Homo sapiens
ggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactcttgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtcctta

SEQ ID NO: 36443 - DNA, 1096 bp, Homo sapiens
tttgggggagcaggcatgatgggttaagacttattaatctggaagtaagcactaggttttcctttagggcaggaagaccttccttgcaaaatccctttctggcaagtctcactgggctgtaaaattgcaaacgcactgttatcacatcccaataagtgcatgatttgattttaaagtaagataatcttgcgttcattccagcctcatagggaacatacagttttctccatccttttctcttacttactccccttcctctgtttccctctgtcatctctaatccccagagtatctggttatcttttttatacactcattactccttcaaaacactccaatatagataacaatacttgattatttggaagttatctcaactatacatgagctgatgaaaaccaggaagtaagcaataagcaaaacaggcagacagagagtccaaagtccaaaataaattaacatttgttgaggacttgtggacttactatgttccaggcattatgctaacctcatcacagtctctattttgattaatcttctgtttgcccctgcagatccactctccgtcctctctacctgctctgggttgggaggctgacctgaatgggccacatcactcatctatcttgcctctggattctagttagatttggtccatggggagcattagcaagagatggaaggactcaggaagatgaggtcaggagttccccgaggagggcaagtggttaagttattcccccgggtccctatcaggtcgctttaggccaactgcatcctccactggagcccacagctcctgccagacacccttccaatagctgcctcctttgggtccccttacccatttattcccttccttcataccttcaggttacaagtggtaacagctccccattgttgctagcccccatatgcttcactgtctcatcttgatttccctgagccctccccacacctttgtaaacagtcccagtccaagttcaccatctgtttcctacccaacttgatgatacaacgaggtaagcactgtattagcccatcttaagacaagtaacctgagccccagagaagtttaataacttgtcccagaaca

SEQ ID NO: 36444 - DNA, 1100 bp, Homo sapiens
gggcacagagggctggggttcctgtttgctctgactctaaagtgtcaccttttcccttaagccagaatgttggaggatgaggactatttagacaacctgctttcaaggggaaagaaaagagcagggatcagagcctttaaaattattattatgaaacatcatacatacaaaaaaattacaatctctatgtatagtttaaaacataacaaaaacccatgtgtccaccacccaactgaagggaacattccctctccccatgaaggtgtccctccaacagcttccatgtccctccccaccaaagggaaccattatccttatttttttggttaatcatttatttgttattcttgttttattatatatataaatatcctctaattatatatgatttcatttttcctatttttgccctctttataaatggaatcatgttggatgtatttatttaatatttgcttttactggtcaacaaaatgttttcagactcatccatgttgatacatataactgtagtttatttatttactgtatttactttactataatcttctaaatgagtaagccataatttatttatctattttattactgatggacattttgcagatttttttttttttttttatgatatggagttttgttcttgttgcccaggctggagtgcaatggtgccgcctcggctcactgcaacctctgcttcctgtgttcaagtgattctcctgcctcagcctcccgagtaactgggattacaggcatgtgccaccatgcctagctaatttttttttttttttgtatttttagtagagacgggctttcaccatgttggccaggctggtctcgaactcctgacctcaggtgatctgcccacctcggcctcccaaagttctggaattacaggcgtgagccactgctcttggcccattttgggggttttaaaagttttagttgttaagaacatgctgcaaaaagtaagtaaaactaaagaaatctgaataagatatggactttagttaacaataatgcatccatattgattcattaatgtgacatgtatagcatactaatgtaagatgttaaggactgggtgctgtggctcacac

SEQ ID NO: 36445 - DNA, 1076 bp, Homo sapiens
tttaaaggaagcctactcagtcgaagctctcaatgtggcatctacaatgtgcagaatataattttaaaaattaatgggaatatgcaaaagaaaatgtggtctatacctgagaagggaaaagtgagtagaagcagatccagagatgacagattttggaattagcagacaaggatttttttttaaattttttttaaatttttttttttgagatggagtctcactctgtttcccaggctggagtgcagtggcacaatctcggctcactgcaacctgtgcctcccaggttcaggcaattttcctgcctcagcctcccgagtagctggaactacaggtgcccacgaccatgcccggctgattttttatttttttattttttatttttagtagagacggggtttcaccatattagccaacctggtctcgaactcatgaccttgtgatccgcctgcctcggcctcccaaagtgctgggattgcaggcatgagccacgacgcccgaccggatttttttaaagctatgatagataagctcaaggacttaaaggaaaagatggacataatgtgtgggaagacatctaaacagagtaataaaaactataaaaaaagacccaagaagctgaatgcatcacaagcagcataaacataactatgttgtacattacattcaaattgttcaaaactaaatataaaatcttaaaaacaggtggaggaaaaagtaacacatcatgcagagggaaagaataatgagtatgattacttcttaggaaaagcaatctaaacctgaaaacagtgggacagcacctttaaggtgctagggaataaaagttaaactcctatatccagcaaaaatattctttgaaaattggaggtgaaatggaggacattttcagatttaaaacaaaatggtagaggtaatttgttacagacaggcttgcactatagtaattgttaaagaaagtttttgaggctgaaggaaaatgtcgaaaatgattgtaaattagtcctagagtaaaagctgctctaggtccccctttacagaccttaacaacaaaggttcaaaagaatccaactgtttgt

SEQ ID NO: 36446 - DNA, 1045 bp, Homo sapiens
gaaataataataataaaagtaggttgtaaaaatgtcttagaagaagagttggtcagttttggaatcatagaggcaaacactagaagaatatccccagcatcatccaataagagaatgccccgaaccagatcccagtattcctgggagatgaggcaaccagctgtctctggaagcgagcctcagagcaggccactgagctcccttgttgtactttacttgctcagagtcctctgtggttgagcaagctttggattaaagtatactcttcatgtaaatttgcctataggctcagaatgcattggtaactcaccatgaatttctagccttctcagtagtcctgacttaaaaaaatacattaaatagttacctttttaaggattaagtaactctaaatgcccaatgaatgaataatgacttttgtggcaggtgttgaggacaggacatggtgtttggagttagaagtggaatttaattcctgcttctctctactagctgtgaggacttgggccaagttacttaatgtctctgaacttcagtttctctaggcctgctctacagtgttattgttagccttaaatgagatcacttttactaaatgcctggacctggagtatcttacttgtcttcatctatcagccatgtaagctatagtgagttttatttatgtaatgtttctttattttcagaatcgtctaaaagaaattgaacataatctctctaaaataatgaaacttgacaatgaaattaaagccttggatagccgaaagaagcaaatggagaaagataatagtgaactggaagagaaaatggaaaaggtttgtggtggtagaattttgttctgcttcaaaattttgggattattgtaatgaactttatttgaatccattttgccatccacattggaaaaaaacaaatacagatcttgttacttctatgtatatgttaaaatgaaggatattgaataaggtttggtttatatttgatacctcaaagtgatcatattttcttatgtttgtacattaaagctttttattttggtgttaca

SEQ ID NO: 36447 - DNA, 1788 bp, Homo sapiens
gaaattcaggagattggaagttgttgctatgtaagggatactcaaagtcattagtatgtcaccttgagagagttatgcaaagggaaggagttacaattagattcctgggaagcacaaacatttaaaatgttagcaggcaaaggaaaaggagcaagtgaaggaaactgggatgtgcccagggaaccagggtgagagccagatagctgtggtgtctaggtgccttgggaaaatagtcttcaaggagaaggtcaacagtgtttggtgctacgtagaggtagagtaagatgaagactgtacttggcacttaggtcactggtgatcttgatgagaagtgctcaagggagtctaggataatgaaaatatcatcatattagttacttttttccaaatgtttactgtgactcaggatgggtagtcatgatgaagaagcatgtgtgcagtcacacacatttatctgaaacaaatttctcaaagtagtacatatacatacagcctactccaatatattaccgtctattctgtttcatttttaaaaaatatgctgaatacattaaattgattacatggtagctaatgcatctaaacctgcaaattgaaaaaccatgttatgtgtgagtattgaggttggctaggatgatgtttaagaattaaagtggggataaattgtactagtaagcaaaatctttgatgaatgagagggaatgactgatctggacgcaagtggatgacagcaacaaggagggggaggatacaaaagaaacagtatttacaggagagtaaggaagtagtatttgtgaaaggactaaagggaattacggggatgttctcttgtcttctttctgtccaatagtcctagcaagcatcttgctgaggcttaacctgggatcaaagaccatgaacccccagaaaccaggcagaattctgtgtacatttttctgggagcaggcccatgagtaggactggcaggtgagtcagtgtcctagggggagagttaaggcagaagtggactagtccctcaacttctgaaaaaaattatttggtcataccaaactcttgtcatgatttgttggcagaatttgtcttgtttttgcctactcaaattttcaaactaatttctcctattttaaaatgaaaatccatatttgctcttattttagcaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgaggtaagttgtctactttatattatcaggatactttgacacctttgaattttcattcacaggtaactgttaaggatggggaatttaaaaacctggttatggagcctaatggcttggatttcagtcctggctctacaacttactcactgtgtgactttaggcaagttactgaaaccttcctgtgtttcattgtctataaaatgaggacacaactaccacctgtggtactgaggtgtgaatgagattgtaattataaagcccttagaacagtgcctggcacatagaaagctctcagtaggcattttgttatacttataatgtgttaccaaaaaatatttatacaaatctgaatgtatcatgctctttggaagcgaatatcggaattttaaatatcagaatttttatttcttttataatatatttataaagcaagaataatcatatatttatagaaaaag

SEQ ID NO: 36448 - DNA, 1029 bp, Homo sapiens
ctcgctcactctcccccactcctcccctctctcactcactctgtctccctctgtctcttgtctgagggaagctagctgccatgttgcaagcagccctctggagaggcccatatgccaaggacctgaggcctttgagcaagtgagtttggaagcagactttgtagcagtcaagccttaagatgactgcagtcctggctgacagcttgattgcgacttcatgcgagaccctgagtcagaagcgtatctcttgatcctcatatctctgagaaataataagtgctgttattttaagctgctaagttttgggatactttgttatgcaacaatagataaccaacacaagcatcaagggtgaaaaccagattattggggccacagagatgaggagacagaggcagtagtttgagaataaaaaggaaggagaggaataaggtagtatcttgaaaagaaaaagatcaaatggataaaatttgaaattggtagaaagtacacgtagtagaaatatgagcttagttctgtgttagactgttatacaataaatggcagaaattaacatcgtattatattttaggaccctagctatcacggctccttttttttttttttgagacagagttttgctttgtcgcccaggctggagtacagtggcgcagtcttggctcactgcaatctccacctccccggttcaagcaattcccctgcctcagcctcccaagtagctgggattacaggcgcacgtcaccaggctcggctaattttttttgtatttttagtagagagagggtttcaccatgttggccagactggtttcaaactcctcacctcaggcaatcgcctgcctcagcctcccaaagtgctgggattacaggcgtgagccaccgtgctgggccacagtttcccctctaagagtaaggtgcatgtcttactcgttgtatctccacagttccttgtatattgcaactttgataactatttgctaaatgaatgagaactgtaatgtctgttccaattatttattgctatgtaaca

SEQ ID NO: 36449 - DNA, 1002 bp, Homo sapiens
ctctctctctctctctctctatatatatatatataaagatatatatatataaagatatatatatatatagagagagagagagagagatatatcttttttttttttgagacggagtctcactcagtcgcccaggctggagtgcagtggcgccatctcggctcactgcaagctctgcctcccaggttcacgccattctcctgcctcagcctcctgagtagctgggactacaggcgcccgccactacgcccggctaattttattgcatttttagtagagatggggtttcaccgtgttagccaggatggtctcgatttcctgacctcgtgatccacctgtattggcctcccaaagtgctgggattacaggcgtgagctgccacgccctacttctatatttttgtctaaaagttttaaattttgcctttcacatgtaagtacatttaagtatttaattctaagttgaattttttccgttatgaataactggttgtcttggctctatttattgtagactatccttctctcagtgacctacagtgtcatttctgtcatatatcagaattccctatgtgcctgggttggcctgggttctctgttctacttaattcatcactttgtctatctctgtgccatttctctcaccatcttaattacatatagcagaattttctttatccagtgtatgtctgtcttttaaccagtgaatttaggcctttcatattcattctgattactcaattgagttggatttatttctgccatctttttttcctttcctgcctttttgagatggatttatttttcttgactcctcctttttcccttctttgggttatccagttgaccatataacatggggattagggacactaagccccccacgcagtcagaaatccacatataacttttgattccctcagaacttaactactaatagcctactgttgactggaagccttactgataacagaaacagttgattaacatatattttgtatgttat

SEQ ID NO: 36450 - DNA, 1025 bp, Homo sapiens
acacctgtaatgccagctactcaggaggctgaggcaggagaatcgcttgaactgggaagtagaggttgcagtgagccaagattgcaccactgcactccagcctgggcaacagaacgagactctgtctcaaaactaacaataacagtaataataataaccccaagtttagtttgtctgtcaggttacatactgactggtctggttttcacttctatcttcgtttctattatgtagggatttccctttctttcttgtgagctcaactatgaatttaaaataagttttgttataagtctatctagtagttctgttcatttgtggcaggagaattattacttaccttagattttggtggtggttgttttttccagaatggcaaatatcttccttagcactaagagagttacacagagagcttctcttctaagacttctggtcagatacagcatagtcaacagaccaacctgagcagtggcattcagaccacagggctcaggaagacaggagaactctggtttcagtatgaggacttttttagttagtgatgataacaaaggtggtcccagaattgcctaggcatatttttggcatatacaagttttaggaagtacgtaatcatgtaagacaaattagatccatttactgtgaaatattgggagtgagccaattaacatgttattttttaaaaataaattatactaagatttttgttagattaagtttaacttttaaaacaattttttgagagtattccatggatatatcttttgtcccatttcattgtgagtgggtacgttaacattacaatgttccctgggtccaaaatggctcatagaattatatgcctgcaccaaatgagaacttttgttttttaacttctttgaatattgccatctctcctagatattagatccagcagtttaaagtggttagtcttggaatttaaggtgctgaaacaagaacataagcaaaacttaaggaattcttgcccagtagactacacatacatatatttgttttttgtt

SEQ ID NO: 36451 - DNA, 1056 bp, Homo sapiens
tcttttttttaaaaaaagttttattcttattttttatggctatatagccggtatatttatgtggtacgtgagatattttgatgcaggcatacaatgcataataatcacatcagggtaaatgaggtttccatcacctcaagcatttatccttccttttgttacagacattccaattatactatttagttatttttaaatgtacaatacattgttgactgtagtcactctgttgtgctataatatactagatcttattcttactatatttttgtacttgttaaccatctccactgcccttcctagtctctggtaactatcatctccactatctccatgagttcaattgttttaatttttcactcccacaaatgaatgagaacatgcaaagtttgtctttctgtgcctggcttatttcacctaacataatgtccttcagttccatccatgttattccagatgacaggatctcattttattttatggctgaatagcactccattgtatatatgaacaacttttttttttttttgagacggagtctctgtctcccaggctgaagtgcagtggtgtgatttcagctcactgcaacctccacctcagcctccgagtagctggaattacaggttcctgccaccacacctggctaatttttgtatttttagtagaaacagggttttgccatgtaggccatattgatctcgaactcctgacctcaaatgatccacccgcctcagcctcccacagtgctggaattagacgtgagccaccgcgcccgagaggaaccacattttctttatccatttatctgttgatggacacttaggttgcttccaaatcttaggtattatgaacagtgctgcaataaatatgggagtgcagatatctcctcaacctaatgatttcatttcctttgcgtaaatatccagtaagtgggattgcagaatcatatggtagttctgtctttagtttttttaggaacctccatactattctccatagtggtgattttgagtcctgactgaagatatttagcaaattatttagacactctgagtt

SEQ ID NO: 36452 - DNA, 1062 bp, Homo sapiens
ggcttttctctctttttttcatttctcatttctttttaggtagggatttgaatcgtgaaatccctgaatcgttagggatttccaggaccttattttagagcagccataataggaggcatctttctcttcttagttttaggaggaacacttctatagattttaaattaaatttgatgcttgctgtggatatctgagggagtcattttgtccagttaagaaaacattctttgatttttcacttaagatattttatcaaaattcagtgttacagtgtatcaaatgtttttatgacatctattgaaaaattatttttttctttttaatctgctactatattagttgaattattttccccagttttactgtttctttcttgttgtaaacactacttggtcatgatatattctttttactacccttactactaaatttcgttttatttagaatgtttatattcataagaaaaatagccttgtacttttttccccttatgtttctccttgctgtgtcataccttatatacttgggagctaggtgtgtcttgaagatttgataacattccctcataaaactgagtctggtggctttaaaagatggaattttgactgccttttcaattttaactgtcatattcaagggctgttaatatcctagccacttttctctgatcttgaacaagtcactgatttcattgaatcttagttttgttaatggtaaatagagataacagtatctaattcccagtattgtcgtaaggattaaatgaaattgattatttagcatagttttgtctcgcatatggtaaatggtcatcaataataatcattattatcattgttattcccttatgtagattactgtagcgaccttagtcatccccatctcttacacagtacagctgtaaattccatagtagacagagaggatacgaagatgagttaatggtccgtcccacagtggtagtcatcaactccatccgacacactctttggtgggttgagacctctccctgaactagatctttttcccgcagtgctgtgtctcagcagacctggccatggg

SEQ ID NO: 36453 - DNA, 1067 bp, Homo sapiens
tgcttaaagaacatgccatgcagctgggcatggtgtctcacacctgtaatcgcagcactttggaaggccgaggcgggcagatcacctgaggtcaggagttcgagaccagcctaacatggtgaaactccgtctctattaaaaatacaaaaattagctgggcatggtagcatgtgcctgtaatcccagctactcgggaggctgaggcaggagaattgcttgaacctgggaggcggaggttgcagtgagccgagatcgtgccattgcactccagcccaggcaacaagagcgaaactccgtctcaaaaaaaaaaaaaaaaaagaacatgccatgcatatatgtattatgttgtcagcctagacagctgatcccaatttaaagcatctgcagattactgtctaaatcatagtctacaaaaatgacaaacttgtgatctgtaatcagtatccctacgtgctttgatgatttttagtggtaattataaatgagaaaatacagagtttgaaacatggtctctttgaattaaaaatactttcaaaaatatcttgaggaaaaagattttttgtagctattctgagttatgaaaattaattagcaataattgtctccttggtgtgaggggagagaacaaataatggaggtgggcctccagcctacctaacactggcttttgctgaggctctagcagccagccaggggctctgcatgtgagtgggtggtggtagagttgacagcagtttggattcaaagacaggaaggaaatgcctgtccctcacagggccaagctgtggccctgtcttctggcttgcctaggcattaaagaaaagacataaactattctaaaattaccaactcactgatgtgtgcgcacccacccacaaactgagggggaaaggggacttacagctcacaccagagtagtttatacttcctagaatagccctactctctcaattctgtgtgtcttgtatcctcagatggtttcagtgggtctgagggttttagtattaggtttctagtaaccacgaaaatgcctaacagttccagttacttggattttctacaggtaa

SEQ ID NO: 36454 - DNA, 1023 bp, Homo sapiens
ttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactga

SEQ ID NO: 36455 - DNA, 1025 bp, Homo sapiens
tattcatgaacttatgtggctatacacaagtacttactttaaaaaaaatgagggacaaggacagcacttctttatagtagaattacaagtaataaatgtagaaggaaagggaaaaagaaaagtcatcactaggcaaataccacaataaaaatcatttcagacaagagtcactgatgaagctaatattagtaggcacaaatctgagaaaaaatttatataatctcaaactatctttcccaatatattaactaaaaagggaaagatagtaattttatcatggaagaacctgacagaaaccatcttaaccaagtggtcagggtcaacatcaccaataagaaggcatgtacctcatgaaccctgtgacctgatgcagtgagaaggccccaacttcatctctgtgaaaatgtagaacctcagtgcaattaggagaaaacaccaaggggaccaaactgaggaacatttgacagcataactcatcagtattcctggaaaatgtaagcgttatgaaagacaagactgaggaaccattcagactgcaggagaccaaagagaattaactcaatgcactgtgagatcctgggttgatcttgaaactgaaaaaggatgtgaatggaaacactggtgagattagaataggatccagtttacttaataaatccatgctcatttttctgtttttgatcattgcactatgattatgtaatgtgttaccattgggagaagctgggtaagtggaggggatatggaaactgtctgtactatttttgtatcttttccgtaaatataacgttaattcaaatttttttaaaaaaagaaaaaaggtaaattgagtcatgtcactcctctgctcaaaacctccagtggctccctatgtcactcatcatgaaatcctcagtcctctcaatggcttacaagtctccatatgctctggacatacttctctgacagtatcttctcccatgcctcccctcactccttctggctttccttgctaattctcagcacagtgggcattttcctgcttt

SEQ ID NO: 36456 - DNA, 1049 bp, Homo sapiens
ctcccctctgagcgctggcggccgggcaggcgctctgtaacttgccgtacacacctttctcattgaatattcctgaccgcccttaagctggtcatattatcctccccatcttacacggggaaaactgagctacagaactgaaatgactggcccaaggtcactcgggtgattccagcatgttcctctgaggtcacctttatttagttcttaccagtggtgaaatgctttgtgttaaacgtgcagcagatagtgatgatagttgcatggccttggatatgctaagaactactgaagtgtatgctttaaagaagacaagaggactgagacctttttttttcttctatatgtcttatatgtgtgctctctgtttactctcttaatttttaaagagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagaggagtctgcattgtagtgtctcaaagacacaataaacttcctatggtctgcactgttgtgatattacatttttgtgagtagaatcctgtgtgaccactaatattcaagttcatgaagcgcccctcctcagcatgagtcttgaagttttgcctggtctcgggttttggtgaaagagcagggctccccctttgttccattatctacaagaaagtagctgcaggtactcctgcatctaaccatttgtgggtgacatgggctatggcgagtgctggttcttggccctctgctcccatagcaacaataaagtctactaactatattgtaattagtatgtgtcagggacgcttttattttttattttttgagatggagtcttgctctctcacccaggctggagtgcagtggtgtgatctcggctcactgccatctgtgcctcctgggttcaaacgattctcctgtctcagcctccgagtagctgggattacaggtgcaggacaccacacctggctaat

SEQ ID NO: 36457 - DNA, 1035 bp, Homo sapiens
cgtgaatgaatttgatttttcttatctcatattaatacagcagaggatatcacttagtgacattgaaccaatagttttttaaatttctcttgtcttaaattctttaattttgcttttgagtgtctacaccttgatatttctattgttcttttttttaatcccacctacaaaactctttttgatattcaaagtctgtcaaggattagtcttcccacttacctttgttatgtgacttgcagaactaaaaggatttggggaagaaagagtctctacttttataattatattggtatttaagaggaaattagttgtcctaatgtctgatttatacataatatttattctcagggtaagatgatcatgcaggataaactggagaaggagcggaatgatgctaagaacgcagtggaggaatatgtgtatgaaatgagagacaagcttagtggtgaatatgagaagtttgtgagtgaagatgtaagtctgccacaatatgcctaactactgtgtgtcttctgtgaacatctttaagtgggttagaagggaagtgtgcagctatatgtgtatagtagaattattaaaaatggagtttttctggggggggcaaaattttatatttttttatatatttctctattagtacagtgtttagtaaggtttggtctttgtgcatcacgttcacaaatcacttttgacacattcgaatattgttatttatcttgtatctttcttttcttttcttttttttttttttttgagacagagttttgctcttgttgctcaggctggagtgcagtggcgtgatctcggctcactgcagcctccgcctcccaggttcaagcagttctcctcccccagcctcccgaatagctgggattacaggcatgtgccaccaagcctggctaatttttgtatttttagtagagatgggatttctccatgttgatcaggctggtctctaactcctgacctcaggtgatccgcccgccttggcctcccgaagtgctgggattacaggtgtgagccactgcgcccagc

SEQ ID NO: 36458 - DNA, 1044 bp, Homo sapiens
gctattgtgagtagtgccgcaataaacatacgtgtgcatgtgtctttatagcagcatgatttatattcctttgggtatatacccagtaatgggatggctgggtcaaatggtatttctagttctagatccctgaggaatcgccatactgtcttccacaatggttgaactagtttacagtcccaccaacagtgtaaaagtgttcctatgcatcaattcttgaagagataatattgaaagagggatgattctcaagccctttcaatttttagataatttggagaggtatttaataagtatatatacctggttaatatatttaagtcatatggttcattttagttcacaataacaaggaaatggagttagtctgtgtctcaaaatagatggtatagtgtctgtaggtgtttacgtggcctccttagtggccttaatgttcaactttttaaattaccacgctggatttccaggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaagg

SEQ ID NO: 36459 - DNA, 1041 bp, Homo sapiens
aattacaggcgtgagccaccccacctggctacagttatttttaatgaagattttctgagttaaagtttttttgtgtgtgtgagacggagtcttgctttgtcacccatgccagagcatagcggcatgatctgggctcactgcaacctccacctcctgggagggtcctttgccatgtggtagtcagaccctctcaaaatcctttaaccaactcccattctaagctataataaactatttgtagttcttcaaatatgcattttaaatcttggtagctagggcctagttgccttccaaaaatatgacagttaacactcccaccaatagcaacatgaatgtgcttgttccccaaccgcttgccaatgctgcgtgttaccattctaacataaatagagtatatttaggatgttttgtatgccgaaccaacgttgacatactaacttttatgtggttgtacaaaaaccagtatgcagttgagaactgatgaagagattaaaaagtcgtgcttgtctttactataattattttgttttctctctaggtacttttaaactagtaatagaattttctgaagaatatccaaataaaccaccaactgttaggtttttatccaaaatgtttcatccaaatggtaagtagcattttatagattttgcagatgatagtggggaaaagagttgtttccctccttttagctctttcaccttactttttactgttagggctcacttgtaggtgttgcttccatgtccatgtgagccacgtattttgttgtggatttttttttttttttttttttttttttttgagacggagtctcgctctgtcgcccaggctggagtgcagtggcgcgatctcggctcactgcaagctccgcctcccgggttcacgccattctcctgcctcagccttgtgagtagctgggactacaggcgtccaccaccacgcctggctaattttttatatttttagtagagacggggtttcaccatgttagccaggatggtctcgatctcctgaccttgtgatctgcccaccttggcc

SEQ ID NO: 36460 - DNA, 1447 bp, Homo sapiens
ttacatctattacatttatatttctgtattataaattaccatgtgaaagacttctccaaattcttgaagctcctcttcagtctcacagcctttgctcatttaaatgtggcgttccccatcagccaactcactttcaggaagaacattttcagaggtcctcttggtcgtgtctctagtactgcagaatacattatagagctccctacccagaggagagatgtgtttcgtttgtgtctggaatcaaggtgactttccagtaatagatactacctttggcacttcatttctgtgaagttgctttttccttctagctgccttttttgcttttttttttgtccaagacaggtttaattttattttctgtttctctttttggggaagttcccaggtcatttaccatttattccactgtagctttatcttgcttagacttgttattgagtcaaaccaaaccaattatgataagggggtctttaaataaaggtgggaaagactgtagaatgagtaagggatataaatatagggttatcacttaagcaaatttttaagaaaccacagtgtatttggttttcacatctcttcatatttatagcatggtttcccttttattctgctgagtacttttttataatttaactttctggtttatttttttaaaaacatttattgaaatataatttacacaccaagctgttgacccacttaaattgtacaactcaaatggtttttagcataatcataaccatcaccatgaccactttaaaaacaacaaaaagccccataactattatcttagcagtcaactctgtttgtcttaaccctccccgcttcagtcctaggtaagtgttacccctaacgtgttttccctctagatttgactattctggatatttcatataaatggaatcttatactatgtggtcctttgtgactgacttctgtcacccagcataaagttttcaaggctcatctatgttgtgatataatagtatctgtgattcattttttattgttgaataatattccactgtatggatattctgtattttgttcattagttgataagatatttgagttctgatttacttttggattctcagaaatagttactcagaactttaaaattgttttacacttttatgggttttacagagttactaatttttgctttgggcagctaagtttgatgtttctgtgggatggacagtaagttggctttgaagctgagagatagatctaggctaaggccaatgattgggaatactgagcacatggatggtaactgaggccacaggagtcaataggattgcccagtgtgtgtgtaaagggtaagaaggaaaagggcttaggatagagtctggaagaatcacagtgtttaagtgtgatttgctccccactctctgttatggtttgctccatgaaatggtatctgtaacatttaaatgaa

SEQ ID NO: 36461 - DNA, 1078 bp, Homo sapiens
cataatttggtgaatacaaaaagaaggaatctgagtcacagtcttaccacctgagatgttgaaaacagctggtttaaggggaattgggttctgtagtgagctggggcccaaaattcacagccagagtgataaggaatgtagccactttgtaggacaaaactccaggacagggcgtggtggctcacgcctataatccctgcactttgggaggatgaggctggtggattacctgaggtcaggagtttgagaccagcctggccaacacgatgaaaccccatctctactaaaaaaaacaaaaaattagctgggcgtggtggcacctgcctgtaattccagctactcaggaggctgaggcaggagaatcgcttgaaaccaggaggcagaggttgcagtgagccaagatcgcaccactgaactccagcctgggcaccaagagcaaaactcccatctcaaaaaaacaaaaacaaactccaggataagcctcctgccacatagcaagtgctggagcaaaggccatgcccacaatgaaaggcacatacccacaggctgcacaagctccagacctcctagatccagtgatacaggggtgacaaggcacctagtattgaggtgcggttgcatgggggcagggtgcagtggtgacatgagctctggccaaggtttgccacctggtaaccctttcccctggaggttttgctacttccccctacagaacaacctgacattttggttggtgctgcattgttcagtgcctgccaccactcatcagtcaacgacatttacctagtatctaatgggtgccagattgcatgttgggctgggcaccacaaactgaaaaggtccacttctgcagcacttttgcagggatggagcctggttgcgtggaatgattgtgggcacctgttttgtgtaaatcttagttgaaaagctttcctatcttccgtccttgggcttagagggaaactagggcaggaatgaagcagagagagcctactaagtgccaggtactcatagacattcatttttccactgaatcctccaataaagtttgaagtaagaatcatccccactttgcaaa

SEQ ID NO: 36462 - DNA, 1046 bp, Homo sapiens
catgcagaggactctgaccctactgcagtcattatgaaaaccttccaaaccaaaataagaagggtagccaacaccaccaccacctagccccaggagtcctaactttagaaaaggcagagtgagctgtgcgcagcatgcatctgtaatcccagccactccggaggctgagatgggaagatggcttgaggccagaaggtcaaggctgtagtgtactgtgactgtacctgtgaacagccactgtactctagcctgggcaacataccaagatcttgtctctaaatttaaaagaaagggaaaaaaaaaaaagaataggcagagtgaactttggggaagaaacaatcttgcctggcttgcttttcattacatatgtatatatatgtatgtatatacatacacatacacacacacacacgcagatacacatacccaatgacagtagagattttttttaagggtgcactctttgttgaatgaagtttccatatgaccaaaagtcttcaataagttctaaaactcttgcctctgaagatctgtgtttactcttaattcctacagaaaggaatccctaaactagttaagaacgatagccataactagatgttatagggcacacaggtctcagataccagaagctgacagtctccttccagacataaagggatacccagcagagattctttagagctggagagctgggaaacaccaaattatctgacatttagggtaacacaattctcattttttatatgggacagtatgtattttactacaaactacaaagactcagaggatggacagtgacagttaatatgattcctctcattgcccataggtaggccaccgatccaaatggatcctgagttcagacagaatccttacctcctgataaggttgagtgaggattattaggtgagccacagactaaggaatgtttcagaaagcagttttctaggtgtagtttggatttacaaaaaaaaaaaaaaaaaagttctccaggccaggcgtggtggctcacacctgtaatcccagcaatttgggaggccaag

SEQ ID NO: 36463 - DNA, 1050 bp, Homo sapiens
gaaatcttgggccagggtgtttgttcctgcaagccacaggcaggccagctggactgtgtggtcccgacacttcttgggggagggagcgagagcacactcagcactccctagtatgtcactggggttctggctggagtctaaatggaatgctccttactcttcatggaatatacattcccaaggagaacgacatgcaacaagtagctcaacaagcacagctgggatgggtattccgtggacactgggtggtgaatttcttcagatagtgtgatgagcatagactgacatgggccacactgaagcttaaacctgaaggttgaaaagtcagacatgcatagaccacatagaagaatattccaaacagagtggagtacagcgtgtgcacagggctcgaagtatggaatatttggcttgttcaaaggaatgaaaggagcccagcatggctagaaggtggtgaggaaggggatagtggtcagtatgaagctgtccaggtggcaggggccagattgtgtagggtcttgtggtcaggagcttaggctttgtcttttgatctatgaagcctttgaaagattttcttaggggcatgatatgatctgatttatgccttttaaaatttttattttgttctaattttttttagagatggggtcttgctgtgttgcccgggcttgccttgaactcctgggcccaagtgatcctcctgcctctacctcccaagtagctggaactacaggtgcatatcaccatgtccagcttctgatttatacctttttttttttgagacagagtcccactctgttgtccaggctggagggcaatggcacaatctcggctcactgcaacctctgtctcccaggttcaagcaattctcttgcctcagcctccagagtagctgagattacaggcttccgccactaagcctggctaatttttgtatttttagtagagacggggtttcaccacattagccaggctggtctcgaattcctgacctctcaagtgatccacccactttggtctcccaaagtgctgggaatataaggatgagcc

SEQ ID NO: 36464 - DNA, 1083 bp, Homo sapiens
tgggcagtcaaggagtcctttcgagggcaccttccttactgtatagggtcactgcctcttttttaggagcccctcctccaggactttccgacctggtccaaggctgccatggtattactatctggcacccatatggatctctagccactgtgctgagggctttacactgttcttatttattctcaccagctgattctggcccacagatgtgtttagtttggccctttcaaagtgttgtaaaaattctgactcagttgccaacattttaaattaaggacatttatgtaaaaagccagttccagtttatctcctctgggaggtatgtctttcccaaggtccctggtctatgaggagaggagctaggatttgaacccatcaacaacttctgcttttaatactgtgggagatgctggctcggaagtaccttctttgcaggaaatgaagagaaatggaattcgcttacaggattgcaaaagaaaatgggtgggtgcacttttagcacctcccccccactccacccaccgatgtcaggacaaagctgggttgcgctgggctgggctgagctgaggaagacgtaggctagaatcaggagtcaggattctgtcagtcagcctttgtcacactctctcttttttttttttttttttttttttttttgagataaggtcttactctgtcgccaaggctggcgtgcagtggcacgatcatggctcactgcagccttgacctccctgactcaagctatcctctcacctcagcctcctgcatagctaggacctcaggcatgtgccactacaactggctaatttttaaattttttgtagagatgagtccccctacgttccccaggctggtctcgatctcttgggctcaagaaatcctccagccccggcctcccaaagtgctgggattacaggtgtcgcacccttgacacgcagactctggaaggcagtgagggtggcagctgtgggttgctgagctgtttgtactctgctgcgcagagacggagaagtcagaaggtcaagagcacggtctcctgaatcaaatacagtcactgacatcttgggcaggtcacttaacctc

SEQ ID NO: 36465 - DNA, 1079 bp, Homo sapiens
tattataggacagacatggtggctcacacctataatcccagcactttgggaagccgatgcaggaggattgcttgaagccaacagttcgagaccagcctgggcaatgtagcgagacccaagtctctgcaaaaaatttcaggaattgtggtgtgtgcttatagtcccaggtacttgggaggctgaggtggaaggatcgcttgagcccaggagttcaaggctgcagtgagctgtgattgcattgcatcactgcactccagcctgagtgacagagcaacaccttctctctaaaaaaaaaaaaataataatacaaattttaatatacagtatagcaactatttacatagcatttatgttgtattaggtattattttaaaaatctagagatgatttaaagtatacaaaaggatgtgcataggttatatgcaaataatacactattgtatgtaagggaattgagcatccttagattttggtattcgaggtgggagatcctggaactaatctcttgcagataccaagggaagattgtatactacatacccagttctgactgtggctatttgatgctttttactgaattgagaacaaatctttggatttggaagtttaaaatacagtcttggccaggtgcagtggctcacacctgtaatcccagcactttgggaggcagcgaaggcgggcggatcacatgagatcaggagttcaagaccagcctggccaaaatggtgaaaccctgtctctactaaaaaaatacaaaaattagccgggcgtggtggcgcgtgcctgtaatcccagctactcaggaggctgaggcaggagaatctcttgaacccaggaggcagaggttgcagtgagctgagatcacaccactgctctccagcatgggggacacagcgagactccatctcaaagtaaaaaaaaaaatacagtcttatgtttttatgagatttggctgtaatttgttgtttaaataaccagctgaagctaacttgtaactttcagagctataatttccctaaattgtgaaatccaacaaacatattgaaaaatcaataaaacacaaaatattcagattacca

SEQ ID NO: 36466 - DNA, 1024 bp, Homo sapiens
tttttagtggagatgggtttcatcatgttggccaggttggtttcgaacacctgacctcaagtgatccacccacctcagcctcccaaagtgctgggattaaaggtgtgagccaccgcacctggcctcccgatctcttttctttgtttttaaatagagaagggggtctcactatgttgcccaggtcagtcttgagctccttgccacaagtgatcctcctgcctggacctcccacatgccagcccagacattttttataattctgttcaagttcagttatacggcttcctcagtttcaaggaggaatgaaatattacttggaaataatttgcttgatgcttatatcattgaatataacactataattctaatttagctcctcaaaccctttctggaaccgtcttgattgatcagggctgtgcctcatcaaattctgcacatttgttactatttgacagttatttccattattttcagttgtgtgtaaaattgttttaaggaagtctagggctcagagatctatgtctgtgcagatatgcagaagaacttcctctaatactttaaaattattaactagtggatgtccctgggatttaactttcatccaatcaagggtgaaagttcagtctgtatattctttgagctccttatgttgttgaatccaaaccgaagtttcttttgttttcacttctttttcagtattaatataaatatagtattttattatcttctaagtggtatttcacccacttccttattttgagggtgattgtgtggcaggcttagttgcagggggcccacccagtaagctgcttcaaaaccctcctcagcctcaggtgtgaactggccatgctccctgttagcaagggttgatggattcaattccttcattcatctaatcattcacttagtaagtcattactgaatgccaaggctgcattatgactttcaagggccctaagctcttttgcctttgtggctccttcctgcctgaaaacatacttaaaattatattttatgactgtat

SEQ ID NO: 36467 - DNA, 1034 bp, Homo sapiens
aacagcgcatcaaccggatcatgggctttcacaggcccgggagcggcgcgggtaagagcctcgatttcccctcagtctcccgcccatcaccttgaatcttcagggtcattcttccctctcccacctccactcctctgacctttttgaccaagccttgctctttgatttcctctctgtcccgccccttcggtgatatcccaagttctcatccctgaaccccaggatgttcctagtcgctcccctcaattttcccggggcctcgccgtgagattttccccaccctgcctgcagagctctcactccctcttcccagttacgttgaacagccccttttttccttagccactcctcgcctttcttgaagggcgcacgttgtatccccagactgtcatgtctactgctccccttaggaagatggctttccttcttaaggttccaagtgcttttccttacagtgccttctctagcgtctaccttcttttgccttttgctgtgtaactcctgtccgcccacatcagcctgtctttactgaactgcccgctagttcatcctacgtgtatcagggactcttgtgctcatatcctagtgtttgtgttcagtgccgtcaacactgtcacctacgggccggctagaaaaggtgggaaaagtgagagtgagcattcttcagagacccagcaagtgcgaagtgcacacctgagagtttcctctcctcatgaggggatattgttgtgattgatgtctggagctgcatttctaaggagagcgcctccttcctcccccaaacacatgtccaatgattttctttaaaaaaaatttatttcacgtgagtataattgagcaattagcgcgccctagtgttatctaagtttccagtgtttcctttagtaattggcctttagtcactggtcgcaagctccttatatctttgtgacttttgttctgtaaggctttaggtgtatagctctgaacttttaggcagttcaaatgagaggtaagaaaaccatttcaaattcttctagaacaatagaagaaac

SEQ ID NO: 36468 - DNA, 1049 bp, Homo sapiens
ctgctggggaggctgaggcaggagaatcacttgaacccagaaggcagaggttgcagtgagctgcaattgtgccactgcactccagcctgggtgacaggtgtgagactttgtctttaaaaaaatgaaagaaataaattagtattctcatttttttcgttgagcacttataagacttggctttacttcattgagacctccacctttaataatggtagtgattaagattctttcaatgtgggacagaatcccctgatctgaaatagtagctccatttggtcatagaataaatgaaaagtgtccccctttcagacgttccagaagtagagagagagacagaagccgagagcgaagaagatctcgaagtagagacaggagacgctcaaggagtagaagccggggccggcgatcccgatcctccagtcctggaaataaaagcaagaaaactgagaataggtaatgttatcattgggctgcatctatagtgcagactggggactgcttcccttctctgcgccttttttttttttccctgtaagtttgtatttatagagaattaactgcatttggctcctaccatgaactgttggcagtgttttattttaattggctataatgtttataattcaactggaaaataatagattctgtcagttttaacattcaatacattgtattcttacttaatacataactgtcaatcagaaatgtattttatagacatctttgtagaaactctgtcattttcttttcaggcagggtctcactctgttgcccaggctggagtgaagtggcaagaacatagctcactaaccttaaacttgtagactcaagcaatcctctcacctaggcctccaaaagtcctgggattatatgaagaggcagacataatatcccagctaatttttatgtttttagtggagatggggttttggcatgtttgccaggctggtctcgaactcctgacctcaagtgatctgcccacctcggcttcccaaagtgctgggattacaggcctgagccaccgcgcccagccaagacttgtcttaaaa

SEQ ID NO: 36469 - DNA, 1920 bp, Homo sapiens
gcctcagcttcccacagtgctgggattacaggtgtaagccaccatgcctggccataaacttgtatttttttaataacacagagtctccctttgttgctgaggctgatctcaacctcctgtgctcaagggatcctctagcctcagcttcccaggtagctgggaccacagacatgtaccatgtgcctggccataaaatttctttatcatgttgatgtcgtttattttctaacttgtaatagaaaattgcttttcatagaggcaattttggaggcgtttaggggattaaaattgagaataactgggaaactttgcttgctaattactttagtttctgttgttaggaagaaataaagtttatgtgtgcataatgcttgtaagtaaaatgagattgatttatagtgtttgaaatctatcttttggctttcttatttgaagatgctttttttgtgatttcattttggtaatatatttgtgtgtatatttataaaggtatgtgatctaagtctaccctgaggggtttgtatatatgccttttttccccttctttatactttgaagaacttactggaatgtcacttggagcaaaattattaaatttggttttgctttttattttcccccatctctttctttcttttattcccccaagaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatggtatattttttagcctaatagcctgtataacacctcatgtagaatattatatgaataatatttcataaggggtttttaatcttttttattgttgaaaactatgcataatatgctgtttaccattttcatcattttcaggtttcaattcagtgataaatacatttgcagtgttgtgcagtcgttaccactgtctgtttccatgactttttcgtcattccatacagaaactctgcaccttttaaataactctatgacgccttttctcgctacttcttgtgacctttgctctattttctgtctctgaatttgtttagtctagctacctcacataagtggaatcataatacatatttgtctttttgtgtctggcttatttcacttagcataatgtcttcaaggtgcatgtatgttgtagcatgttggaatttcctttctttatatggctgaataatatttcactgtatatatatgccaagttttgtttgttcattcacctgccattggataatttggttgtttccacccttttgttatcgtgagtaatgctcctgtgaccattggtgtataaatatctgtttgagtctctgtattgagttctgtgaactatatacccagaagtggaattgagattgtaaaagctccttttaatatttatgttgtaatttgaaatatagaattgtgtttagtaagcatcactgattttactttagaatgaatcattgagtgttattgggcatagccagtaaatagttctttaatatattataccaatgtgaacgttagtaaggagagtaaattaagggcatgctttcaagtgcctcctctgatttttcttttctttttcatgtttttggagatagagtttcattctcttgcctaggctggagtgcagtggcacagtcatagttcactgcagcctcgacgtcctgggctcaagtgatttttctgcctcagcttccagagtagccaccatgcctggctaattttgtctttttcttttttcttttttgacagagtcttgctctgtcacccaggcggcactgcagtctccgcctcccaggttcaagctattctcttgcgcctcagcttttcaagtagtcaggat

SEQ ID NO: 36470 - DNA, 1435 bp, Homo sapiens
attatgacaatgaagttgtctttatgtacattttctttatcaatttggcactttggggctgatttccccttaccagcaggtggagtgagaatcttcagagctctggagtgacatctcagaagtacaaaaacagcctctcctggcacagctcagtttttaaactctgacttggcaggtagactcctcgtgcatctatctgtttatttatattgaggtttgttagcccagtatcagtggatatataaaagcgacatggaagatatcctagggaaacatattttcctaggtagtttttggccttaacaggctataatgccagcatttcattcaagattacttgtttagattctggtttcttgattcatcttggcagagataactcttggaaagttgagtagggttttggaaagttgttcagcttctctcttaggaacacggggcatagtatatctctcctctgtctgtgcccctcagaccaaggttgtttctggaagcagcagtatggcttctgtggcacagtgagtcacttgattttctttgttctgtgatttgcattagaaaactgtttgcattcttttgaaccaagtattttcctgagggttggatgaggcatttaactgtcatttatcttcttttagcatgtttttaaaaatctgcttatatttatccttccccacaacctctgctgttatacaacttttgaaatagttttcagggatgcataacaaaacaaaaattaggtgaaacaatctgaactttattgtaaaggttaaattgaacactataaagcacagccttaagaattttggtggttaggctactgatgtatttatctttccagctgtcatcatgactccaactcgagaactggctttacagattactaaagagtgtaagaagttttccaagactttgggacttagagtggtctgtgtttacggaggaacaggaatcagtgagcaggtagttatataagaaacattcatgttttccattcttttctcaagttggatgattcaataaagtaaaagtgacttttacttttagttttttgaatagtgattgcttctaaaatcatttaaaaaatgaagtataaaaataatagtaagaattagttattttatgtaggatgaatacctttggagatgtaatgtacagcatggtgactagttaatgttatattgtgtgctgaaaattcgctaagccagtagatctcacatcatgttttttttttttcttttttgagatggagtctcgctctgtcacacaggctggagtacagtggcgcgatctcggctcactgcaacctctgcctccctggttcaagcgattctcctacctcagcctcccaagttgctgggactacaggtgcctgccaccacgcctggctaatttttgtatttttagtagagacggggtttcaccatattggcca

SEQ ID NO: 36471 - DNA, 1031 bp, Homo sapiens
accacatccagctaactgtatttttagtagagacagggtttcatcatgttggtcaggctggtctcgaattcctgatatcaggtgatccacccacctcggcctcccaaagtgctgaggttacaggcgtgagccaccgtgtttggccctgataatttcttttaccctgttgtcaacattatcgttttttttttttttgtcatcgcctatcaaattctgttaagcccatctagtgaatttttgaattcagtttttgtatttttttagttctaaaattacaaatatgttctcttttagattttcttgtttgtctgattagattttctagacgttccttgtaagcatttttaaaaagtcttgatcataattattatatgtgctttgaaatctttgttaattttaacatctgggtcatactggtgtcagtctctattgactgtcttttttcttgatttttgttttatggttttgtctttgtatgtctagtaatttctgtttgcatactggactttgtgaatgatccattgtagagattctaaattctcaattctctgatgtccccgtcaagtggtgttttgtttttgtttttgtgtggtttccaaatagggcattaacttggcagaacccagcatccaaactctgtctgcctttaatgggcagcatctgaaatctcttactttttaattttattattattttttatacggagtcttgctctgtctcccaggctgtgtgcagtggcgtgatctcagctcactggacctccatctcccaggttcaggcgattttcctgcctcagtctcccaagtagctgggatgacaggtgcgtgccaccacgcccagctaatttttgtgtttttagtagagacggggtttcaccatgttggccaggctggtctggaactcctgacctcaggtgatccacccaccttggcctcccaaagtactgggattacaggtctgagccaccgagcctagccctgaaatctctgaatttttttttttcatcccaactgcttagatttttgcctcat

SEQ ID NO: 36472 - DNA, 1045 bp, Homo sapiens
tgccttgatggggaaacaacctgcatttgtttcctttcttgattcaaaggaataagggaataagccttttctggttcagttacccagtttttaaggcaaatccaattggattttatgggttgggaagagttttgagagctttaccttaggaacatgttatatcactccccctgagaattattgactatatttttagtaggccactgaccttgagttatagtccttcttccagcctgtttcattgcagtataatttggtctcaaggcctgagccctggggtaagtcagctgcatcctattggctattctgtcttgaaagcacatgtttcctcatttattgaacagggatgaagtttctggtcctctcaggagtctgatgacgtggttcatgcaatgttgtttctctgttttctatttttctccctaccatagacaactgattttttaaatgaaatgtgacttttaacaaataggtggtatattttcccatggatctgtgtagtaggatttgtgtaaatataactatctgattccagccttttggtggaaacattccttatttatttctgtagaataacttaatttggtatttctaattcagttttttactagtcctttttttccttttgatctagattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtattaagtaatttgttccaagtctcagtcaatacttttaagaagttctttgattttacttttcaggaattatgttgaacacaagtaaacaagttgtcctagacattgagtttgtgagaatttaacattctcaatacagaattttttgataattgcatttggatgatttctcagtgctattgactgaggactttgggcctattctggaatttctaactgttagccactggtagtttt

SEQ ID NO: 36473 - DNA, 1928 bp, Homo sapiens
gaatagttgagtgaacagagaattcattagttattgaatagtttttcctttctcaatgcagtaatagtaacatttaaaattttaaataaccaatagttttataagttggcaaaggaaatgatcttaaatatttccttttgggtttgtttggttggttggttggttcgttttttttttttgttttttttgttttgctttctctgatgacatatcttttatttcctattacagcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatggtacccaagttttaaacttagatgtgcttcatcttagtgaaatttaattcacaaggaatcataaattgtgtttttgaggctgggcgcagtgactcacacctgtatcccagcaatttgggaggccgaggtgggcagatcacttgaggtcaggagttcaagactagcctggtcaacatggtgaaaccctgtctctactaaaaatacaaaaattagtcggcatggtggtgggtggctgtaatcccagctactcaggaggctgaggcagaagaatctgagccaagataacaccattgcactccagcctgggcgacagagtgagactatctcaaaaataaataaataaataaataaatagtatttttgagccttcaagatacagttcctgaatattctaatttaaattgttataattggattacctaatattcttttcaagactcctgatgtattaacttcatgttattgtcacttttcaaaaaaggaatttttttcaggagttaaataaagtcagtcttttatatccaagggtttcaaacccacagattaaaccaaccacagatcaaaaatagaaaaaaaaaaaaaaagaaaaaaagaatgtaaaattttaaaaatacagtttaacagctgtaaaagttttactataacatttacattgtgttaggtattttaagtaatttaaaggttacagtatacaggcggttaaagtatacaggaggatgtgcatcggttatatgcatatagcaagccatttcata

SEQ ID NO: 36474 - DNA, 1024 bp, Homo sapiens
ggtcagcaggagttccagcatctcagaattgtggtgaaaaccaatacaagtaaggaagttattaattccccatttggtgggttcctcaaccccagccactggggacggtccacgccggatcaccagcagctcaggcttaaggccacgacgcgcaagcgcagcctgccagcctggctccctcccaaagcttgcgtgcaggttggcggcgggagatcgggtctcgcgatgcgagtgagcgtgtgcgtgcgcggccctcgcgagctcgcgcacgccgcctctaacactacagggtggtagcggcctcttcgtactgcgtccggggcaggaccgtgcgcggcggccgcggcgggtgctgggagccagcgcctgcctcgccgccgccctcgctgcctgccactccgtcttggcccgttctccgcaccgtgcagaggcggcgggctggggagggagcggcgccagcacgaggttcccagccgctgggaagcccctagacgcgccgaggggccgggctacgagcggctgaggtaggtaggggtgcgcgggctggtcagccggccgggagcggggtagggcggcggcgagaacgggcgcctcgctgaccggggagaagaggcctcctgccaaggggccctagtgtagccggagtgagaggaggggccccggacgtagcctgctcttccccggtgtggagccattacggggggacattcctcctgcggcggggggagggagccccctttcttttctttgagaggtcagaatccgcagtccgcccttcgcctttaaataaaagcctgccggctcgagatcggcgtcgcgatggagtgcccgtggacttctacgcttgcggaactccgagtggacggatagcggcttatgaattttgctttttagagggtacacaaccctttctctagggtggcgtgcatcttctgcaaacttgttattgccaatacgctaatagtcgctttcagcacacaacaggtaatacattctaaacgcctcgtgtcaaaataaggagagt

SEQ ID NO: 36475 - DNA, 1098 bp, Homo sapiens
ttaaatcagataatgtgcaaagaaccaagcttattgcctggcacataacaaaatcctaaaaaattgctaactttcagccaatactatgtttggaactcatcttgagagtctccttttttctcatctgaaattagaatttgagctagtgaaatgataattaataatctagtcctttttgttttgagacggagtcttgcttgtcactcaggctggagtgcagtggcacgatctcagctcactgcaacctctgcctcccgggttcaaccaattctcctgcctcagcctcctgagtagctgggactacaggcacgtgccatcacgcccagctaattttttgtatttttagtagagacggtgtttcactgtgttagccaggatggtctcaatctcctgactttgtgatccgcctgcctcggcctcccaaagtgctgggatcacaggcgtgagccaccgcgcctggccaataatctagttcttgtatctgtggggaatgagtgaaaaaattattccacttaatatttgtgtttagcccagtcttgttttatgttctcaagtctaaaaagcttttgccataaacaagtagcttctcactgtagatatttttccatcaaattgagactttaagccagcttgccaattgctctgttgattctcagcaaatgtttcataatttaacagaatttgattctgtgacttcatgctcatttccttttgcctttacaaactaaagtaagtttacagtggttttcgctaaccttattacctgtttgcagcctctaggagtaactgttttcataactgaggttttggtgcactctcacatgtatgaagggtgcacacaaatatctcctaacaacttgaggctggaccttaatatacatttgtgactctttataaatccgaattggaacccatatctttatctcttttacctcatcacaacataatactgtagtctctataaaactgtcatttccagccaggcacggtggctcacgcctataatcccagcactttgggaggccaaggaaggcggatcacctgaggttgggagttcaagaccagcctgaccaacatggagaaacctcatttctatta

SEQ ID NO: 36476 - DNA, 1025 bp, Homo sapiens
ataacgatggagtgtccatcttgtggaaactgttgtcaggccagaagtatgcatgtgagaaatacaataaaaggccaacaggaggcattctaagaacatcaggcaaactgaaaaaaagaattgtgttaataagagttcttggctttactattattcttttgaggtttagtaatctagaagagaaaagcccacagaatagaacatttgtttttgacttacacacttttctggttcctaattggagagcattatagctatgaaatcagtattataatagagttatcttgtatgatgtttgtcccatgattaaattgagaagaagtgtccttgaatctgctgatgtgtgtttgtttataagtggtctggagtcctgcctgttagcctaattttatgtagcctgcatagttgttggaagacagactgttttctcactgaatgctgcatacaggtatgtatttgtgtgtgtgtatttatatatatttgtcttttatttttggtagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaactaaagaaaaagaagaatctcaaccgatctggtaagcgtggccggccttcgggaaccaccaaatcagcaggataccggaccagcacaggcagacccctgggaaccaccaaagcagctggatttaagacaagtccaggcagacctttggggacaactaaagctgcgggatacaaagtcagcccaggcagacctccaggtagcattaaagctctatcccgtcttgccgatcttggttatggctgtggcactgctgcttttccttaccctatgatgcatggcagagcagttcat

SEQ ID NO: 36477 - DNA, 1050 bp, Homo sapiens
ctttctggtagttctttctctggcactgggtagtttactcacatgcatgtgatgacccgtaccctgctgtatacttgggggggcctctgcagatctctggagtcccctctctagatagctcctctcatctgcagtattctgtcttgcaaactatggcttcttggtctccttggactcttagctccatctcctcaactgggagagtctgctgggctctgcctggatttcccctccctgagccacagtgggaacgccatcaaggcagtaagttggagcagttgtagggttctcttcatttgtcgcctgtttctcggatgtcactatcctctgttgcctcataactgatttcctgaaactgttgttttatatatattatctatttggttgtttcagtaggtaaggtaaatctggttcttgttactccatcttggccagaagcagaattcccagataatgtttttgaatctctgaatgaatccacagagctctatgccctagtgtgaggtagatcagtagggtaactgtagttcataatagcctattgtatattttaaaatagctagaagagaagaatttgaatgattctagcatgaagaaaagacaaatatttaaggtgatggatatcccaaatacattgatctgatctttacaaattgcatgaatatattgattatcacatgtgctttgtgattatcacatgtacatctgttatgcatcagcaacaacaaaaagctctacagggatattctttgaaatcttatacaaatgtgcatacctgaggaagcccccagaccttcccaactttgaagtcagttggtcactgacactccagtgacatgctgttggcacgcagaactcatcacccagcgggtggtttcttaaccacatggtgagctttcgtgagggctgctggcctcactggtttctgctggttggtgcctggcacaaagtctggcagctggtgttgagttgatgagttggagggcaggaggcattgctatggaggtgagtggagttgggtaaatagatgtacgagactacctgggactc

SEQ ID NO: 36478 - DNA, 1035 bp, Homo sapiens
tctagctccaaagtgggggaaagttctcttcttcctcctgctgctgcctctgcactgccgagcccatctcccagcactcccaagggcagcagcccaagggtggcaggcaggagagcagagtccagctgtcagaggccacctcaggaaggagctgctgtgtggcttgaacagtgttcttcaggcagtgtggctcagcatccccgaggtatcatggcagggagcctacggctcgttctggagtagcagccagaaaactttgctcgcagacttggctttgctgcttactatctgtgtaccatcggacactgtgctgagcctctctgtgccttgcctcgttacctgttcagtggtcttggtaacccttgtcttgcccatctcacaggactgttataatgtgtgcaaagatgctttgttctagtagaatcttgcataaaaccatgatccttttcttggatattatcaaacaaatgaaactcttatcaaaaaatgaaagtgtttatattctattttcctaatgagatatctgaactggaatgtttttggttataatccacatggcaagcagcaagtttagggcagagctgtgtgtttgtctattatttgacattcattattttgtttgcttgtttgtttgtttgttttttgagacggagtcttgctctgtcgcccagactggagtgcagtggcgcagtcttggctcactgcaacctccgcctcctaggttccagcaatcctcttgcctcagcctccctagtagctgggattacaggtgcctgccaccatgcccggctaatttttatatttttaatagagacagggtttcaccatgttggccaggctagtcttgaactcctgacctcaagtgatccacctgacttggggcctcccaaggtgctagaattacaggtgtgaaccaccatgcccggccttctttgacattcattaatttattaatagtacctgcttgtgaccttcttcctaacctgggaaatggtgagtagctctctgatagtttaatgaaaggagacctttttg

SEQ ID NO: 36479 - DNA, 1050 bp, Homo sapiens
tgttgtgagtcgtgaaccaccatgcctggcccacagtttcgtttcgtttttttcttttcttttcttttcttttctcttttctcttctcttcttttctcttctcttttcttttctttcttttttttttgagatggagtctcactctgtcacccaggcgggagtgcagtggcgtgatctcagctcactgcaacctccatctaccaggttcaagctattctcccactgcagcctctcgccgaataactgggattacaggcgtgcttcacatgcccagctaatttttgtatttttagtagagacagggtttcaccatgttggtcaggctggtcttgaactcctgacctcaagtgatctgcccaccttggccttccaaagtgctgggattacaggcatgagccaccacacctggcctgtggcccacagtttcttaattcctttcacgaaagaattctctgtagcatgcaatgctgtttgatagcattttacccacagtagaacttctttcaaagttggagtcaatcctctcaaaccctgctgctgcattatcaactaagtttatggaatattctaaatcctttgtcgtcatttcaacagtgttcacagcatcttcaccaggcgtagatgccatctcaaaaacctactttctttgcttatccataaaaatcaactcctcatctcttcaagttttatcatgagattgtagcaattcagtcctatcttcagactccacttctaatcctagttttcttgctatttctaccacatccgcagttccattctccattgaggtcttgaattcctcaaagtcatccacgagggttggagtcagcttattctaaacgcctattaatgttgatattttgaccacctgccatgaatcacagatatttttaaagtcatctagaatggtaaatcctttccagaaggttttaaatttattttgcccaaatccatcagaggaattgctatctatggcaactatagccttatgaaatgtatttcttaaataataagagttaaaagttgaaatccctccttgattcatgggct

SEQ ID NO: 36480 - DNA, 1047 bp, Homo sapiens
agaactcttggttgaccaggtgcattgtcaacgagtataatattttgaaaggaatctttttttctgagcagtaggtctcaacagtgggcctaaaatactcaggaaaccatgctgtaaacagatgtactgtcatccaggctttgttgttccttttctagagcacaggcaaaataaatttagcataatttttaaaggccccaggatcttcagaatgggcaatgagcaatgagcattggccctgtggttgctcatacctgtaatcccagtactttcagaggccaaggtgggtggattgcttaaacctaggagttccagaccagcctggggaacatggtgaaaccttatctctacaaaaaatacaaaaacttgccaggcatggtggtgggcaccagctacttgggaggctgaggcaggaggattgcttgagcccagaggctgaggctgccatgagccatgattgcgccactgtactccagcctgggtgacagagcaagaccttgtcaaataaataaataaataaataataagatttattgttaaataaataaataagaccgcagctacactggcctctaaaaagagtccgcctgtcctttgaagccaggcattgacatctcttgtctagctatgaaagtcctagaagccaccttattccaatagaaggctgtcttatctacatgaaaattgatttttgagtatagccaccttcatcaattctcttagctagatgttctgggtaagttgttgcagcttctttttttttttccccattgatctttgatgttactatgttgtagcttctctatcagcacttgctgcctcaccttgcacttttatgttctggagacagcttctttcttaaacctcatgagccaaccccagctaatttcagacttttcctctgcagtttcctcacctctctcagccttcgtagaattgaagagagttagggccttgctctggatttaggctttggcttaaatgttgtgactggtttgatcgtctatctatagcattaagattttctccatatgagcaataatgctg

SEQ ID NO: 36481 - DNA, 1004 bp, Homo sapiens
tcccttgtgccagcttaccaaaccaattgcctactgtaagttgatcttttttgagggacagggatgggcattctgaagagttggaaattttttctgtcaaataagttgacacagtgtgctttgtccatgaattagagttttctggtctggtttgtttagacaggaacttaactagtggaataattgtgccattggtagatccatattataattgaaagcaactcagattgcagaaaaggagtgccccccagccatgacccataagcaaagaggtcagaaacaaatgaaaaagccaaaagtttcaagtatcagaaatctccgtaggtcacacgcaacttcctcatttatttctgtctattctgagatggtaattgtatgagaaagccctctattaataataaattcaggttttttgacttctttctcttgtagcctttctaccaggtttggcaccgtagctgttcctaatattttattatttcaaggagctaaaccaatggccagatttaatcatacagatcgaacactggaaacactgaaaatcttcatttttaatcagacaggtatgtggaagtaatgtgctgaggaagaagatattctattgctgggggtctgtgccttctgtgggttctgatctgctataatccttaagtgaaggattcaagactgactttgagttgtaaaacttctcttctaatgaactgttatgatcctgttaaatacttcccaatcagtatgaagtttaacatgaataggtaattttaattattatagatactttttttttcccttttttttttttttttgagtcttgctctgtcgcccaggctggggtgcagtggtgcgatcttggctcactgcaacctccacctcccgggttcacgccattctcctgcctcagcctcccgagtagctgggactacaggcgcccgccaccatacccggctaattttttgtatttttaatagagacggggtttcaccgtgttagccaggatggtctcg

SEQ ID NO: 36482 - DNA, 1090 bp, Homo sapiens
ggttaattttgcgtattggggtcattagtgttcttgtagttgaaatacaatgatggtttttcatatcattggtcgtggttgtagcccgtgcaagaataatgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaatagattatgtgattaggagtagggttaggatgagtgggaagaagaaagagaggaaataaagtttgattatgcctttttgggttgaggtgatgatggaggcggagatttggtgttgtgagattgttttaggtagtagcttttctagtcaggccaggtctaggaggagtaggggtaggttttggcttgtaagaaggcctagataagggactgtgcggtgtatgatactagggtaaaatccgagtatattagagaagtaaaatgtatacagtggggattttattttgagtttgttggttaggtagttgagatctagggctgttagaagtcctagggaagtgacgcctagggctgtgagttttaagtaaagtgggattgtcatttggggggtggatgtggggagaatgctgttggtgatgagaaaccctgcaaataggcttccgattgttaggcgtttaatggggtttagtaggg

SEQ ID NO: 36483 - DNA, 1044 bp, Homo sapiens
tgaagaaggcgtgggtacagatgtgcaggaatgctaggtgtggttggttgatgccgattgtgactattataagtcctagttggcttgaagtggagaaggccacgatttttttgatgtcattttgtgtaagggcgcagactgctgcgaacagagtggtgatagcgcctaggcatagtgtgagagtttggattagtgggttattctctgctagggggtggaagcggatgagtaggaagactcctgctacaactatagtgcttgagtggagtagggctgagacaggggtggggccttctatggctgaggggagtcaggggtgaaggcctaattgagctgatttgcctgctgctgctaggaggaagcctagtagtggggtgaggcttggattagcacttaggagggttatttgttgtgggtctcatgagttggagtgtaggagaaatcatgctagggcaaggatgaaaccgatgtcgccgatacggttgtataggattgcttgaatagctgctgtgttggcatctgctcgggcgtatcatcaactaatgagtaaaaaggatataattcctacgccttctcagccgatgaatagctggaataggttgttagcagtgactaggattagtatggtgattaggaagatgagtaggtatttgaagaattgattaatgtttgggtctgagcttatatatcatagtgagaattctatgatggatcacgtaacgaacagtgctacagggataaatattatggagaaataatctagtttgaagcttagggagagttgggttgtttgggttgttgcccagtgtcagtttgagataatgacttcttggtctaggtatatgaatattgttgtggggaagagactaataacaagggtggatgcgataatggattttacttaatggggatatgagttttttttattagggttaatgagggtggtaaggatagggggaattaaggaagttagggctagggtgggtatagtagcgtacatggttattacttttatttggagttgcaccaaaatttttggggcct

SEQ ID NO: 36484 - DNA, 1034 bp, Homo sapiens
atattaagttattggctcaggagtttgatagttcttgggcagtaagagtgagtaatagaatattcagtgagcctagggtgttgtgggtgtagattagtgcgatgagtagggggagggagcctactagggtgtagaataggaagtatgtacctgcgttcaggcgttctggttggttgcctcatcgggtgatgatagccagggtggggataagtgtggtttcgaagaagatataaaatatgattagttctatggctgtgaatgtcataattaaggagatttgtagggagattagtatagagaggtagagtttttttcgtgatagtggttcattggataagtggcgttggcttgccatgattgtgaggggcaggagtcaggtagttagtattaggaggggggtcgttagggggtcggaggagaaggataaggagcagctaaataggttgttgttgatttggttgaaaaatagtagggggatggtgctaataattaggctgtgagtggttgtgttgattcaaattatgtgttttttggagagtcatgtcagtggtagtaatataattgttgggacaattagttttagcattggagtaggcttaggttatgtacgtagtctaggccatacgtgttggagattgagactagtagggctaggcctactgctgccttgcaggcagcaaagactagtatggcgataggtacaatattggctaagagggagtgggtgttgagggttatgagagtggctataatgaatagtgatagtattattccttctaggcatagtagggaggatatcaggtgtgagcgatatactagtattcctagaagtgagatggtaaattctagtataatatttatgtaaatgagaggcatttggtaaatatgattatcataatttaatgagtcgaaatcattcgttttgtttgaactatataccaattcggctcagtctaaccctttttataatcattcgtaggccagacttagggctaggatgatgattaataagagggacgatgtgactattagtg

SEQ ID NO: 36485 - DNA, 1048 bp, Homo sapiens
ggcaggtgagaggggctggagctgcagcccccatgagctacccaggggactgtacctggagggggctttggttataggcacattgggtcagatttgcatttgaagatcaccgtggccactgtgtggaagaagggtctagaagggggaactggttcagtcactcttgctgggatcctggtgggagcagtgtcaggggcatgaagagaaccagggtaggaggggcaggacttgccaatgggatggatgctaaaggagagggaggaggaggggcttgcatgagggcagagccactccagagttggaggtgctggtggaggagctggtctggaagggagacaaatgagttccattttgatgagccatgtttgaggttcatccagtaggaggtgaggagtgggcctttgggtggggctcagtagagaggtctggacagagcaatgggagtcaccatcgtgggagtcacccctatctgcttgcctacctctggctcttccccctaagctgttgctcttgagtcacctggaccagccccacctgggcaaagggtggtcctgcccaggaggctgccacggctcacctgtgtctgtctacctgtggggcgtgtgcacatgtgtgtagtagatgctcttgcatagctccagctgaagttaggttgaaggggctggaggtagagtaggcaagagcaagcagaagcaaggagggacttgccccagaaagatgaattttgctgcatggggttaggctcacctcatggatgctggcagatcctgggcactggctgaggggaggagggttgtcccagcctctaggctctgccccatgactggattgtttgacaaactcacttctctcagggatggtgttctgaccatcagcctgagggctgcctcattagaccagtatccctcggggtactagaactttggagtacaagctgaaattcaaggcacaccaaacccaatttaagctatttaggtgtgggtggtgttctaggaccttacagggtatggggcagcctaactctccccctttttggcccctgttcctg

SEQ ID NO: 36486 - DNA, 1050 bp, Homo sapiens
aggtgtggcccacttgagtgctcctgccatggactgccctctgctagcctcatctgtgctgggcatgggccgggctgtgactggtccgtccgtccgtccgtccgtccgtccgtccatccatccatccatccatccatccatccatccatccatcccctccctgccttttctgccttccctgcctgcaagctgtcccagagcacatggattacagaaggtaccaatggggcttccctgcagccagccctgtggggacccacggattgtggccaggatgacccttttattcttgacctgatggtccccatgtgtgacagtatccttgccttctctttggacatcacactctggaaggctctcggtgcaggcagctagggacagccttgcctttgtttataggttagttcccaatcatggtggtttagataaaaacaaaagagaatgatgccctttggccttgctgctggctgccaggtgtgtgtggcttgcagagcatttctacacctatggtggtattgaggactgctttgctgacggatattggagggtcatctggaacaatggccagggcttgtgtcacactgaccacaacagtctgaacaccaaggaggcaggatgtgagggcgggcaagggttgaggcctcagtgtcaaacagaccagcgccgactctagattgtaccgttttcttcttgtgtgaccttgagcaagttgcttaggcgcagtgcctttacctgtgaaatagcagtagtgatgacgatgatgacgatgacgaagacgacaggcactcacaatgtggagcacgtaagcccaaccaaggacctggattgtgcagggaaagcagcccctacatggtgcaagtggtggtcaggattctagtgtcgccctggtagcagtgggtcctctcagctctctccctccagcagcctgggaggccgatgatgctgaccccacaggacaggttcctccactaggcaggccctgcatctgcccagagcctcttctgcacgggagccacatggagatcgtgttaaagcctcggcgtccattgt

SEQ ID NO: 36487 - DNA, 1065 bp, Homo sapiens
tggaccacagctgggttcgagtctacaacattgctgctgtggtgcccagagactggggtaagggcaatggaagaagtggttgctgtgagccagtcaagacctgagctgggcctggtttggggagagcccaggtgtcttcagaatcattcttcatgacttctggtggaagaacacatttgagagagagcgagtgagtgagtaccatgaatcctagtggggcagggcagagcaggcactgcttttgagaagtgggctggctctcatcacaatcatggctagatgggctccctttccttgtagaatatgacatttgctttgcttaaagttagtaaaatgccattttattggtagtgtttttatttaggctgcttgactatcctgccaaggtgattttattattacaaaatgtggaaaactccattcaaagaagaaaataatacaaaacagattttggttcacatactaaaattcattggaaaattgagatctcaacccacaactattcatgacagtaaaacaaagacccctgacagctcccaaggtatccagcccctgagcccacaccagctccctgcactgcattgtcctgctgcccactgagtggcagaacctgagaactggcctgcctctgggaaggaactggaattggcctggactccctagccttgggctcttgggccaattcctccaaccccacccaagtcctagactgactctctggccagattccccctgaattttgtgggaagttgtgggaagagccctgttggaggccagttcttaacccacgggtcctggcttgcaaccattagggagcagaatcagccagagagcctgatacaaatctaaattcttacaccccaccccaaaggttcggactcagtacagaaagggcaaggccctggaatctgcattttagtaagctaactctggtgcttttgaagcagggcgccgtggaccacatcccagaggcactgctacgacaagaagcacagcatggtgtctaaagggcagggttattggagtttgaaatcctgtgtttgaatcttggcttgctgactatgt

SEQ ID NO: 36488 - DNA, 1050 bp, Homo sapiens
cggaggcgggctctccctggctcggaaggcctccccgcggagggcctggcttgctgtccgctcgcttttcgcttccagagtcggagagacgcgactttggggtcgatgtggagagagaaacagatgccctaggcgccccccattcagggattttcacaaactgcccagttcagctttgtcccttgcgtctccaaaggtgttttcaatctacatatatttggaaaacttcagttttcatatgatttatttaaaaataagcatacatattatgtttattaggaagtaaaaattttctttttaagtagatatgtcctagtaccacagagagacttgagtgtagaaaattgctaaaccagtgacaaaatgccagaacactgcaaagatggcaaccactgctttaggaaatatttgacataaatatttttcatgttttgtctccttaatatctcggtgatatttttatttgatttgatattttaaaaagaattgtaacttttagacttagaagggaacttagagtcttatgggctgcaaagtacataaatctgtttgacaacgtctccaacaaattatgttttgtcctttgcttggattatatttagtagaaagaggtgttgctccattcttttgttggaaaactgtgtgtttttacgtgttttggagcgcgaggcttcagccctcctgtccaggccatgcttcccctgcccttgcactggtgagtaggattccaggctccttaacacggaccgtctgcctggggcaacaatctgattgcttatcatgaaactttaggaaggagattaaataaaggacatttaataattatttccctttacttttgctgctcccaacaaatttgtccacccttttcagataattttgcatctatgttctgttatctgtggtattcacctattatttctattgttgtgatcactgaaaacttgaaactgttgaaagtcacttctgggtattcatttcaccaatctggaagaacctagtgatggtgcagaagagagctgcttccatggcctttagtgagttggctgt

SEQ ID NO: 36489 - DNA, 1078 bp, Homo sapiens
ctcagacattttgtatgaagaaaaaatactcatttatatgatagctcaaaggaatgaataaaattttgcaactgaattctactaaataattacattgccagtatttctgataaattatcttcaggaaattattcgagattaaaaattgtctgtctaggttgacagtagcgctgagtcagcagaagctgcctgtgatatactctctcagctggtaaattgttccatccagaccttgggcttgatttcaacagccaagccaagtttcatgaatgtgtcggaggtaaggatattatgcgtttttggtgagctatactaaaatccctaaagactgccaaactaggcaaaagccatttttttcctaaagacagaccatctcctatttgtattcaaagtattatttaaagctgttttctgttgactagcacttatttttgcaaaaatagtttatgcatgttttcattctttagatatattttgtaactgtagtcatggttaccacagtgtcattaatataaaatttggatattgtgcttattctacttaaataacaatttatgtagttactttgaacatagagcatgtagaggcaatagtgggtgtttttcctgtgattctgtggcctgtcttttggaggtggaacaatataatatttaactaaatgaactacgcttgttagcatgatgtttacattcatgcagtagaaactccaaaacaaaagtggtttaaaaacatgatcaaagtatatttctctcacattaaagaaattgataggtgagacagtccatagctggtatgaaggtggtaggaacctaggtttcttccagccactccactctctccagggtgtttcttcaagatgaccatctgagctctgaccatcacatccttgctctgggggctaggatgttagaaatgggggaagaagggtgtgccttctccttatcaaggagactacccgtaagtaccacacagtgtttctgtttacctctaagtctggccacaccagattccagggagtctggggaatctttgagctgggtggcagtgtgcccagctaaaaattgggactggattaaca

SEQ ID NO: 36490 - DNA, 1046 bp, Homo sapiens
ctcatgtttcatctgatgatgggttacattttttaaagctagaatgatatgatatttttattacaataactataaagatgcaatttccttttgaaaattatatacctatgaagcataaattatttaagttttttcaaaagatttcttaatctgcaaggtaggtatagttatagtaagtttctcctgagatattttaattttacatatatacatatgcttttcattatatacataatacctcctggcagccatgctctcagaagttgttattagatagctattttcacaaataatgaataattaatattaaatttaaatttacaaaatattatattaggatcagtatgattctttgttcttgagaatttttcccaacttcccacaggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctggtaatgggctgccaaagattc

SEQ ID NO: 36491 - DNA, 1026 bp, Homo sapiens
ccccacatcccccctgcccccaaaagttacccttaggttgtatgtatgcaagtgtctttcttccattgcaggagatcctgagcaccttggttcccaagcctcctgcatggtccgagattcttgttaaaaatgtgggcagtaaggcccttctgccaagcttagtgaatctgaattttgagggatggttctaaggaatttgttgatttaaaaaccccatgtccaattattttgtacaggtttgaattagaatacaatgggttgtgacccattatgggcatttattttcatgggatgatgtgctcaggagattttgttttggccaatagtgttgaggaaaatgtggggattggtttgcttgcctttttatttcagattgcagcagtcatagagatgttggagcacaaagtgaaagagttgtttctgtgaattcactttagaaatctagctgtgagctctgtgtgtgtgtgtgtgtgtgtgtgtgtgtgtctttctgtatgtttttctgtatgtatgtgtgtctcggggtgggtattgaagtcagtttgtgtgtgtgtttattatgaaagttggtcaggatgtagtacttccataaccttaggtaagaacaggacctttgggttattgattcaacatgaattcatttgaaatagaagctttgtgaagcttagcaacattttattcatatggttaatgtgtataaaacttaaccctgaatcttcctttagctttcttatctgcatttgccaaatcagttgatgtcaaaccccattcttccagttgtccaggctgataccttggaatcattgttaactcctttgttctcatacaccccatgatctccttcatcaggaagcttactgtctttcatatgtctgctgctcaccaccccactgctatcaccctggttgtaagccatcgtcatcttctcccctcccttagattactgcatctctgaactggtctcgctgcttttatcattgctgtccacccctcctcctgcttattctcaacataccagccaggatt

SEQ ID NO: 36492 - DNA, 1046 bp, Homo sapiens
agggttcataatatggctgaggtatagctgcactttaattttgaaacctgtttttcctctgactcttcaagaaatatgtttattttaaaaaatatagaattagatgaagcagaaagtgaaaagtacacctaaccccaccaccagagctaatatcacaaaccctttctttcattaaacaaatatttattgagcatatgtatcactaggcttacagtgatgagtgaaaacagatacagctcttctcgtggaatttacattcttgtggggacagatttgaaaggtaaatgtaaaaacataggtgtggtaagtgctacaaagtaggagtatgtgatgcggtaagcatataagagggggacttctagccaggacggtttgggaagacttccccgaagaagggatgcttgagctgaaagagaggtgaggtgtgtgtgtgttttgtaatgtgatagattcatttgtaattcatgatataccgtaattttataaggttttcatttatggctgaggtaccactgcatctcttttggtacactaatgacgttctgtgttcagtcagtggttgcagtttttcagaagaatcagggaacctcacgtacacaggaatttctaaatattatgattaccttggttttctttctagctttgaggtcatttctctaagaaatgacaaaatacatcaataaaagggtattatcaagtcaagtcttcataaaccaaaggtatactatgaaaggccaagataatagcagataatgggttcatagctgttaagtccctccagtttctagtgtaagaaggagcataccttcctgtctgttcaattattggctctctgtgcttggtgtacatttttttaaactcaattttaatgccctatttctgttggctatcatatggaaataaatataggataaaactaagtgataggctaaatggcatatgaaactctttatagcccctgttcttttttccattactctctaagatcttacagagattatggttagtgtcttttaagcctgagttcctagcatggagtattcctg

SEQ ID NO: 36493 - DNA, 1065 bp, Homo sapiens
ttatctagcttagtgccttgccttttataggcactcagtaaatatgtgttgtataaataaggctataagtgtgagcttaagtttagcactggttattatgtatatttgtgtctcagtagactctgaaagcatttagaaaaggagtatagaggaccaaaatttagctgtccagtaatctgtaatgtgtaaagactgttgcagttgctaagtacagtcttttgggattttctctattactggaataagtgtagaggtgatgtagaagagtattatggggtgttagatacacagctgatttaaattgaagataggtgttctcagtgtttctaaattcgttttatttagtgaaaggcaaagggggcatgaaaaattgaatcaacttttcaggaaagagactcaaaatgttcagaggtattgcaggttcacttgtggctcatgcaaatcagaacgtattttattttttgtatacataatgagaaattttttcataaccgagtacttatgtgaggatactaaagtaaatctattgctgtaacccaagctctctgatcattttatttcaaattttggaccaaggtgttattttgaatatagtatagtctgcagaaaagactaggacaaaatgcatccattatatgggtaccataaagaagttttaatctcagtttaacaattttacttttactataggtggtttagttcctttagaaacctagctgttaaatattaagagaatagatgagtaaaatatgattgcaccattaaaggcatttaaaaaaatctatatattcgggtgagggaagagcaaatgcttgtggtgttaaatagaaaatgcagaataccaagtaatatcatgttatatcctgttacgggcagttgtgggcaagactatatatatgcagaggaaacaaatataagcataccatatgttaatggtatgattataggtgagtatacttaggaaaaatattttttaaggaaaaatattttttaaaaagtggtacattgtctcatcatttctgagatcattgtgttccagtaataagtgtgctaaaaatgtcctaa

SEQ ID NO: 36494 - DNA, 1448 bp, Homo sapiens
agctggatttcttttaagacttctattcagatcaggacacaatcacgttcaaaattgacatagcatgtaacatggatttcagtgaagaaaagtacttcagaatcaaattttagaagagtgttttagggtttagtggcctaatcaaagggagtccagaagctatttttggataatacataggaggtagagcaacctggttttgcctctggttatcatttgacattgccagtgtcttacttgttcatattatggggaaggaatcgagtggtcacagaacttttggagaaaatttatcaattttttgtttactttgtaatgcttttctgttcttatttaataaaatatgcctttcgattatattaatttaaatttgtatatattgaattgatttaaactaggatcctttccccctttctctttcaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccaggtaggtcttattcctgagaagaatttggaaaaacaaaaacaaaaaacctctcttcctgatatgcatgtaactagatttagtaatgaaaaggttgtattagctttgtgtttccatcttaaatattctaatcttggaagggctattggattttgagtttagctttttatatgtaggtgatacaattctcaggtggcttactctaattcattattcactgtaagcacccatatatctactctgccttttcctgtggatgacctgtctctgttttatttaaagcctaagctccaagtgtgtactatatcccattcctttttgtcaaatgaagaactttgttcctacagttatcatccttctctccagcattatattttccctttctaccagagtatttctgatagcatacaagcatgccatgatactacccatcctaaaataaaacttaaaaaaaaa

SEQ ID NO: 36495 - DNA, 1024 bp, Homo sapiens
gcagctgcctcttgttctgcgaggggaatagcagttgttaacacacagtagaacaaaacgattgtagtcagatgttaaccacatatttagtatactaatgcagtagaatgaaatgaaacaatagacaaaaatagcacaaatactgacttaacagaaacactggattgttgtgtacatccctacttcagggaggtgaagtgtgacttaggtagcttaaaaacaaactcattttgttgatgctgaatgatatcagaattaagttgagatttttctaagtgaaactacattgacagatacaggacaattgttaatgagatgagttgtaaatgtttgaagaatcaggtttgtttcagtttcctgcatggaaaggtaatcagatatttgaatgtgattggtcacttgggtctttagagaaagcgaatatttgaataaagtttatctcttaaaaatgtatctgttaaaaatgtttagactttgttgtgtatattttcattatggtcatatttagaagactgattttgattggaaggcttttacctagagaatattaccatattcaatatggaaaaccgtactgaacaacgtaaaacatgagatctttcaaactaagaaagatcaaagtgttcataattggaaatgtggaagtttttagggcattcacataacagattccaacttcactctgtagtcttaactccttgttcagtgcgtaggccaactgattttctcatctcctctgccaccctccccttctacctcttcccagccctagtactcccatgtgaaatcctcctgtatctttaaggttcagtcaggtatgtttttttcttacagtattttgtttgattctctgctagctgggagcgctcacctctgtttaactcctattgtgttaaattctctgttttatggttgttttttaatatcctttatctcatagaacaggagtggtatctttctctggattttctgtcttccagggtaccttatgcaggctaaatgcttacagagttttggattcagt

SEQ ID NO: 36496 - DNA, 1032 bp, Homo sapiens
taattgtttgatttccagaagagtttagattttattttgccaattaccgtatgtttaaaaaatggaagtagccctatttgacttaaatattttcttctattttatgacactcagtaccatttattgtcttttatataactgatactgtgatgaaagctatggcattcaatttaatcttcagaatgactatgtgagatagatattcctgttttacagatggaaaaagaaattctaaagtaaattttaaacttttaagtaccttacctagggtagggctaagaactagaggttcagacccaggtttgtctaactctaaagtctgtgatctttcacctttactgtgtggcttttcaaattatttaagactttagaagttaaaatgaatcctggttatctttagttagataactgatgaactgatttcactggagaaagataagtagattttgtaaagttctaaattttgttaatggcatgtcatatatggacatgtcagtatgtcactgtcaagaaatatttgaacacctgctgttgtcaggcagagtcatatataagtacagtaagtcctcacttgatgtcattgataacgtcttggaaactgactttaactgaaacagcatattacaaagccagttttatcataggctagttgatataaacaagagttaagttcttgtggtatatttctggtcacaaaaatatcactaaatttataaataaagacccaagactcttctaatattaaacattgaaataaatgtgagctgtgcatatctttaagaaagatcaataaaaacaagactgttatttacttaattattctaattcatggtcatgggtagccagagcacattccagcaactcagggcacaaggtggaaaccaatcctgaatgggacgtgattaaatcacagagtgcactcacacacaccccggcactcacactgggactgtttagacatgcatgccagttcatctgatgtgcacatctttgggatgtgagaggaaactcgggtaaccagagaaaactcaa

SEQ ID NO: 36497 - DNA, 1037 bp, Homo sapiens
gctacaatttaagatgagatttgggtgaggacacagccaaatcatatcagcatttaatattaaaattgctatttgagtctcttaacttcaacagttttgattattattactagatttcattagggtgacttggcagaattctttagaatactaaaattatttcattcctagctaagtactgttattaaaagtaatggcagaagccacaattacttttccaccaaccttaatattaaggatttgcaaagttcaaaggaacttttcaagtttttcatctactctcttcacctgactgtattgacattccaaagatttgtgcttaaaatctgaaaagaattttagtcatgtatttaagcaatctgtactgtatctacatatttaagcaatctgtactgtatctacatggttcttaagaatttagcacaagaagagcacctgtcacacgctgtgcatgggtttttttctttttggtattcagccccagtccagtgttttcatgatactttgctgtagatctattgtatacatcagtttactggttaccctgaaggtatttctgccttcttgtacagtaatgtgacttttgcatatttattttaatctccactccccaatgttcttcactcccctgaccgccctccctccccaacccagttttcctgggccaagactaccataagcagtaaaccagagaacctgataaatccaggaaaataaaagtgaaaaatttctatttcaatttttatctgcagttttaggctaaagatttcagctcagttcatcccagtaatttccaaccttaaaggataatcactatgtgactgccacattaaattatacatgcatgtattgatcaatatctacaatgccttatctgatattcaaacaacttgaaaataaaaaatttttcgttaaaaaaaaaaacctgggccgggtgaggtggctcacacctgtaatcccagcactttgggaggccaaggcaggtggatcacctgagatcaggagttcgagaccagcctagccaacatggtgaaacc

SEQ ID NO: 36498 - DNA, 1052 bp, Homo sapiens
aatatcaccggcaggatgtaaccagcaccccatgttggattgagattatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttat

SEQ ID NO: 36499 - DNA, 1692 bp, Homo sapiens
tggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgcttaatgtgtctttttttgttttggctctggagttggcctgcctgcgtttgagtcatgggcctcatagcttagacaagttgcttaaccactctatgcctcactttcctgacctgtaaaggaaaagt

SEQ ID NO: 36500 - DNA, 1028 bp, Homo sapiens
aacattttaaatattactgatttttgtcattgagtttgtaagtctatcataagctttgcaaaaacaaaacttgttctttctatctaaatcagtttttctgtttaaaaaaagggtaatggggctatagggaaaattcaaagaagagctatgggcagcttgcttaaccatctccatgttaacgtatgttggatgggaggtgggaagagggatttagactggtggtgaagacttatccatattatatcaaatgggtgtgtgtataattcctagtgagagattttctgaggcagtttattgatgtttagagatggattttgaaaagatccttatactttgtcttaatcagttaccccttcccatctaataaacctccttcattatttcattttaaataatactttcatttgagataaatgctgagaattttaacagaaaagttaaaactgaaacccccaaaccagtagcaaaggtttatgagtgtgcccttctaacctgttctggtagtcactgtacattgatccttggctttctttgacagatactttgctgattatagatggagctctagctctttttgaaagggttctcagagaaattggtttggttctaaagtgtttcttgagttctttgtacctaagaaagcctttcattctgcatagcgtttatcaccatccaacatatatatttctttaccctgtttattgactgtcttacctcatgggaatgtaagatctgtgaggacagacctgtgttgccactgctagaacagttcttgatatgttataagtaagcataccaatatttgttgaatgaatgagagtactgaagcaagaagtgaattttttaagtattagaatttaccttttaaataatgtaatatttacttcttagttgaattgcttctagctcaatgttttattagctctctttatgcctgagaagtggtttgatgtggggtggggtattgtgggagctggctaaagtataattgagaagaaggggaaattcagctaagaaagcactcatat

SEQ ID NO: 36501 - DNA, 1044 bp, Homo sapiens
gggaaggagatatagtccccaagatcagcgagtaagtttatccatttagaaatttgggcttcttggccataaatgatagttgggaaagcatggaggaggtcctcaggggaactatgtgttctccttctttgggtacagagattcttagtgggccgtcccctctccagaattatacaaagggccagaaggctcataacatgtgaggcccttatgtcagatcctgtgcatcattctaggctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtgagcttttgactataattcctgggctctgcaatttgctaagagacttcctggacaccactggggatggtgctaggatacccaaagggctggtgttctgctcacagctctattatctctgattctctgccaggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccaggtgagaagctagaggtgtgatgggtgtgcgcacttggaactggtaactctaagaaagctcctagggactacttatggagtcaagtaagatattttttttccctctagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggtgagaatacaagaaagctttagtgtagcagcttagtagctacacatttttccatggtgccttccaggtgggcttgtgccttctgagggcatg

SEQ ID NO: 36502 - DNA, 1651 bp, Homo sapiens
ttgcatcagatgaggctaaaaacttagttgaacagtcatggagttgttgtttacgacgtctgtagagttgaaatgtattggaattaccctgaccatttctttatcttcccatttgataagaaaacaaacactgtatctattggaaaacaataatatatcagatgtttaggctgtgggaggacataaaatcctatgtactcaggtctaaagcagaaagtcttgcctacaaccactgttcttccttgttctcttattactatttctgtagtttaggagaagggtacctcttttcacttctgactggaagataaaatactgggctgatcttgatggaaataatcatttgggcatccctctctctcacttgagcagctgttttctaagtggtgctggtattccagttagaaacaacagagcatgaaccagtttaagggtagcaaataagtttcaacttgattgccaactctattttatttcatatctggactgccaagttcataatttctgaagctgtgtttaggcttagctggaaagagctgtgatcaattgatgtctgccagaggcctggcttaggggtgctgtggtatgtgtgccatgcattttccatctctggaccaggtgcatctctaatatcacttggggctggtccctctaattggcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctggtaaaagaccagtcttcctgcttctccacgaccccctcccccttttttctgaggctgattgttgctattactttactcttgtcctgtgctgtatgaatcatggtacttaacctggaagagcccactaatggctcaaaacccagcccaaaaggaagggggcagggatttttccaccgatagagaagggacagcaaaacttgggtggagaagggtttgagatgttggaagatgtggattgtttgacttactaactttgggaagacaagaggaagaacacttaatgtccctaacatccctgtagctcatgaatcgcagaggagaactgaagagggcttcctagaaatctgtcagtgtgtcctgaatccaaatcatgatggatattctctctttcttagcctttgcctgatcatgcagacatctccaactgtgggaactctttccagcttgtgtctggtaaggcatcgtgtgtgtttgtgtacgtgtgtgtacccattcctctctccacacatttctatcattggtttccagtgaccagggctagcgagcctacctctagaaccttcttgccagggtcaacttctgagattgacagttgtctttcatgttctagcatgaaagttatctggttggtttgctcttattctagctttgtggggacttgtataatctaattttttgaataggtaatacattcacatggttcaaaatttaaaaaataacaacaaaaaggttatgctgagaaaagtctctcttactctc

SEQ ID NO: 36503 - DNA, 1063 bp, Homo sapiens
gaactgctgacctcaggtgatccacccaccttggcctcccaaaatgctgagattacagatgtgaaccaccgcacccagccctagagtgattcttttaatgattattggttctgaaggttttttgtttcatactatacagaataggacagttttagagatacaggattcagaattaacatcgctaaaagacacagttggacatgaattcacttctttcattcattcacttaaatatttgaatgcttaccatattctagacctgttgtagcagtaaatgagacagtagagatctctgctctcatggagctttcattctagtaggtgagttgaatcaataaagagataattacattgattaggaaattatataattatgtctttatggacaaggcattaaatatctttttcccctcctactgtagagtggtgagatcaagtcggtagatcccagactaatccatgtgatgctgatggataattcagcgcctcaaagcgaggtacagtaatggactgcattcctgagcagactcatgagcttgcattatcttgctgtgtgtagatcccttatatatgtgttttccatggatgccttttgagttgttcagctttagccactgtacatttttttgctctctccacagtctgtctaattaaggggggatattctcaagaaagagacctagtttgagcaaacccttttaagcatgactatgttccctagttcttctaaagtgcaaggctggtttcttcctatattctgtcaggacaggtatatttgaaagatatagtagtcagttaaaagtgcaataagcagtagtaatactcgtgatctaccaagtaacaagaagtgaaggataaactacgtccactttttttttttttccattcggtggcagtgagctccaacggagtctgaaattctgtattcccaagtagaatcaattcaagctggtacctagttcagtgctcagcccccagtgcattggttactccataattgttatgaaccagcccaactcttggtttattcagaattaatatagccccaaaaaagatacattaa

SEQ ID NO: 36504 - DNA, 1032 bp, Homo sapiens
gcgcagtgctgagctgttgctgggcaaaagcaaagggaagcaggcccccaagggccggcctcggactgcccccctgaaaggtgatcctgctggggctatatttgggctttgctctggcactgggctcaaatgcctgtcgtgttcttgtgcagcagaggcactcactttgatggagagttctgtaatctcatagaattacagagccaagaggacctggcagaggcccctcgtcaggcctggttcagggcaggattgcatctaaaccggcactgtaggaggagtatctgtcccaaataatgataatcccccaaaggaggactcttgatcttccttggcggtcagttatttttggtcaggaactatttctttgcatttgtctcatccctttttacttcactttggcccatcctctttacttcagaggggttactgggaactggtatccattcccacatagcagacatttgtagacttgatgaagcagagagaatcacccctcagtttgctcctctctgaaacctacataaggattttaacagctctatcaaaatccattaacttgtgtggtgtgaggttatggtccagaagcgggtaaaacaaagtctcatggtaaaagcagctgttctcaataggaattgctatgttgtgggagctcaagaggtcctgatgaacagaatagccatatcgtgagagactagaggcaggtgatggctacattctggcttcttatgtttttcacatccatattcaaagttgttttgccatagtggggcacttcccacaagttctgcatggttcttagctcccaatggaagcttctttgctccttgctttcccttcctgtcaaggatggacataatgggtacatgcccaagcagggaaaggagtagcaacccaggtcagaacaaatgtctgtccccaaaagaatcatgctattggttcctgtttacacctcatgacaaacttttcttctctcccccttgccacagttggccagtcagtgctgaaagatgtaagcaaagtgaagaagct

SEQ ID NO: 36505 - DNA, 1114 bp, Homo sapiens
tctagatatgtcttttggcctaaaaacaggaagaatgagattgccatttactgataaagagattctttagggaaaagcaggtttggggaggaaaagggggagttttaacttggccgtgttaaatttgagatgcttgttagattttcaaaggaaaatactgagaaggcagctggggatacagctctagagttaagggaaggggtcctacctggagatataaatttggatatcaccaggtatttaaagctgtcagtctaagtgagatcagagcatagataaagaagaatagcagtccagggaccaaactctggtactctccaatgtttagaggtgagaaagatggaagcaactagtaaaggagactgagaaagaacagctagtgaagtagcaggaaaactaggcagtgaggtatcccagaagacaactaaagaaagtatttccaggaaggaataatgaactgtgtcaaatgttgctgacttgaatgggggcggtagctcacgcttgtaatcccaggatcttgggaggctaaggttgaaggatcacttgaggccagcagtttgagaccaccctgaacgatgtagtgagaccctgtctctacaaaaaataatagtaataataataatttttttttttgagacggagtcttgccctgttgcccaggctggagtgcaatggcgtggtcttggctcactgcaacctccatctcctgggttcaagcgattctcctgcctcagtctcctgagtagctgggattataggtgcgcgccaccatgctcggctaattttttgtatttttggtagagacagggtttcaccacattggccaggctggtcttgaactcctaacctgaggtgatccgcttgcctcagcctcccaaagtgcagggcttatgggtgtgagccactgcaccctgcacaaatcaatttttaataaaaaagtaaaaatgttgctgacaggtcatgttacatatggactagaagtgactgatttagcaaggtagaattaccttatcaaaatagttttgctagattggtaggggaattgcctgattgtagggaagaaaataaaagggaaaggaacctatggcaatgagtatagacaactcttcttttt

SEQ ID NO: 36506 - DNA, 1042 bp, Homo sapiens
tgagccactgcgcccggccaagtatagacaactctttagaggaactttgctcaagcagataaatggagggagggtatggcttgagaggatttttgtggtagaaattggagcaaatttatgtgctggcagcagtgatctgatacagaagaaaatagatgatgttgaaaagagaggagagatttagtggagaaatgcctttgggttggggaaaagtgataggatgtagtaggagatactggcctttgctggttcagagcagcgggaactcatggaatacgtgggccaagttgcagggaagtgtggtagtgtcgtggtgggagcttgtggaggttgttttctggctcctcttttctcagtggaatagaaaacaaggtcctcacaggggaagtaatattggaggtatgaatagaaggaaggtatgaaaataggcatctagaagagggaatgtaccaagaaactgtattgtgactgtcaggcaatattaaggactcacttgatgtaggtagacatgaatttaaagtgttaaaaggccaggcacagtggcttatgcctataatccctacactttggaaggccgaggtgggcggatcgcttaagcccaggtgtttgaaattggcctgggcaacatggcaagaccctgtctctacaaacagttttaaaaaatgaaaaattaggccaggcgcagtggctcacgcctgtaatcccagcactttgggaggccgaggcaggtggatcacaaggtcgggagatcgagaccatcctggcttaacatggtaaaaccccgtctctactaaaaatacaaaaacaaaatcagctgggcgtggtggcaggcgcctgtagttccagctactggggaggctgaggcgggagaatggcatgaaccccggaggaggcgtttgcagtgagccaagatcgcaccactgcactccatcctgggtggcagagcgagactctgtctcaaaaaaaaactaaaaaataaaaaattatttggatgtggtggcatgtccctgtagtcccagctacttgagaagctgaggtggca

SEQ ID NO: 36507 - DNA, 1068 bp, Homo sapiens
tcaaaaaaaaaaaaaaaaccaaaacatacactattgtgtctagtctagtgcatagctaagtaacttgctaaacagtttgattcttccaaggcttgctttacactttgttatgccttctgtgactagcccttttcacttagtgtaatgttttaaagtttcatctgtgttttagcacatgtgaaccattcattcctttgcattgccaaataatactccttttttggatatacttcattttgtttattcaccagttgatggacttttgggttgcctccgcatttggctattatgaatagtgctactgtgaacatttgtgtacagtttttttgtgtgaacgtatggttgcatttctcttgagtatatatatacatgtaggagtggaattggctagggcatatgacaattctacttttaaccttttgaggaactgccagactatattctaaagtagctgcactatgttacaatcccaccagtaatgtatgagggaattttccacattcttgccaacacttgtcctttgtcttttttgttatagccatcacagtggctgtgacgtagtatctgattgtgtcgttttgatttgctttcccctggtgactaacgatgttgagtatctttccatgtgcttttttttaacttttcttttttctttcttttttttttgttgttgtttttaagaaagggtctcgctttgtcactcaggctggagtgcagtggcatcatcatggctcattgcagcctcaaccgcctgggcccaagcagttctcccacctaagcctcctgcatagctgggactgcaggcatgtgctaccgtgcccagctaattttttttggtagagatggagtctcgctacattgcccagtctggttgctaattcccaggctcaagtgatcctcctgccttggcctcccaaactgctggaattataggtgtgaatcactgtgcccagccatttgtttattttcttaggaaaaatgtctattcaaattatttgctgcctttggttcttcctttatcttattacgtgccagaaaccctccttgccccttgactttttcattctt

SEQ ID NO: 36508 - DNA, 1034 bp, Homo sapiens
atcactttacccgggaagcagagggtgcggtgagccaagatcataccactacattccagcctgggctacagagcaagattccacctcaaaaataaataaataataaataaataaaagcaaggagattactaaaaacacactttgcatcctcttgtttctaagctgtatagttctgtgttcttaaaaaggcagttgaaatttctgttaggtggtgatctggcattgatatctttagagaaaaatccttaagtgtgattttaagatggggcagagaaggggttggaggtaggtagtacttttctaggcaaatgttttaaggccacacaagttttttgatagtgtgataacactccctagtttaaaaactttagcaggtgcttgaggaaggggagctcatggcattgtcattttcaatatgaggaagtgttctcaaagttggacttgtcagatttttgtcctttcaccttaaaacaatggtaggtattagggcaacagaagtgatttccccagggtgagaatgaagcataacaatggagtagaagcatttcctttcactttagttgacatgtggaaatccatggattatacaactaggaaagaacagtagagcttcctggagaagaggaggccctcctcaggaaaccctcctattctgtctcagccctagagctggaagtttttcctagattgctctgattgggatatttttgtttccacagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcagtaagtagctttcatatctagttcagtgatagcagactggaaaataagcatctatacgcccagctctgcccttgaataataaattatattctggggcataatgggacttgaaaaaataaatgaataaaaaattaaaaacagac

SEQ ID NO: 36509 - DNA, 1051 bp, Homo sapiens
accctgtacccagcctattcttcctacaaggccgtgaagacaaaaaacgtgaaggaatatgtgagtggatgacccttcaccccctacccaacccacatggcacagagaggggagggcactgggtcctattacagatgggggtgactttgcaccaacactgtcagccactaacaagacccaccagcaaaggagggccctgggtgtcccacacagcgcctccaacatggctggcaggcagaagtggggtccttggtgttctccccagcccaggcatgttcaacaggcagagctggggtcctgggtgtccctggcccctcagccccgtgccccagccagcgcttccctctgtccctcaggtgaaatggatgatgtactggatcgtctttgccttcttcaccacggccgagacgctcacggatatagtgctctcctggtgaggtccagcgtcccctcctgtatctcagggcccagggcctctgcctttctctacccagccagccaaacaaaagactgggcctgggggtgaagctcctcccattcctgacaatttcatggggtccttgatatctcccctctcatgcctaacttgacctgcagaagaacagacatagtagtgccaggcgagggggctcacacctgtaatcccagcactttgggaggtctaagtgggtggatcatttgaggtcaggagtttgagaccagcctggccaacatggtgaaaccccgtctccactaaaaatacaaaaaaaaaatagctgggcatggtggcgcccctgtaatcccagctactagggaggctgaggcaagagaattgcttgaacccaggaggtagaggttgcagtgagccgagatcgcgccattgcactccagcctgggcaacagagtgagactccgtctcaaaaaaaaaacaaacaaacaaggagtaagaacaaacataatccccatgtttctttctggcggcagccagagcccctcagtggaattcaggaaacccgcttctgccatgctgcctgcgaccttaggcaggtcacagctctcgaggcctcagttt

SEQ ID NO: 36510 - DNA, 1057 bp, Homo sapiens
actttggaaatcctggagggcttttaaagttatctttaggagacagtagaggcagtgggcaagggccaaccaaaaatgctaaaagttattttccaacacaccatataacaatccttcataatcctacaatgttcccattgagtgttcatgtggttggaaacctgagcctagaatttttcacgaatcccaagaatcttttacatgggtgttaacaagcactgaatcttccaaaaatgttgtctaaatcacttccttcatacttgcaaattaaattgatttcttatactgatttttggaaatacagtaatctcatttctacatattacaaaacattataaaaggagccattgtgtctgatattctaagcccatcttgataacagactcttttgaacatggcatatgacattcatccatgaaacataagggaaatgtgctggaagacttttgggaaatcttaacattgaataaagatgtagttgcctttctgctcaggttgtcagcacatgataattattagaactacatcagagaatttgggacaagccagtacactgaggacagaaaagcagaaatagggaaagaaatctgggttccttttatttttgagccatagaaatagtatcttaggacttatttctagatgcagtttctttaatgtaagccaattctggttatttctacttggagctgaaagcaacctgaaaatagccaccttggttttcatgttagagatctaaaaactttcatgttagagatctagaaactttcatgttagagatctagaaactttcaagattctaaatgtaccaaaggtctaaggggagaaaataaaatccttcaaacaagatttgcacatgctgatactgctcattatttcattataacagcccttccaaatcttgaatttgcatttttaaccagtgttagcaaatcctgtatttccctctttgggaaatatgggaagcatgagccatggcatattcttgaagctaaatctcagggcatcacccctcacaaacaagagatcaagatgctttctgtatttatttaaaaaa

SEQ ID NO: 36511 - DNA, 1030 bp, Homo sapiens
ttaacctctttctggaacatcttggtgacatatagtagagacatctaacttgtctctaatcattttttaatttgtaaaatcaaactaaaaacctaatgatcatatttgagaaattaaaatatgtgttaaataattctctgtacacattaagaaagctgaattattttggaaattaaatatagcatcattgctgtatatcttaaatatggggaattgtatgttaatgttcagtggaatctcatgtgattttttaaaagaataacttaatcttgctgtctttaaagatattagtttgtcattttaattgactccagtttaatgttaaaaatgaaacttttaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtaggtcattactgctttttaggtaaagagaggcaggcctttctagaaaatcagtgtttgaagattttttttgtggtcagtattctcattcttatgcttgccaattgctcagtaacttacttagttattggagatgtattaagttggactggctcatattttaattctcattcttatgcttgccagttgctcagtaacttagttattggagatgtattaagttggactggctcattttaatcatgagagatgcttgcagagggacatctggagaatctgaatccacttctcttgggtatttcaagtaatagttaagtcttagaaatgttgtaacacaaattgataggaaagaaatgggaccgaagtttacttttcatcctgtgtaatacttctttttagttcatgctgaagagatgggtgtgataaaatggaaaaatatctacctactctgaaaatactctagaaattgtcctattgtgtcagaatagtatgtt

SEQ ID NO: 36512 - DNA, 1073 bp, Homo sapiens
tctgggtataaaggaatcatgttttgggaaattcagaattgataaaaagtaaaatggtaatccacagtttactaataattaatgctagaaaaattgtccttattatgttacaaatgtggaaggaagactttaaatacggaagataaacttcttgaaacctgcagtttttatttttagtagagatggggtttcactagttgcccaggctggtctcaaactcccaagctcaaacaatccgcctgcctcggcctgccagagtgctgggattgcaggcatgagccacagtgcccggccttgaaacctgtagttgtgtgttaggtttcttttccagtcggagaatttcaacaatgatgtaggttttttaggttattggatatcagctaaggtaaatcgagccctgctatttacaggtgctttactaacccttgggagaacttcatagatctttcgtgcctgatggtagattgcatagtccagagtcttatgtcaaattcatccctgtggcagtacccataaatgggcagtgccttagatggagataacatctccaattgttttctgaatttgtgaacaaataaccttcaatggtaaatattttttcagttttcaggctgaagataaatatttctaatactgaaaatgatgaaattattagaattccacagtactaattaggcaggtatattagtttcctagggcttctataacataaattattacaagcttggtggcttagaataatagaaatttattctctcatcattctgaaggccagaaatctgaaatcaaggtgttggcaggcttgattccttgttgggacttaggaagaatctgtggatgcctctttcctagcttctggtggttgccagcaattcttagcattccttggcttgcagacatgttactccagtctctgcctttgttatcatatacttttctttttttgtgtctctgtgtccaagtttccctcttcttataaggacatcaaccattgaattagggcccaccttaatccagtataacctcatcgtaacttgatatcatctgcaaagaccctgtttccaaataaagtt

SEQ ID NO: 36513 - DNA, 1023 bp, Homo sapiens
agtcttgctctgtcgcccagtctggagtgcagtggtgccatctcggctcactgcaacctctgcctcctgggttcaatcgattctcgtgtctcagcctctccagtagctgggattacaagtgctcgccaccacacccagctaaatttagtatttttagtagagacggggttttgccatgttggccaggctggttttgaactcctgataaatgaattcagcagaccactgtaaaaaaagaaaatccatgaagctgtagctgctacagcagcaagcatgaaaacccctgcactttttatgaaaataattttatcttgtcaacacaagataaaatgcagcttctgtgtgggtgcagggctgctataagaaaggcatacctatagactagtaagattcgagaaaaagcaaagtcattatatgacaatttaaagcaaaagggaggtgaaagatctagagttgaagaatttaatgccagcaagggatggtttgatactttaagagagatgtggctttaaaaatgtcaagataacaggggaagcagcttctgctgaccaagagaagggttcccaaatgccattaaaaagtgcagcagaaggccaggtgcagtggctcacacctgtaatcccagcactttgggaggccaaggcaggcagatcacctgaggtcaggagttcgagaccagcctgaccaacatggagaaaccctgtctctattgaaaaaaaaagaatagaaaaattagccaggcatggtggcgcatgcctgtaatccgagctattcgggaggctgaggcaggagaatcacttgaacctgggagacggaggttgcagtgagctgagatcgcgccactgcattccagcctgggcaacaagagcaaaactccgtctaaaaaaaaaaagtgcaacagaagggtgggcacggtggctcatgcctgcaaccacagctgcagacttcaattcacagtatgtatcaggcagttcggctttttcttacaatgtcatgacttttctttacctcttggtagtactt

SEQ ID NO: 36514 - DNA, 1037 bp, Homo sapiens
aacttaattcttttgcatattgcacttgtcctagcaccatttgtggacaagaccattcttcattgaatattctcggcactcttgttaaaatcagaatatatttctggattctcaaagttgattgatctctatgtttacatttgttttggttgaccagttttctcttacaagtctggccttcttgtttttgacagtcttggttctcttcattgtttcttttattgcagaatcttcctctccttactctgctgtccacagtctcgagggtcctaacttttttttttttctaaatctttcccaactcatgtgttttcatacatctctggctttcttctcccgctcagaaaggccctagcttgcaacctttaaataatgtactgtgcttaatcaaaggtgatcagatcttttgacccctgcctttgtaatttactactactctcttctgggctctcactgtagctttctgatccatctctctggttaggtttattgtatgtactttagataggttaatcctctttactttgacttcactctggttgagggaattgaattctgtttgtctctggcctttctactcccatcttctgcttcttctaagcatatcccttactcctcagttagactagataattcagactagatattatgcctctaagcctaattaatatatgaattatatattaatatataatatacaagccttattgtatacctcagcatgataagtggttctacaaagagcataaatactggcattacaaatcctgactctgccatttactagttaggtggcagggatttagttagttaatctgtataagctttagttgcattatttgtaagccaaggctaataccacttactctctaggtgggtgacagaattttaaaaatatgtgtagtgccatagagtagatgttggacttttttttttttttttttttgagacagactctcgctttgttgcccaggctggagtgcagtggcgcaatctcggctcactgtaacctccgcctcctgggttcaagtgatttt

SEQ ID NO: 36515 - DNA, 1027 bp, Homo sapiens
aaagtgatccacctgccttggcctcccagagtgcctggattacaggtgtgacccaccgtgcccggctacatttgcccattttaaaatcagattatttgagtttttgctgttgagttgtttgagttgtttgtatattctagatattaatcccttatcagatgaatagtttgcacatattttctcctgttcttcaggttggctcttcactctgttgattatttcctttgttgtgcagaagatttttagtttatataattccgtttgtctgtttgaatataacattccattttttcctggcctgtagcgtttctgcatagaaatctgcgttattctaatgggaattcccttttatgtgacttgatgcttttcacttgctgtctttagaattttatctttgtcttttgacttttgacaatttgactataatgtgccttgggtgtataactacccactaattataactacttttttgattcaatctctttggggactttttgggctttttggatctgtatgtccatatctctccccagacttgggaagtttccagctattatttaattaaataggttttctatgccttttcttttctccttctggaattcccatgatgggaatattggttgatttaatgctatcctataagttttgcaggctttcttcactctttttcattgttttttgtttgtttgtttttcctctgggtaatttcaagctacctatcttcaagttctgagattttctttttcttggtgaaatcttttgaaactttctattgtattttttattgaattcttcgttgttttcaccattaaattctttagctgcatgatttctgttggttcttcttcatgcattctttttgttgaatttctcatttacatcctgattttggtgaattttctatttgtattttattgtatctctttgaggttccttaagataattattttattttatctttttgagacagactttcgctgtcatctgttgcccaggctggagtgcagtggcatgatcttggctc

SEQ ID NO: 36516 - DNA, 1420 bp, Homo sapiens
cattttgccaagggtggtctcaaactcctggactgaaagcagtctgcctgccccagcctcccaaagtgctgggattacaggtgtgagccaccatgcctggccaagtagtttctaaagagaccgcatggccccagagcctaaagtatttgctatttggtcctttatagaaacttgccaatttttaatctgtttcaatcagctccccagtagctgggactgcaggtgtgcactgccatgtctggctaagttttgtatttttagtagagatagggtttcaccatgttggccaggctggtctcaaagtcctgatgtcaaatgctatacccacctcagcctcccaaagttctgggattacaggcgtgagccatggcacccagcccaaccaattaatttttctgaaggttttaaattataaattcagtttcttcagtagatataaaactaagttatgtattgtttcttgggtaaattttggaagattgtggctttcaatgaattagttcattttatccacttagttgattttgtacgcatggagatgtttgttgtaatctcttactatccttctactgtttagcatctgtagcagtattctctgtttcataactattcttgataatttgttttattttttctttctttgtcaatctggccagaagtttatcaattctagtgatcttttgaaaaatccagctttgggtttcattaatttttttttcctctaatacttccaatttcatctgtttctgctttttatttatttatttttctgtctgcttattttgggtttattttattctatctttactagtttcctgaggtgagaacttaggttattgacttgagacctttcttctttgtgtaaagatatagtggtatagatttccctaatctaagccctgctttgtctgcatccgataaattctgatacgttgtattttcattttaaaattatttttatttttttgttgttgtttgtttgtttgtttttaagagatcgggtctcatcgtgttacccaggctggtcttgaactcttgagttcaaatgatcctcccacctcggcctcccaaagtgctgggattacaggcgtgagctaccgtgcccggcctatattttcatttttgttcagttcaagatattttaaaattttcctcgagtcttcttctttgatcactggcttatttagaagtatgttgtgtaatttccaagtatttggagattttcttgctatgtttctgttactgatttctagtttaattctaattccatatggtcagagaacataaactttgcatgatttcaattttttttaaatttgttaattgagccttgttttatgacccagtgctacctttgtaatgttctgtttgcacttgacaaataatatgtattctgctttttattttttttttctttttt

SEQ ID NO: 36517 - DNA, 1050 bp, Homo sapiens
tttttctttttttttaagatggagtctcactctgtcacccagactggagtgcagtggcatgatctcagctcactgcaacctccacctccgggttcaagcaatcctcctgcctcagcctcccgagtagctgggattacaggcgcataccaggttgcctggctaatttttgtgtttttagtagagacagggtttcgccttattggccagactggtctcaaactcttgaccgcaggtgatccacccacctcagcctcccaaagtactgggattactggcgtgagccaccatgccccaccatgattttcttaataacattttcttttctccagcttatttttgtaagaataccatatatcatacatataacatataaaatatgtattattttgactgacggtattaaatatgtgttatctaatatggactgaccgtttatgttatcagtaatgcttctagtcagcagtagctattaataaaaatttttgggaagtcaaaagttatgcagattttcgactgtgtggagcagggggttggcacccctaaccccagtgttgttcaagggtcaattgtagtttaaaatcttcccttccttttcccatctgtactcactgagtcgtcatccagggtggaggaggtcatgtagggatcttcatggtcctagtgtgtaagcacctgtgggacctccctcctaggagtggcatggaaggtgctgctgggatggacatcaaccaacccccaaggtagaggccaagtcgctgttggctagatacaggcaattggtacctttccgaagctctctgtggtgttagttcactgtaatggaggattcagagaggggcagccaactccatgccctgtgagcctgggacagttgtttgtccacttgctcaggctcttgacagagcagcttcttactgcatgacagctttttaggcactctcccttctcaccactttacctttactttcttcttatcctagttttacctctctctgaagacaggtaatgattagctgccccttttttcagtggacacatttgacattgtag

SEQ ID NO: 36518 - DNA, 1069 bp, Homo sapiens
agccttcctaaaagactgaaaaagttgtctgtcatgtacagatgtctaatctgttgatctgacacaggggggctgtgagtcatttcctcaacagctcagatttgagcttgggttttcctgaaaccagcaaaacccaaggccgattgtttaaatgttttctgaaacctgctcttccgcaaggtccaaacttccacacagtaggcacagatggtacaaaagagggctgcctgatctcaaactagtggttgtggtgtcagtcttagcctacctcttcgaatagtgggaatcagagacattttagttgttaatacaagtaactgtggtaggaaagataataatttattctcctaacaaatccagagatacttctcactgttctacgaagtcttggctctgctgggttctctgtggaagttaactgctccaagtgtttttcttttctcttctcttctcttccgctcccctcccctcccctcttttctcttttctcttttttgagagagtctcgctctgttgtccaggctggagtgcagtggcgccatctcagctcacttcaacctccacctcctgagttcaagcaattctcatgcctcagcctcccaagcagctgggattacaggggcgtgccaccacgctgggccaatttttgtatttttagtagaggtgaggtttcactatgtggccaggggtgggtctcccaactcctggcctcaagcagtccgcccacctcggcctcccaaactgctggtattacaagcatgagccaccacacccagcctctttctttttttgggacatggtcttgcagtcatggcttgctgcagcctcgaccttctgggctcaagctattctcccaactcagccttccaattagctgggactataggtgcgtgccaccacacccagccaatgaaaaattttttaatgtatagagatggggtcttgctatgtagcccaggctggtcacaaactcctagcctcaagtgatcctcttgccttggactggaagccactgcacccagctcagagtgtttctcattctaacctcaggatcttctttagtctcatt

SEQ ID NO: 36519 - DNA, 1051 bp, Homo sapiens
tccaggtccagcagtttcctcttgtctttgcttccttcccaagttgcatgattataaacacatttactgggccgggcgcagtggctcctgcctgtaatcccagcactttgggaggccgaggcgggtggatcacaaggtcaggagatcgagaccatcctggctaacacgataaaaccccatctctaccaaaaatacaaaaaactagccagatgtggtggcgggcgcctgtagtcccagttattcgggaggctgaggcagaagaatcacttcaacctgggaggtggaggttgcagtgagctgacattgcgccactgcactccagcctgggcaacagagggacactctgtctctaaaataaaataaaataaaataaatacatttacttctaataacccataagcaccttgtacctaggaatcctactaattatcctctcagcgcattttcatactactctcattattcacttattcaatgaatacagccgaaggatctgaatagacatctcttcaaagaatataaacaaatggacaataaacatatgaacggtacctgacatcatcagctatcaggatggtggtcacttcagatccactagcatggctagaattaaccaaaaagggggaaaataacaagtgttagggaagatgtagggcactgtaaccctcatacacactggtgggatgtaaaatggtacagccactttagaaaaaggtaaagcagcttctcaaaagtttaagcacaaagtttactatatttcccagcagttctactccgttcccagagaagtaaaaacacagaaacgtgtatgagcgttcatagcaacatgattcataatagtcaaagagtggcaataattcaaatgttcattaactgatgaatggctaagtaaaatgtggcatggtaatataacagaatcttattcatcaacaaaagggaacaaagtactggtacatgctacacatgagtgaactttgaaaacattatgttaggccaggagcagtggctcatgcctgtaatccgagcactttgggaggtggtcaggagttca

SEQ ID NO: 36520 - DNA, 1055 bp, Homo sapiens
ctacataaagtatgaaacattgttttcattttctttgtgtgcagcagccctgcatacgctgcatgccataaagatacccagggcagagggtacaaagaagaggctctattgctacacgttgtagactgacattctgacatcttttatggagaatgccagttggcatggttcctggggggcaattaggtaccatacttctactttaaacatatatgctttttaactcgtgatctaactgctagacattttctctaggggagtgtcacaaatatttgccaaaatacctgtataaggatgttttcttcaaccagaatgtctaaggaaagactgaataagtgaattatagcccctccatctattcagtagggtactatgcagccattaaaatggatgaggtagatctgtagggccagacctagaaaggttttcaagtgaaaaagatacaatagtgtccataatataattccttttatattcatttacatatagttgtctgtattttgtatggactgttatatgtatgtgtatgaatttttttctattagaagcacacctataaataatgtattgaacagttgttcatgggtacagattgttgtgtctactcatagtggacctatgctgtttccttagctaaaatgatgtatggtttcagttaagtgtgggcagagcctgtccccctctgttgaacagtggactcgcacctccccccatcaggttcagttgtggagagcaggctgggtgctctgtcctgggtgtgtggtagcctcagcgaggctggggctttcctagagacaagtgtttcatgagggtagagaatattactttggtcagcttcctgaagtggggaatattactctaaaaaatggcacactctttcctggtttaggttcatctagaaggcggccaggatgaattcaagaaagtctaaatggattaaaaaaaaaaaaaaccgtagaagtatctagacaaaggttaaaaaatccttggtggaagtttgggtcacttttgaacggaaaggaatgccatacttcattgattctgaaatagggatg

SEQ ID NO: 36521 - DNA, 1041 bp, Homo sapiens
agccaaaattaacctctgctattgtctcttatgtctcagttccctctctccccctctgggcaggggccgagagcagccagaagccatgtggccagtgctgtggaaggctggtgtgcctagatgggcccaggtttcttcatcctcagcactgtgtttctcagccaccccgtcttcatccccctattccctcacactgataggtacaaaaatacggttcctaccgcctggaaattgtacaatacatttcatttggtgttttaagcctgatcaagagaagctctttctcagttacagtttttctctgtagttaacaagcctccccaccattttccctgaaatagccaaactctcagcctcatctaggccacaggatgtgtgagacacaagcctccttacacaagccaaagattgtaaaggcatccttgactcccacacaatcggtaatagggcctattgcttccattggccaaatgtatcttgacacaaaccagtcttgtcctttctgcagatctccatagccacttggactactgtggccgctcccgatttcctgttctttcctctctccacttccttctgcatccagctgtcaatactgtcatctgaaaatgcagatcacatggctctgccctgcttccatgactacttagaatacagctcatctccagtatggtctgcggggtctcagttcataccactctctgtggtgtactttgctccagcctcactggaagaaaatgtttgcttgctataaacacttgagaggtgctctgtgtttctccctttgggtaaagctttctaggctggtcctaatctgggagcctctaaaactctgagatgtggagcgagacaggaactgggcaggggccacccttttctctttgaccatccccaactgctttttttcttgctttactttactcacttgtcttccacctcagcctgcagtgagtggcttttgtcatcaggcattaataacgcaaagtgcctcagagcagaagagttaactatttgtttacttagctaaaaacatctggactt

SEQ ID NO: 36522 - DNA, 1098 bp, Homo sapiens
gtgacagtctgcatgtgcagttttcaggtaaatatccctattcattccaacattgactacctcctctgtgccaggcctgtgggctagttggtatctatcaggaaacaaatgggaggtaaattaacctgtatttgtaagatccatgaaggaaaggacaatatatcttgttttattcactgctagatcccaatcgcagtgcttggcacatggcaggacctccctgaatgttgcataaaacaactgaaaacacagaaggggattcctgttaaagggtttgacaacagggtctgcaattagtgcttccacgcctgttttgcagtcaatattcaactgatacgtcttctacctggagtgcctaggtatctgaaacaaataatgagaaagctgtttcaggaatcatccagcggttgtcagctatccaggctcatgtggtgcctgtgatggtgttacactgttggaagagcaaacactgtctttattgaggtttggctccaagcactgttttggtgttgtagctgagtacctttgggcagtgttttgcacctctgagagtggaatgactcctgtggagttgatcctagtctgggtgcaaacaatttttttctgtttgcagaaaaagacaggttgtcttagggacagcctgtcattctttacctctttgaatcctagatgccttcacctgaatgacatctacctccatcaggaccccagatgtctgacagccctgtgtgacaccaagataagtaacgtatgtagtcttcttgtcatgtaggtcccaattaaattactatagctcagatgggggtaggggacttaaaattatgatgtgaaaaattatgtagagtatcagacttttttttggggggggacggagtcttgctcagttgcccaggctagagtacagtggctcgatctcggctcactgcaacctctgcctcctgggttcaagcgattctcctgcctcagcctcccgagtagctgggactacaggcacctgccaccatgccaggctaatttttttattttaagtagagacgaggtttcaccatattggccaggctggtctgaaactcctgaccttgcgatttgcctgccttg

SEQ ID NO: 36523 - DNA, 1027 bp, Homo sapiens
tttttcgtactgcgtcgtggaacaagccgcctgcagtacagtgcgaggcgggtgatttgcacttgtttagtcaagtcacctcacatcctttttctctttatcaaaatagtattagtccaggttcctccagagaggatcgtgtggtgtgggaccttccggtttccagacaaagggttttggagtaccgtggtgtagtcgccgcatcgttctttgcatttcgagctctgtgccatgttctgtgttcggcatttaccgtggatgaatatcccctaggtgtttatcctgctctgtggccctgttctgtggaatattcctattggatcagttacagttttttagccagatatttctagaacggttatggtggttctgaaatggctagtctttcgggcgcgctggaataatgtgaagaatcgttgatttcgtaggtaggggtcacgagattttgtattggtactgcgttctgtgttttaaaccttggcttaagatttctgaatagtcggtaaaatacatttttctcccagggaaatctaaacagttgactatgcggacaaaaatgatgtttcaggctattttaataaatgtttaaaatttccctttaaaaacatttctttactaatggctcagtcatctacgcagtctatcgacgtttttcacagtattgttttaaaaatcaagaaaggcttgacattttcgttgcaaaaacgctctggatgatgccttttccacttaaatagaatgtttttgcaaactcgaaattaaacaacattaaaatactgcatgaagtttcttggttatgtaagatttggaaaagatcatttagccagatgtgtgttgaagtgctttaaatttgtatttcttcctttgcacttaacagtatatacttagaacattactttgtactttacccagagaagtttcgctttatcatctttatatatttttcagccgtgtacagcttttatatcacattttgaactaacttggaaggatttaactacccttgatctgtgcatttgttttagtc

SEQ ID NO: 36524 - DNA, 1050 bp, Homo sapiens
acttgaacccaggaggcggaggtagcagttagccgaggtggcgccactgcattccagcctgggcaacagagcgggactccatctcaaaaaaaagtaaagtggatgattgacttaacatttgggatggacagtgctaagtttgttgggatggattggaagggttataggctgggagtgtagttttgccattttctgtatatgtggttggttattctaaggcacaacgctgtccaagaaataaagtgctgtaatttataattattagctatgtagcaaacctttctcattggatcattaggattaagggctctgaagttcttgataaaagtttatgtgtagaaaatttaatggataattaaaagtaaaacagaaaacaagcctatgggttgagttttagatatgtacctttaaaggggttttatgtgtaatttaaaaaattgagtataagtgttaggttttaacgcatttctattataatcctatttgtaatacagtaaaagttacatgataaagtgctgttatctgacctaacctgaatataatttattactgtggcacttctgtgtggatggagtgcggagtgcctttgatgtgatgtataattttccagttgtacatcaagccctaatgttctctgtatagataaagctcaaggctctttggaagtggaaaataaaaagtgaagtagtaatgaaagcttaggtttgaaaaaattttaaagctattccaaaatttaaagtatgcttgctccccacccaccaaaccttaaaaacatcttatctgacattctctttaatgtggttcaggcagaaacaggttagtaggaaaacaagaggggagcttgcctgtggagaaggagagagtagttgcagatgggtaagaaaagtaaaagcagagtgcctatggtaaatgtcttagtgggccagcagtaaatgcagcaagtatggaaagtagtcatttaattaatattagggagcagtattatctgcatttacttcatgaagatgcataactttcagatcttttaggatgatgtgtttggtttttttc

SEQ ID NO: 36525 - DNA, 1034 bp, Homo sapiens
ttcttgaattgaaaataagttggatgcttggtttgaaagtcctgaccgcaggaatcaatatttttgtgtgatttatgacaaaaatcaagcagctaccttccaaatggtgctgctttgaaattactgacagtcaactatgtctgccatctatcagtgacataggttaagacatttttactaaattggtattgttgattgctacctaaaacatatttggtatattttcacatgaataagctaataaatgatcaaggtgattggccttgatagaacatttggaaaatctgagcatttcttgcaattcagaagaggaaaatataagaaactgtagttttctagctgttgcttgtaagtttcaatgtgaagttaaaataatgtcattatgaaggtatttttttccctgagtatctctagttttatggttaaaccataaataatctttcatagttttatgggtaaaccatctcaaattagttgttttttttttttttaattctgactacaaagactgagaagagaaaaattatttttttatttgttttgttttttgagacgatgtttgctctgtggcccaggctggagtgcagtgccccaatctcggctcagtgcagcctccatctcccaggttcaagtgattctccggccttagcctcccacgtaggtgggactacaggtgcgtgccaccatgcccagctaatttttatatttttagtagagacgaggtttcaccatgttggccaggatggtcttgatctcttgacctcgtgatcaacccacctcggcttcccaaagtgcagggattacaggcgtgagccactgcgccctgccagagaaaaattatttaaaggagtgattatctcacacagttgagagcatagctgaagatccatgtggagtagtagatacctcttagcattttgggaggtcaaggcgggaggattgcttgagcccaggagttcgagaccagcctggccaacatggtgaaaaccccctctctaccaaaacaatgaaaactagccgagcatggtggcatg

SEQ ID NO: 36526 - DNA, 1378 bp, Homo sapiens
attgggaagaaaaaaggcactttagaagagatagttttgatgatcgtggtcctagtctcaacccagtgcttgattatgaccatggaagtcgttctcaagaatctggttattatgacagaatggattatgaagatgacagattaagagatggagaaaggtgtagggatgattctttttttggtgagacctcgcataactatcataaatttgacagtgagtatgagagaatgggacgtggtcctggccccttacaagagagatctctctttgagaaaaagagaggcgctcctccaagtagcaatattgaagacttccatggactcttaccgaagggttatccccatctgtgctctatatgtgatttgccagttcattctaataaggtgagttaactcaacagatgcttctaatttcttttacattgtagtgcctatttacctatatctttgactctaattctgtagtctgatgacattgagttgatcaagcatttttaaacttttgagaacacttactttatttggaaggtaattgtttttgagcattttaaaccagggctttacattaatatattctgcctagattacttctggccacaaagctatcatccactgagattatcttgttggtttttggcatcaatatgttcttcttaatcatatatttaagcaggttttttttgtctgctttgttgaattgttttaagtattttttttgcagtcaatgtgctctgccattcaggatgctagatttcagctctccatctgtcttgattgctgatttgtatgtagtaaagatgtattcttgaacaattctctttttttccttatctgtggctacagggaaagagttaatgtagagccctggtgtttgtttcagtatgtttcatattttagattagttcattcttccttttttaatttccctttaacacaaactctcatactatgactgaaatttttcatcattttttttctccttttccacaactttcttaaacatacttcaaaactcactttttattatcccatgttacatctgtccctttagagacttggacaaatcaactactacagtatcctgctctgtgttcctcataaacaaattctttttctgagttaggcttagacttctgaaatagtcatttgaaaagaaaatctaattctcctttgctttaattatcacatctggcaaaatgggaactttttcaaaatgcccttttaaatatgttgtcctttctctttcaactttttcagtgttactcattctgactttttttcccccaatatatggtgcagttgacttaaagtcattgttatagcaccccactagcttgatctataatctgtgaccgtccattttttcctgatgtgctcta

SEQ ID NO: 36527 - DNA, 1030 bp, Homo sapiens
gcagtttttacatattttgatgaaactatggattcaagagtaagatacactaccctagtgcaagaggtacttttagcctgtaaaaatgcttaggtcctagctagttttggtattctgtcaaaatactgagtacatttgagaactattttagaggccttttgtttaattctgtggtttaaatgtgtaaattggaccaactttaagaagtttaaacacatggattatctgaatttctagttttctagttgctttactatgttttttacgtatatgcattatattgaaaaaatctttactcactttagcagtggaccctctataaccgctatagaaatgaccttagagaaaatttctgtgatggaagtagataatgaaaaatttttaaacatttaatcctgctctctggtattgctgcataacttggaaaatctgttctttttacttagtggtattgttaaatagtctacatgatcaaaaattcttactgtgaagtaagaaacttaagttgaaaataatttgtcatggagtgtcattatttttaggtgacttaaagtgatggtggtgtttttatttctttataggtcattttaggtcatcaaattgcttttcttttcttttctttttttctttttttttttgagacggagtttcacttttgttgcccaggctgtaatgagtgcaatggtgcgatctcggctcaccgcaacctccgcctcccaggttcaagcaattctcctgcttcagccttccgagtagctgggattacaggcatgcgccaccacgcccagctaattttatatttttagagccagggtttctccatgttggtcaggctggtcttgaactcctgacctcaggtgattcactgccttggcctcccaaagtcctgggattacaggtgtgagccatcgcacccagtcatcagattgcttttctatgcaatctcaagctttctcagcttcctttcacttaaagaaaattacccactacagcactttggctgtcttgtcacttgagtttatattaagtt

SEQ ID NO: 36528 - DNA, 1424 bp, Homo sapiens
acatgctctaaaaatgtaaaagatacggaaaagagggtaggttattaaaagattctaattcattgtccagcaaaatccttggtgatgaattttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaatcctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtaattatataaaattcatgttacttttccctacagagccgttactgaaaatttttctttttatttatttatttgagatggggttttgctcttatcgcccaggctggagtgcaatggcacgatctcgactcactgcaacctctgcctcctgggtgcaagcagttctcctgcttcagcctaccgagtagctgggattacaggtgcccaccaccacgcccagctaattttcgtatttttagtagagacggggtttcaccgcgttggccagactagtctcgaactcttggcctcaggt

SEQ ID NO: 36529 - DNA, 1163 bp, Homo sapiens
aggcagccttatagtgtagctttgaaaaaaaaaatacaggacgtgagtttgcagtaagttaactgacccaacatagttaaaacttttgccactcattcaaaaattattgaataatttttcctatttgagaaatgttggcctggtcagataccttagtatcctttaaaacaattttatttgaacaagtaagtcatttagaagccatgtataaagtgaatataaatataaaaatacacacatgctataaagaagagtaaacaaaggacccacattgagctgactgcctagcttaaggagtagggcattaaaatgcctttgaggcaaactttttatgttaaatggctcataaaatgtcggagtcaggcgggcccagtggctcacgcctgtaatcccagcactttgggaggcccagcagatcagttgaggccaggagttcaagaccaacatggtgaaaccccgtctctactaaaaatatgaaaattagccgggcgtggtggcacatacctgtagcagctacttggaaggctgagacaggagaattgcttgaatctgggaggcagaagttgcagttagccaagatcacatcactgtactccagcctgggtgacaagagcaagactgtctcaagaaaaaaaaaaagtagagcgaaatgagatttttgccatcctattccatattccattggttccttttatgcaacattcaactcaaaaccaatatttacctcagtttttatttgatggcttggtcaaataacttcattaatttttctcactagagctgatcattatgtttacatttgtaaatgctaataattactgatgtttatggcatttaatgccatacgtttttctaagtttaaatttattaatttaatcctcacagtaaccatatgcatctcatactgtgatctccagtccataaatgaggaaaattgaaatatggagaagttaaataatcccatactgcttataagacacagagccaaaatttaaacttgggcagtcattcttcagagcatgattgttttttttttttttttttttggagacggagtcttgctctgttgcccaggctggagtgcggtggtgtgatctcagctaactgcaacctccacctcccaggttcaagttctgctgcctcagcctcccaagtagctggga

SEQ ID NO: 36530 - DNA, 1051 bp, Homo sapiens
ctggtgacaaaaatgatgatggtttggttgaaattaaggtggacaagatcgaggaacttgatcaagaaaacgaagcagcgttggaaaatggaattaaaaatgaggaaaacacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtgagatttaagtctttgttcttcaccttcctcactctcctcaaaacaaactcttaggttttaaaataagattttaaagttggtcttacataagctgtgatagcattttaaatttgctttgtttctatggggaacaatttataaatcttaattgatatattttcctctcatgcatgtctctgattttgtattattttctgttgttattccacaatgtgttcccttttttcgtaaaatttcttgcaagttacacgcttttgttttgcttttctgtgttgtttttctgtattatatttctttttttaagaatacagttaggtgagacctcaaacatcaattaggtaaaagcaaaatatggttcggtttttgttttttatcttaggctgtattggacttctcaaaaacatgttgtttcatttaaattatgttgacaggtgaaattgtgaatactaaataaaatcttcagtttaatttgtaagaatgtatgtttgtatttctaggtatagactatgtgatacctaaaacagggttttactgtaagctgtgttcactcttttatacaaatgaagaagttgcaaagaatactcattgcagcagccttcctcattatcagaaattaaaggtaaggttgaatgtaaaacagttcttttgtgaaaacttaacaagttatggaaataagtggggtatataagtaaaatgtgtatagtgttctctctagactcagtgcagtgctttctcctgaagataactttttatttacttttttttttttttttaaagacagtttctc

SEQ ID NO: 36531 - DNA, 1546 bp, Homo sapiens
cagttagtgaaagacaggatatttggggaaaattagtctgtttatactacttgtcagttgtgaacttgaataaaactttttcacacacacacaaaatcacaggataggtaacttgacaagaactatagaacccacttgtgtttctttaagggatggaggttagggaatggagatttcctctaatgattcaaggctgtgcacgttgctccttaggaactcaaattgaggtaggtaatttcaccctcttttggtcagaatgagtttatagcaggcttttccttaaataagcactctgcactttattcaggtttatcactttatgactctagagtgtgatgctccagttttagtgaaaaacttgaacacttagcacagcaatttggttgatactgtgggagattaaagaatgtggaaggcaagacctctgcccccttgtaatctaataaccttttgtgcttttaaaacattttcttgtaatttacatcctattgtcattcattatcatgaaacgtgaaatgggcagagcaagtttttttttttttttttttttgagatggagtctcactctgtcgccaggctggagtgctggagtgcagtggcgcaattggctcactgcaacctccgcctccccgggttcaagcgattctcctgcctccgcctccctagtagctgggactacaggcgcttgccaccacgccggctaattttttgtatttttagtagagacagggtttcaccgtgttagccaggatggtctcgatctcctgactttgtgatccgcccccgtcggcctcccaacagagcaagttttatcttgcccatttgggaattaaagaaatagaagcctgaaagattatttttatttagcaaatatttatataacaataatgccaggcattgttctcattgcctttacaaatattaactaatttgatccacaacatagctagaaggtaggccctactgtaaaatgaagataacaaatgagacgtgaagtaactttcccaatgtcacagagctatgatagtcggaattcaaatccagatagtccagagattctatgctcttaaccattatgtggtgctgtgtgatttagtgacaggtctagggtactttaaggtggctatgtagcatagctgggatttgaacctacgtcttctgactgtggtctaagattaaagttgtccaagtcattgcctttgtgatctagaccacctgttgcacaggtgcatgaatagtttgcatttgatataggctaaggttcagttccaaaaaactcccttttttcttaattttttcattgtttagagtggtgctgtccaatgatgtaggtactgtgtgtggttatgagcacttgagatgtggctagtgtaaatgaagaactaaattttaattaaatagatctgtgtagccgatggccaccatattggatgggcacacgtttggagaatttgaatagcctctgcttcttatatcagtttgtataaatttgggtggcatttctaatgtacttgagcttttatcagttaggatgacccattcttgc

SEQ ID NO: 36532 - DNA, 1131 bp, Homo sapiens
atttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtcttgctcaggctggagtgcagtgtcatgatcttggctcactacaaactctggctcccagggtcaagcagttctcttgcctcagactcccaagtagctgggattacaggcactcaccaccatgcccagctaatttttgtatttttaatagagacagggtttctccctgttggccaggctggtcttgaactcctgacgtcaggagatccgtccgtctcggcctcccaaagtgttggga

SEQ ID NO: 36533 - DNA, 1021 bp, Homo sapiens
tggagatcgcgccgctgcattctagcctgggcgacagagcgaaactctgtctagaaaaagaaaaaaatgaaaataaaaaatactgtaggccgggcgcggtgactcacgcctgtaatcccagcattttgggatgccgaggtgagtggatcacgaggtcaggagttcaataccagcctagtcaagatggtgaaaccctgtctctactaaaaatataaaaattagccgggcatggtggtgagcacctgtgatcccagttactggggaggctaaggcagagagttgcttgaacccgggaggtggaggttgtggtgagctgagatcgcaccactgcagtccagcttgggcaacagagcaagactccgtctcaaaaaagaaaaaaaaatactgtactagaggtgtggtaccatatattagattaatattagaggtaaggactgattgaattcctatcaaaatgatgaattaacaggtagtcctgtggagtattgggaactttaataaatggttgtctgaatatggctatttaaattagttctatcttggatagttctatcttggataccttcttactccaaaaggtgagcttcttcacataagttctgggaatttttttttccccactaaaaaagtattttttatttcctttacaaaagatcattgaattaaggcactttctttggctctactagattgttatttaaatataattcaaacagccatcgaggataactgttaataaatctaggttttctctgaagtctcccagtgtatattactgtactgatgactgacaaggaagaggttttgacaaggtccaattctgtatatttctcttaaaatatcctaggcagttcccaggataggagtatctgactcatgcctcatgctaccaggaacctttgcagcctcatcccagaaatgcagaaacacacttgttttgtctgtagaaataaagttttgatggttagatttccaggcaaaccttcaaaatcatgttaaactataatatagggaaataaag

SEQ ID NO: 36534 - DNA, 1901 bp, Homo sapiens
aaatcatgcatacttgtattaaaattgagagcactggctggatatggtggctcatgcctgtaatcccagcactttgggaagccaaggcaggaggatcacttgagctcaggagttcaataccagcctgtgcaatatagcaagaccctgtgtctacaaaaaattaaattagctaggtgcagtggcatgtgcctgtaatccctgctactcaaaaggccaagacaggaggatcgcttgagcccaggagtttaaggctgcagtgagctgtgatcatgccagtgcactccagcttgggccacagagcgagatctgtctcttaaaaaaaaaaattgacagcacaaattacctcagataaattaattattattcttttttttttttttttgagacagagacttgctctgttgcccaggctgtagtgcaatggcgtgatctcagctcactgcaacctccgcctctcaggcccaagcaattctcctgcctcagcctcccaagaaaagaagctgggattacaggcatgcaccaccgtgcctggctgatttttgtatttttagcaggtttcaccatgttgaccaggctggtcttgaactcctggcctcaagtgatccacccgcctaagcctttcaatgtgctgggattgcaggtgtgagccaccatgccccacctgatctcagataaattaattaaaatatataatcaaaataatgtcacaaacagaattattaagaattatcaagatgaggctgggcgcggtggctcatgcctgtaatcccagctctttgggaggccgagacgggcagatcatgaggtcaggagatcgagaccatcctggctaacatggtgaaaccccatctccactaaaaatacaaaaaaattagccagacgtggtggtgggcacctgtagtcccagctactcaggaggctgaggcaggacaatggcgtgaacctgggaggcggaacttgcagtgagccgagatcgcaccactgtactccagcctggacgacagagcgaaactccatctcaaaaaaaaaaagaaaaaaaaaaaagtactatcaagatgaaacatctgtcattcttattttgctatcagttttaagaatagtatttttcttacataataaaagtcatcctcatcaggtactcctttaaatgtcttactgtatattgttttcattgcagtataatatgaaaatttgtttccaacagatacattgtagcaaaagaaagaatacagactgcatattttgcagttaggctgctgctgacattattaattatcccatcatggataggtcaccctaatttttctgaaaaatgcctgttctttgcttgtgtttattttgaaataatacgactacttgggcttaggaatcaaaggactctgctttccatttaaaatgtctttctcggccgggcgcagtggctcaagcttgtaatcccagcactttgggaggctgaggcgggcgaatcacgaggtcaagagatcgagaccatcctggctaacacggggaaaccccatctccactaaaaatacaaaaaaaattagccaggtgtggtggcgggtgcctgtaatcccagctacttgagaggctgaggcaggagaatggcttgaactcgggaagcggagcttgcagtgagctgagatcacgccactgcgctccagcctgggcgacagagcgagactgtctctaaataaataaataaataaataataaaaaatgtctctctcctagatataagtcaattgggaatgagtacacttgaaatatttaatatataataagcttcgattaaataacttctctcttttttttttttgagacgaagtttcgttcttgttgcccaggctggagtgctatggcgtggtggtgggggcctgtaatcccagccactcaggaggctg

SEQ ID NO: 36535 - DNA, 1030 bp, Homo sapiens
tccttgtctgtagaatgggaattgtaccctgcaagcctgtggggaagattagatagaagagggtttagcattttggactacataaaagataattttgttgttattttttacaaatgtgcttggcagttttattcacagtacccgatacttagaaacaactcagatatccatcattagctgaatatgtaaacaaaatgtagaaaatccatatactggatggagcattacccaccaataaaaaggaacaaatagtgaaacaaccctgccacttagcagtttattagttggctccaagttcaccctcccgtacttgctctgctttgactaaataacttctgaagtatgtatttcagctggtgaagagctggactctttcacctttgcagtgaacaacatgttgggctttgtcaatagagggcactagagggacattacagaggaaaggggcttcttagatttggtggacttttctttttttaagtttttaaatattatcatggtgtcttaacatgccaataatgttgacctacggaattggtataatctcaaaatcttaggtgtcagtgttaaatatatgtttcacttttacttcatcgtcaccccaagcaaaaaaagaaaaacctgaatgtgaaaagaatgaagtcttataatatttctaaactaaaaaagggattgaatcccagtattcttcagcaaacttcaaaatactgtcaccttaatatgtttttaatacatgtgatatttttgtaggtctagaattgtgaaatcaattctcttaaacatcttattatagaagtgtctgctgctatcctttgagcactaaccccaccacctgtaatgcatcatgccaatataagtgatagaattgctttgctaaattcttaagggcttatgtcagggaaaaactttgaaattagctgggtacagtggctcatgcctataatctcagtgctttgggaggccaaggtgggagaatcacttggctgggagaccagcctgagcaattcagcaagaccccttctctacaaaa

SEQ ID NO: 36536 - DNA, 1047 bp, Homo sapiens
gttgccataataaattaccacaaaccgggtggcttaaagtaacagaactatattctctcacagttctggaggccagcagtctaaagtcagtctgtcttcaggtccatactctggatgttctaggggagaatccttccttgcctcttccaactttggtggatgtcagcattccttggctcctttggtttgtggctacatcactccagcatctgcctccatctttgtatcaccttctctgtgtgtgtcttctcttttgtgtcttatatggccacttgtcattaaacttgcccatccacgtaacccaaagatgatttttttttttgagacggactacagacacgtgccaccacgcccggcaaattttttgttttttagtagagatggggtttcacgttgttagccaggatggtctcaatctcctgacctcgtgatctgcccgcctcagccttccaaagtgctgggattacaggtatgagccactgcgcccagccagtaaattctttttattactgtagtagatgatacttgattaaatgccatctcgggtgctttcattgtcaacaaaggtgctcccatctctaagcttacataaaatgtaattttaaaaagacatttctttagatgtacctgttcacatttttgttaatagtctctcatgtctagttttggaggctggaatgttcaagggagccacaaaaatctctgtcagttggtgttttgaataattgttctgaaatatactcccaggcttgaaacttggatctggccttttttttttttttttaacttgaatttttttttttttttttgctcttatgttattcatatgaattttgcaaatagagagccagtcttgtagcatagtaaaatttaacagtttatgtgactattgatctacccatcttatagagattgtctgtctgtaggaagacggtggtaaccgtggtcagactcatcattttgaacactctaggttagtgttggagaatttgtaaaacagaaacttaaccacctgtgctttgaaagagtaaagtccatgaaaagtat

SEQ ID NO: 36537 - DNA, 1032 bp, Homo sapiens
gagttcgagaccaacctggccaacaaggtgaaaccctgtctctattaaaaatacaaaaattagctgggcgtggtgtcaggtgcctgtagtctcagctactcgggaggctgagacaggagaattgcttgaacccaggaagtggaggttgcagtgagctgagatcatgccactgcactctagcctgggcgacggagcgagactccatctcgaaagaaaaagaagttgtgaaatgaacaaaggatagttaaaggtaaaataggaaaggttcttgaatgaatagagaatatggtcatatgccacataatgacattttggtcaatgacagatgatattatgacagtggtcccataagataatggagccagaaaattcctgttgcctagtgacatagctcttgtagcgcaattccttttttgaaaaagtaaattaaaaaaataataagtttattatagcctgagtgtacagtgtttataaagtctgcagtagtgtacaataatcagtaatgtcctaggccctcacattcattcattacggactcatccagagcaacttccagtcttgcagactttgttcatgatgagtgccctatagaggtgtgccatttttttacctttttttcctcatgtttttaccataccttttctgtttagatatatttaggatacacagatactattgtgttatagttgcctgcagtattcagcacagtaatatgctgtataggtttctagcctaggagcaataaggctgtataccatgtggcctaggttataccatctcggtttgtgtaagtacactttgatgttcctacagctacacatttctcagaatgtatgcctttcgttaagtttagcatgactatattctcttcataacacatttccatctcagtggttgctaaagtactcaaagaaactccttgttctctcgtgttttacacatttaccccaaaacacctttttcttttttcttttcttttctttttttttttttttgagacaagagtttcgctcttgttgcccagtctggagt

SEQ ID NO: 36538 - DNA, 1038 bp, Homo sapiens
tgttgcccaggctggagtgcagtggcgcgatctcggctgactgcaacctccatctcttgggttcaagtgattatcttgcctcagcctcccatgtagctgggattacaggcatgcaccaccacgcccagctaattttgtatttttagtagagacagggcttctccatgttggttaggctggtctcgaactccgcacctcacatgatccacccacctcagcctcccaaagtgctgggattacaggtgtgagccacggtgcccggctgcgtgcaggtcttttttttttttttttgagacagagttttaccccatcccccaagatggttggagtacagtggtgagattatagctcactgcagccccaaacttctgggctcaagtaatcttactgcctcagcctcctgagtagctagtactacaggaatgtgctaccacatccccgctaatttttgttgttgttgttgttaattttttgtagagacagggtctcactttgttgaccaaactgatctcgagctcctgggctgaagcagtcctccagcctcagcctctcaaagtgctgggattatagccatgagtccctgtgcctggcctatagactttctgtttcctgccgctattggtgattgggctgaatggactagacttccttttggaaattttttatgtgcctttgtaagtatttgagcactaattctggttggtaccctactaagcattaatccactcagacatttgagtgcctctaatgttccagtctctacagaatgcagtgaagaatatgatataccttgtctctcattcaaggagtcataattaaacattaaaggggtagagaagagtttgtgcagaggttaacttttggtagttgtggataaattaaaaatgaaacatagggaggctgagggaggggaatcacttgaacccgggaggtggagattgcagtgagtcgagattgtgccactgcactccagcctggcaacagagcgagactctgtctcaaaaaaaaaaaaaaaaaaaaaaaaaagaagaaagaaat

SEQ ID NO: 36539 - DNA, 1085 bp, Homo sapiens
ataacatctgttttatgtagtattcagtgaagttataagaggaactagataggagagggtggatagttcttttagggccgggcgcagtggctcacgcctgtaaccccagcactttgggaggctgaggtgggcagatcacaaggtcaggagtttgagaccagcctggccaacggggtgaaaccccgtctctactaaaaatacaaaaattagccgggcatggtggcgggcacctgtaatcgcagctactcgagaggctgagataattgcttaaactcaggacgtttaggttgcggtgagctgaaattgcaccactgcacttcagcctgggcgacagagcaagactcacgtctccaacttgagttctagtggattagagaggcatagatacgtttttgtttttagtggaggtaacactgggaatgggatattctaacagtagttggttcttgctttttcctatttgtgaatttattgtcaaatttttttgattagagaactgttttgtccgatatttagaattgtgggtctgaatgcttaccagaagtcatttcccaagtcatcatggagtaatgttgaacactgttgaacagaactttcccaaactgcactgcccccaccctctaaccccccacttttttttttgcagagacagggtcttgttcttcagcccagactggagtacagtggcacaatcgtggctcactgcagtgtcaaactcatgggctcaagtgatcctcccaccccagcctccccagtagctgggactgctagtacatgccactacacctttccagcctccccagtagctgggactgctagtacatgccactacacctggctaatttgtttttttttttttttttttgtagagacaggatctcactatgttgcacaggctggtctctaattcctggcctcaagcaggccttctgcctcagccccccaaagtgctgctgttacaggcatgagttaccgtgcaaggccagcatacccacccccacccccccccctttttttttttttttttttttgaggcagggtcttgctctgttgcccggactggaatgcagtggcacaatcacagc

SEQ ID NO: 36540 - DNA, 1246 bp, Homo sapiens
tgggctcaagtgatccacccgactcagcctcccaaagtgctgggattacaggtgtgagccaacatgcccagccttctgtcggtttaatcattattagtatatgagttcaagaactatgtaatgtagaatcatataatttcaagtactttaaatgaatgaattgagtggacatcttttgtagaaataggccaatcaagtatggaataaggtatatgccaacaaatactaaaatttaatcagaaccctctataagtagcaattaaaggagactttcacattttacagctccttcccattatcattgaattaatccttatcagaaatttgggatagaaaggggcctttccttgaatgtcctataagctactctcttcaagttacttgatgggataatgaatggaatctgttgcttactgactccacacctatgttaagccaagcttctctttgtgtgtacaggtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgttttta

SEQ ID NO: 36541 - DNA, 1094 bp, Homo sapiens
ctgagcaacatggagaaaccccgtctctactaaaaatacaaaattagccaggcgtggtggtgcatgcctgtaatcccagatacttgggaggctgaggcaggaaaatctcttgaaccggggatgtggaggttgcagtgaaccgagatccgagatcgcgccattgcatccagcctgggcaacaagagagaaactctgactcaaaaaaaaaaaaaaagggcggggggcacttccttttgaagtttcagatgtatattggagggagcagaattcctttgtgatttcttccttaatacattgtgtccctgaggtggtccctgttcttcctgtctcctgtcagccccctggctcagaggacggctgaatggagttgcatttcagtgcccacagatggaggtgatgactgaagtgtgtttgcttatgtggggagtgagatgatggctttggtgtctgagtggatgctagtgccttgagtggccagcagagggcagtggtgacccatagctgtgacaaccgtgaggcgtgtggtcagtgaatctgcatgggcacaacctgagaggggcttttgttggagtggggagattctttcggacttaagctttgtgcgtggtatatccagaatcagatgggccagtgccaagttcagtcaggttctcagccttacagtgaaggaaaaggttagtgacttgtatttcagcccaaagcctactggaagtgtcaagctgccagctcccctctgccctccccgttgctatggcagccatgtctctgtgtgtgaataggtgaaccaggctccaggttaggacctctgcccacctagctccaggttacatgcaggaaaagatctgtctattgctgcatgtgaacaaggagatcccatatttctagcaggtcacagaggcagcagtccattatcacttgcctgcccacctaccctgggcaaccagcacatggctccttagaccttgaagatggaggcctggggacagaaggagcagagttgggggctagtgatagggcctgggaaatgttcttgtctgtttcaagtttatcttgtattttggggccctggtctcctcagtcttccagcccaacag

SEQ ID NO: 36542 - DNA, 1061 bp, Homo sapiens
gtacatgggggagagatacaggggagctgggaaaaggaaaggctggagaaggagtgccagggaaagtcgatttccccaggaccactaagtggccagctggttccctgacctggggcatggggtccttgggaggtgacagggtgtgccagagatggggggaagaatgagacctctgatcaaatgggcccaggagtctttctgcctaccttccctgcttaccacacacctgcttctccctgtccccttagttgccaaggccctcattatccagtgcccccacttagattttggccatgtccctggttcttagtctacagccctgcaaaatgggtacagagctggcttatgtataaggaagtcctggggtgctgagagctgagggtatgccctcagggagcctttttaagcctctgcccgcctttggggttggggcctgccttccttgcactgggcagaaataaggatataccccttttccatatgctgccaaaaaaaaagccgtttttcagatgagagaagtgagtctgatgggaatggcttcatggtcatgaagggctttggatgcaatctcctaacacccagactaccggtcattctgggcctacagtactgagacagcctagcagtggtcaaagggcatgtggctataaggactcaggcccagttgggctccctcctcctggccacacagttctccataaacgactggaccgtggttgaggaggagagagggacccaagcatcctgagggacacaaacagcagtggccagtcaggaaactggatgcccgtgccgcggactctggagttggacaggcctgggctccacacctggcttggtcgctgcctgctatgtaatcatgggccagtctgctcacctctctgacctcatgtttgtcacctgtgagatcggtatgactctcatctctgtctcaaaaccgcaggacctgaagtagatggtggggtgtgttgtcatcagttctcattatgtcacctggatctccaggcgagcatgcccctccacctgctccactagacctggcatttttctgggggtggcat

SEQ ID NO: 36543 - DNA, 1035 bp, Homo sapiens
atacctcgataaaactgttttttaaaaatcctgccagccaggcgcagtggctcacgcctataatcccagcattttgggaggcccaggtgagaggattgcttgatcctcataggaagacctcatccctactaaaaattaaaataataataataataaaaattctgcccttggcctcaaggccctgcacaactgggaccctgacagcctcatagacacacctcacatcttcttccccacctgcttaggctctctttcatgcctttgtcccctctcattgcttctccttatccttaactctcaaactagcagtcccttcctccaggaaggcctcagatagctcattgtgtccccttccggctcttgtttcacgctggttcatgtgactgtgggcccagctcctgtgcactcctggaaggcagtgctggggtctgggtctgtgtgctctgctgtctctccggtatcataaggtacagggctgctgtcgaggtaggtgcagggaagatgtgtgcaaaggaatatctagaacatccagctgtgggccacctgtgtacatgtctgtgtgcagatggcactatgtcatcccaggatgtcccctccttcccagtgctttctggcccgagagttcaagattgaaccctgcggggggtgaagtgaggctcttctagggctgagggttgaataagggcactgccaccacctccagtgacctcactgccagctggcattatgatgtcactggcttagcattccaggccctgggcatctccaagtgccccaggtgggggcactctcctggggtctgtgacagcttgcccccaaccacggagaggtgacaggcacggtaacaatcctggggagtgagagcagccttaggggtacctaggtcacctgccttgggccactctgtcaattgcaaaagtggccacagaacagggtgactaacacttgggctctgggttcaagctctacccctgctaggcaccagctgtttgacctgaggctgacagcttgaacctctctgagcctaaatttcct

SEQ ID NO: 36544 - DNA, 1048 bp, Homo sapiens
ggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgt

SEQ ID NO: 36545 - DNA, 1035 bp, Homo sapiens
tcaggtctagtaaaagagaaatcaggtatctctgagctcctctactcctgagcccctaataccagagaagatcctttttagctatcaccgtccaaagactcactggttaattaatggtcagcaacttagctgtctgcataaaaaccagcgaccacttaatatgttacttttgggagtgggatctctccttgacacaagtttctgggaagagtaaaaggggcaagcgaacctgctttaatgaatcccgtaaggaactgcgtttcccaggaaattcctgacatttttagctcatgaatttccgaaagcctgcttggttttctcctccattctgggtccttccagaaaggaagaagagtgggctagggtctgaatgctcacagggcctggttcatccgcagagctggccagcaactcaggctgggctcagccctgagcagggtgccccccttccccaaatctcagaaggaggagggggaggcgggcgggcaggcagtcagtcgtggtcccaagggggactggctgcaggtttttgggtgagtgtggagtttctttttgattgttgcatgtggggaagggcagagtcgacgggaacagtcactgcgggcaccctagccctggtgcgtctactgtcctctgctcggctccccccatcggtgagtgcgcccgcccgcccgactgtgcggggctgcggttggggggaggggggagcgggatcatctgaggccagagccactgccgtgtgtgcggggagggggagcggcgggagagagaggggagggacaggctaggtgtctgctgctccacgccactgctgccggcgccccgacctcatccccagcagccccctctgcagctaagggttaccaccgcaccacctctcttctttgcctgcctcagcggccaaggctctgcggtaggagacaacccagccgggtggcgggtgggcctgtctaggtttgggtttgggtcttgctgaggcccgcatgagagggggtggccgtgactcggtgtcccctctttgcagggggctctgct

SEQ ID NO: 36546 - DNA, 1049 bp, Homo sapiens
aaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattac

SEQ ID NO: 36547 - DNA, 1021 bp, Homo sapiens
aatgttcatatagtttccttatggtctaagtgttacaactggttttcaagttgttatattgaatattcctttttggaattcagggttgaatcactttgagggggaagggaagcaagggcaagagactttattttaaccagatgcggtcttatgacctcaaagatgtgctctagaaagaaaataacaaaaagtgtacctgtgaacatattttttgtcttggtgatattatgcaacacagtgttcagaattgcaaaaaaatttaaaaattgatagttttatcaatggaacagagagatgtgtttttggctaaaattattttttgtaagttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttgcaaattctgttgaacattcagtgatgtatttgaaatgagaaagtcctttataacatagtgtgaatgtttgtggccaattcaattgtggaatcttatggctttgtttttactttgggtagaagtttaacttccattgttcagattttaggtttatctagtgaaattgtgccaggtagttgtctaaatatggaccaattttgggaaatgaagattaataagtgtatatttgattctagataatcctttactcaaaatcataagttaaagattcacatcattaagagttatctaacttttatgttgtcaaatctttaaatgtggatgatattcagcattctatctatgaatttcctttaggaaaagagaaaaattcagtctccaaaccttttcttggagacaaaatttaccacatatcgaaaatgaaaaaaatttagaaagcgatttgattattttttaatggagtttaaccagcttaattaatgatttttccag

SEQ ID NO: 36548 - DNA, 1027 bp, Homo sapiens
cccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggcctaggggtggggggccgtaggtgctgcgcgcccgcacaggtggtcaggccgtcagcatgcctggctcgtcgcgcacagaacactgcccaggggttcacccagctcccctccctcccctccgctgccctcctggcagctccagctctgctctcgcggctttccaggttttggggtgggtgattgagtaggccgcacctgggacactgtgactggaggacgccggaatttaaggaggggacgagggagacgcagctctgtttctcgctgtaccccctcacccctccgaagcagccgcgggcggtgcgcaggccgttctctgcgtcctcgggctctgggtgaggctgggtgcagcgggagagacccggggcgagctgctgggggctgtgtggccggccccaagctggccgcgcgcacacgctgcgcacctgttggagcgggcctctgcctgttcggacccgagccgggcctccacgacacagtccccttgggcggcgaaacggccacatctagctttaggtttgaaaggaaaacaaaatagggggaaaaaagtgggtttacagttgcatacatggactctctgggtcagctcttgatgaggaccaaatatcagtaggtcttttggggctgcagccaacaagctggcagctgaggacagagacctgctccctggccttggcactgctggagatctttcagcttgatgagatgcagttttcacagaaaaatt

SEQ ID NO: 36549 - DNA, 1024 bp, Homo sapiens
ctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaactgtctgtctaaatgattccaggcctaagctaagctacctggagtctgtgcttgtctcctggactgttaccatgtctaactaactactcatctgctcactgaggcttataaaatgtgggtatctatctcagctagtggccaccatccaatgtatgaccagcagccaatctacctttttattctggtggtgatgcaaacagtgagggtgctacaaaggcggccagttctgagggccaggtgttctccagctgggtcatgggctcccggccaagctactctccccgtagtcccactcagagataggctcagggaggagcatttgccacatcttgcacctgcctttacccagagcctaggaaagggccttttggtaaccaggggctgcccctggagtggcttccaggcctgctccctggaaacccaggaacctacaattacatggggccagccaagaggttttccttttttttttttttttttttttttttgagatgatggagtttcactcttgttgcccaggctggaggacaatggcgtgatctcggctcaccacaacctccccctcctgggttcaagcaattctcctgcctcagcctc

SEQ ID NO: 36550 - DNA, 1043 bp, Homo sapiens
taccttccagattctcctaactttcttttgatgcattatattaatgagtttaattagttgcttataaatgcctctttcaaactattatagtttataatccatagttgatcttgttggaaaagtttttttttttttttggctgttttttttttggtttgtttgagaacggagtctcactctgttgcccaggctggagtgtaatggtgcaatcttggctcactgcaacctctgcctcccgagttcaagcaattctcctgcctcagcctcctgagtagctgggattataggcggccaccaccatacccagctaatttttttttgtatttttagtagagatggggtttcaccatgttggccaggctggtctcgaactcctgacctcagactatctgcccacctcagcctcccaaagtgctgggattataggcttgagccactgtgcctggcctttttttaaatttttttttttttgagacagggtcccgttatgtcacccaagctggagtgcggtggtgcaggagtgcagtggctcacgatcgtatggcgcaatcacggctcaggcagccttgaccttctgggctcaagcgatcctcccctttcagcctcccaagtgtctgggaccacaggcgcacaccaccgtaccctgctaatttttaaattaaatttaattaattaattttttccgacacacagtcttagttgcccaggctggagtgcagtggcggatctcagctcactgcaacctccgcctcctgggttcaggcaattctcctgccttagcctcccaagtagctaggattacaggtgcgtgccaccatgccccgctaatttgttgtatttttagtagagatggggtttcaccatgttgaccacgctggtctcaaactcctgaccttgtgatctgcccacctcccaaagtgctgcgattacaggcgtgagccaccgtgcccggctattttttttgtagttacaaggtctcattatgttgtccaggctggtctcaaactcctgagctcaagggatcctcctgcagtggcctccca

SEQ ID NO: 36551 - DNA, 1043 bp, Homo sapiens; identical to SEQ ID NO: 36550

SEQ ID NO: 36552 - DNA, 1043 bp, Homo sapiens; identical to SEQ ID NO: 36550

SEQ ID NO: 36553 - DNA, 1043 bp, Homo sapiens; identical to SEQ ID NO: 36550

SEQ ID NO: 36554 - DNA, 1027 bp, Homo sapiens
cgcgagtagctgggattacaggcatgtgccaacactcctggctaatttttgtatttttagtagagatagggtttcaccatgttgcccaggctggtctcgaactcctggcctctagtgatccacttgccttggcctcccaaagtgctggagttataggcatgagccatcatacctgtcctactgccaattctctgcagctgtactatttaacattcctaccagcaatgtacaagagttccattcttctcatcttcactaacatttgttatttttctttcttttctctcttttttttttttattacagccattctagtgagtgtgaggtggtatctaattgtggttttgatttgcatttccctaatgattaatgatgttgagcatcttttcatgtgcttattggtcatatgtatatctttgaagaaatatctattcaaatatttttcctgttgattgggttttttttatagctatgtgtttgttttttcttttcttttttaaatttgttttaggaaaaaaattctggatgctagttccttaacagatccatgatttgcaaatattttctcccattctgtgagttgtcttcattttctttctttctttttttttttttttttttgtttttgagatggtctcactctgtcacccaggctggaatgtagttgcccaatcatagctcactgaagcctcaaacttctgggttcaagtgatcctccaacctcagcttctggaatagttgggactatcagcatgtaccactgtgcctggctgatttttaatttttttgtagatatggagtatcagtatattgcccagactggtcttgaggtcttgaactcctaagctcaagtgattctcctgcctgtcttttctttctttctctctctctttcttttcttttctcttctctttcctttctttttctttctttctttctttctttctttctttctttctttctttctttctttctttctttctttttctttctctttctttttttctttcttttctttctttcttct

SEQ ID NO: 36555 - DNA, 1027 bp, Homo sapiens; identical to SEQ ID NO: 36554

SEQ ID NO: 36556 - DNA, 1027 bp, Homo sapiens; identical to SEQ ID NO: 36554

SEQ ID NO: 36557 - DNA, 1027 bp, Homo sapiens; identical to SEQ ID NO: 36554

SEQ ID NO: 36558 - DNA, 1034 bp, Homo sapiens
tcaaaatgtaagattaaaaatggcccagataggccaggcgcagtggctcacgcatgtaatcccagcactttgggagaccgaggcggacggaccacctgaggtcaggaattcgagaccagcctggccaacatggtgaaacctgtttgtactaaaaatacaaaaaaattagccgggcatggtggcgggcccctgtaatcccagatacttgggagaatcacttgaactcaggaggcggaggttgcagtgagctgagatagtgccattgcactccagcctgggcaacaagagtgaaactccatctgggagaaaaaaaaaaaaggctcagataaatacatatcttaattattcaatacagaagtaatgccattgttctaacataattattcatttttatcttgcaatctatttttacattcatatttacatgaaattatagacacaatatataatacagttgttttctattttttcactatgtgttcttgtgttctatcataatctttaccatattactatatagtctctataactcttgcatcatattccatcaagttgatgaaccatactcgttcattaattatggaacttttgcttttcatttttcactattacaaatactgttagatttaataactctatatgtataactttttaccttttcttattttgaattattttatatattgattttaagttttaaaaatgtatagcctcttccatgcttttgctatttgtggactgatatcttaattttaatattatttcttttcctcattataaaaagcaatactgttcttcatataaaatgtggaaatgctgggcttgtagtcctagctaccaaggaggcagaggtgtgaggattgcatgagcccaggagttaaaggctgcagtgcacaatgagcatgcctgtgaacagccattgtatgctagcctgggcaacatagtgagacccttctcttaaaataattttttaggagaaaaagaaaatgtggaaagtatgggaaagtataataacttttatatttaaaacctat

SEQ ID NO: 36559 - DNA, 1034 bp, Homo sapiens; identical to SEQ ID NO: 36558

SEQ ID NO: 36560 - DNA, 1034 bp, Homo sapiens; identical to SEQ ID NO: 36558

SEQ ID NO: 36561 - DNA, 1034 bp, Homo sapiens; identical to SEQ ID NO: 36558

SEQ ID NO: 36562 - DNA, 1022 bp, Homo sapiens
atgtgtgtaatgtatatatgtatgtatataatgggaaccaataatgggaatatatatgtataatgtatgtatataatgggaatcaatgtactcctatatatatacatacatatatatgtatataatggggattttccatatatacatatatagatatattattatttttttcttttttctgcttcttgcacagcagggctaacccatagggagtgtgcccacagtagcctgattcccattttaaaagaaagatttagtagtcagatattttggggcaaatattgtgtgttgtgggatatacattattcattttaagacacaaaatgttgtaatacagagttgtggcattgttttatcaacttttttcaaatgtgattatgttattcaaaactaagggaatgaatgtatatttatagagaggaaaataaaataggtagcttttcaccccttttatttcaggaattaatatgttgaattttgaaatgacttggtgtgaggatattgggactgtactttctgatttcttgtcttttaacaactatggtaatattttaaatatacagaattaacagttattttttaaagtttattctaaatcagggctgaaagctttgaaatcatttttcatgatttcatttgaaatgtctttgccatgactcacgggacctaattatgttgatatgacctaattatgttgatcactgccaggcttaagaaataagaaagagaaaagggtaaagtaaggataagtgacattaatattgcccaactatgttctaataataacatatcagttgcagataatcaatgtcttactctcgggcttaactactactcttaatttcttgtttagttgactttcctttctcttatttacctagtagaaaataataaaaacttcaaacctcagtgctatgagagggaagatttgcaagttcagttatgcttggtttcctgcatgattaaacaatatttaatcactccattgtttaagcattatgtgtacagtggcaagcaaaaaa

SEQ ID NO: 36563 - DNA, 1022 bp, Homo sapiens; identical to SEQ ID NO: 36562

SEQ ID NO: 36564 - DNA, 1022 bp, Homo sapiens; identical to SEQ ID NO: 36562

SEQ ID NO: 36565 - DNA, 1022 bp, Homo sapiens; identical to SEQ ID NO: 36562

SEQ ID NO: 36566 - DNA, 1035 bp, Homo sapiens
atctcagctcaccgcaacctccgcctcccaggctcaagcgattctcttgccttagtctcccaagtagctgggactataggtgtgcgccaccacgcccagctaattttttgtattttagtggagatggagtttcaccatgttgcccagggtggtctcaaactcctgagctcaggcgatctacctgcctcggcctcccaaagtgctggaattacaggcgtgagccacatgcccggccgagaaagcattttcttaatacctcccaaggtagtattaattatcctagagatagtgacttttgtcaaccatgaaagtataggtaacataagcgctagaagttcattaaagtaacttttaaacccaccttaaattatggagcttttactagtatattaagttggtgaaatctaaattcttttctacaaagtcattctgaaaactgctagcataccccaattgaagaaatatattacatttttgttttcttttgatccatgtagaatttgaacaagggtaaattggctagtggatagtgaatatgtgacttgtacccctagctacaattggaaccagcaaggcgttctattcagcaagggagtaatgttatttccatttagcttaaaatcattgactatttgtagattccccgactgtctaatcattagtctcaaaaattattgcttggtgaaagctttttttaaaaaaagcttcaggaaacaaaagtgcatttggtggtatatgaagataacctaaaacaggatatctgtttcatttatgggcctttgtcttattctttggtctgagatgatttttttctgagttgactttttaggtgccacgtgtgccaacgcatacacttgccatggttgtacctccccaggaacctgacagaacttcacaggagaactctcctgcccttttaggagtgcaaaaaggttagttattgaattatttttcttaaaatgggtattttttcacctaattgataaatccagaaatgtactttaatgatacagagttactgtgtacccatggcta

SEQ ID NO: 36567 - DNA, 1041 bp, Homo sapiens
gatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcaggtgggttaagaaatatatctgtaataatttctctttaatctgtgtgctgaacttctttatatacccctccaaaaacgtagactttgtacgtttccattttagaactttgtaaaattacccatttctcgaagtattttggaagtgaattaactatgctcaatagcactaacacacaaaagtgtgttttcccctcttcttttttgtcatattgcaaaggcaaagaaataaagttgccacaatcctttgttttaaaccgttggtatcaaaaccactgtgtgctgtgacttgggtaggagatctcaaagtagaatttctttgtaggcttttagaagtattcgtataagattatacttaaaattttcctgctgttgattttcatgtctggaaatttaaaatcacacagcttttttaatttgtaattttattagatcaacttacgtatttccaattaaatgggatgttcagataaaactaagtattccat

SEQ ID NO: 36568 - DNA, 1042 bp, Homo sapiens
attgtgcagaggaggaatgtcttagttttcttaaagaaaattaaaattctgggaaatgttttaaggagttaggctctttgttctttaatttgggtttttatatcttcagttggtagacacaaattaactttgtattattagcattgaaagttgttataaattgtgaataaattcttgtagttcatttggaattctaattttaatctgggtaaaaacagattttagaatgtgaagtatgattacgaataataatgatgaaactgatgaactgggaataacatttttaacatgtagtgttctgtaactagcattataatgttcctaattaagtgcacagtttgcagttatgaaatctgtgttactgattagttcagttatgttagaacttttttttttttaaagaatgtagaaatagctctaaaaggaacttgtaagtgttaaggaacatcaagttttatttcactgaagtatttgttaaattagtcttttacaaagtttgcatgaaacttagaaaattggcttagaaattatctttttattaatataaacaaaatttaatttgtgttagacattaatacctaccacattgtacaatattcttttattaataagttttaaattttaaatcagccaacaggtacaaaaattatcttcatgtaaaaacttccatttttgtgaaggctatgtgttttgaactatatggcagtaattatattttctttattcaagatgatgtacctgtcttaaatttaaatattatattttcttaagtcaaagtttgtcttaattttcttagttgaaggtaaaataaataaggcaagggtgaattaggttaatacctaatgctgtaattgtaaaacatattaacatattggtaagattatagagtaggacaaatatataattaattttacttaactctagttcttaccactcatattagtaaagaatactgtacatcttaaaattctactttagaattttactttagaagtaaattttactttagaagaattttagatgtatgataacagtacatttt

SEQ ID NO: 36569 - DNA, 1042 bp, Homo sapiens; identical to SEQ ID NO: 36568

SEQ ID NO: 36570 - DNA, 1042 bp, Homo sapiens; identical to SEQ ID NO: 36568

SEQ ID NO: 36571 - DNA, 1042 bp, Homo sapiens; identical to SEQ ID NO: 36568

SEQ ID NO: 36572 - DNA, 1033 bp, Homo sapiens
ttgtgataataagttgtttatataatttattaatgttgcaacttgattagctgattaacttagccctttagtgtgttgtttgatacgtgtcatacatgatgtagttccaaacagactatataaattattgattaggaacatggttcctcaagtccttctgaaagtgagcattgggtttttagcagttaccataatagcaagtgattctcaaagttcaaatgtctaggaatataaagtaatttaaagaaattcaaaatagcttttacctttgagcagttctagaaatacttagtaaaattttctttctttttttttttttttgagatagagtctcactcagtcatccgggctggagtgcagtggcttgatctcggctcactgcaacttccgcctcctgggttcaagtgattctcctgcctcagcattccgagtaactgggattacaggcacctgccaccacacccagctaatttttgtatttttagtagagatggggttttaccatgttggccaggctgctttcaaattcctgacctcaagtgatccacctgcatcggcctctcaaagtgttggttttacgggcgtgagccaccgcgcctggccaaaattttcaattctaatatagaaagaagattggttaaaaatcacctaatatcaatttatttacatttattgagcatttaccatgcaccaacttctatgataaatgctaaatatactttatttcatgggctaattataataatactttaaataagtccttttcccacctctatttttctgttgaaaaactgaagctggccgggagcagtggctcatgcctgtaatcccagtactttggcaggcagaggcaggcggcggatcacttgaaatcaggagttcaagaccagcctggccaacatggtgaaacccatctctactaaaatacaaaaattagccaggcgtggtggtgcatgcctgtaatcccagctacttggggggctgaggcaggagaatcacttgaacccaggaggcggaggttgcagtcagccaa

SEQ ID NO: 36573 - DNA, 1033 bp, Homo sapiens; identical to SEQ ID NO: 36572

SEQ ID NO: 36574 - DNA, 1033 bp, Homo sapiens; identical to SEQ ID NO: 36572

SEQ ID NO: 36575 - DNA, 1033 bp, Homo sapiens; identical to SEQ ID NO: 36572

SEQ ID NO: 36576 - DNA, 1075 bp, Homo sapiens
ggctcacacctgtaatcccgcactttgggaggccgaggcgggtggatcttgaggtcaggagtttgagatcagcctggccaacatggtgaaaccctgtctctactaaaagtacaaaaattagccgggcatggtggcacatgcctgtagtcccagctacccaggaggcagaggttgcagtgagccaatatcgcaccactgcattccagcctaggcgacagagcaagactccatctaaaaaaaaaaaaaaaagatttctttatttcttagtgaatactggtgaaaggaaaatatgatgtaaaacactgaattattatgaattatcaaatatattctgtcagaatttgttttgagatctgtgactcagtatgatttttattctttttaacaatttcagtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacggtaaatttttctgatttgttaactctacctgcacctttccttcttcatgcctggtacaagaatttgaagtatattaatccaagtacaagttgtgttaaacaattgaagtctaccacattatctatcttcaatattcaaaactgaaattcacccatgtcctctttatcatttgctagttaggaaatgagattattagaaatttttataggattcatagtctgaagttgaaaata

SEQ ID NO: 36577 - DNA, 1026 bp, Homo sapiens
taacagagacctggtatttccttataggcttaatcagatctctgggggtggggcctgggcataggtattttttttaaacacttccatattctaataggtaattagttgttttttgttttttgttttttaatgagacagagtctcactctgttgcttaggctggagtgcagtggcgccatgttggctcactgcaacctccgcctcctgagttcaagcaattctcctgcctcagcctcccaagtagctgggattacaggtgcacaccaccacacttggctaatttttgtatttttagtagagatggggtttctccatgtttgccaggctggtcttgaactcctgacctcaagtgatttgcccgcctcagcctcccagagtgctgggattacaggcgtgaaccgccttgcccagccagtaattagtattgaccctctgatttaaattcttgtttcttcatccagattgcatggatgatgaatctggctttctctctaaagccaattacctattccccagcccttacagcacacagtgactccagaagagttagctgcaagcagtagtcattatagtagtagtaactgtggctattattttgtggtagagattagtagaaggaagacctcacttcgacaatgaccgttcttgaaaacttttgatacttttctcctgattttcctatttccgactcatctttctcagtctcttttggtgaattctttttctctactatcttttaaataaataaatgttgatgtgcccaggcttctacactgtatcttctccccagatgatctcatcccacatttatttatttataaatagagatagggtcttgctgtattgcccaggtcttgagctcctgggctcaagcggtcctcccacctcagcctcccaaaatgccagaattaacagatgtgagctaccgatcctagcccatccccacactcttgaatttcacaccacccaaatttgagccactaactcagagttctccccatggcttcactatatctagcttcctcc

SEQ ID NO: 36578 - DNA, 1011 bp, Homo sapiens
tcccgaagtgctgggattacaggcgtgagccaccgcacccagccttgacccacgttttaaacagaagatgtttaaaagggcattaagagctggagaggatggtgaagttcagtggaaattaactgaggagtatgttcctgactcctctctttaaatttcagggaagctggaagagaagaaacctcctgaggctgacatgaagtatgtatcctagcccctggcatctgatcagagggagggggtctgtacatttcttgtgtctggcattttggggaggtgctgacatgagaatctggagaaatggtcagggggagtgaaggtgtatgtgtgaatttggccagctagtgatctccattttcccagtatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgaggtgagatgtgggcccttagtaccaggtgatggagttgcccctctctggaaatgtgagcaaggttgggtaaggaattgtttcaaacttgggggagggatgagtaggaatctctcatggtaacactaacttcacattttgtgttctttccagcccatggacgttgacaaaggtgagttgtacacacagcatctcacagttgctctagcagtcctgctttcccctggtagggctcagagctggcaacggtgggattgggggacctcctggttctgggttcttgtaagaactgtgtcttgctttattgaataggtggagttccctccaccttcctgggccatggcagggcatatttgctcttagatataattcctgtggccctggggttctgaggaggtgaggtagaggtcaagtatggaatgttc

SEQ ID NO: 36579 - DNA, 1029 bp, Homo sapiens
atgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactg

SEQ ID NO: 36580 - DNA, 1011 bp, Homo sapiens
ctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgcccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcagggtggacgctggagacaagaacctcagggtcacaagtttactgtttttctcccttttccatccctacattggtctgctggggaaggcggggctaggcatcactgacacacgcagac

SEQ ID NO: 36581 - DNA, 1020 bp, Homo sapiens
ggtcaggctagtctcgaactcccgacctcaggtgatccgcccgcctcggcctcccaaagtgctgggattacaggcgtgagccaccatgcccggccaccccatagacctttctataagactgctcacaataaagcaactggcttccccagagcaagtaacccaaacaaagacagaaggcatggtttttaaaataacctaattttggaagatactacttttgacatattctattggccaaacagaccaactctggtacaaattgggaagagactacacagagtaggaataccaagagggtggggctcatcctggggctgtcttggaagatgactgctatactctctcgaaagctaaggctttatagaaatgaaggcttaacacttctaaaaagaagtttacctaaaaatttgagtttcttggttgaaaatgataagatccttaaaaccatatttgactcaggtgctgtttcttcctgttagatattactgcaatgtctgtgactgtgtggtgaaggactccatcaactttctggatcacattaatggaaagaaacgtaaggcttggaggtagcttgtgactagggctggaattgggttttggaggtggggtggaatggaagggtagctttttttttcttctttttactcatcaaaagatggctggagtaagaagggtagtttctactgggctcttttttgatgcccctattagaactctccagttgtttcagcacaggccgtcttttacttcattatgtaatatttctggaggccgtgaggtaagaggcctcattctggaggccatgaggctttcaacagcacccaaaccatgtgctgctcctggacccagctggccaagggagtttcttttagccataattatttttgctgtgtgttttatgagatgtcagagaagtcaggaaaataatttttgaggggctgaggatgttgtaatgaacttgccttcttcactgttgaccctatgcagatcagagaaacctgggcatgtctatgcgtgtgg

SEQ ID NO: 36582 - DNA, 1064 bp, Homo sapiens
aagcataacaggaagtttcacctgggccggggttggaaggtttatctagtttagcagcgaagttctaagataaggtctgaaatacaatttacaccttgtaaagacgccactcccctggcccaagcactagttgtaaaagtcgatttgatcacaaagtgaccctgcgtggttgttttgggagcgcagtggctgaaggcgaaggaggtgggggtgtgtcgagacttgtggaccaggtgactgctgagaaggagaaaataagccaggtacacaactgcggaagagctctccagggttaggggaaggctgtgtccttgtcactgctgtgtgtccctggctgtacactccaattgtctggaggcggtggcgtgttggacagtcctggttgctgagtcatgctaaaacactgttgttttgactcactttgtgacgtaggtctttctcaccagtcaagaaaatataatccggagatagcctctgggctggctttagctcagcggttacttcgagtacattgtaaccacctctctgggtggttcgagacccgcgggtgctttccagctcttttactgctgaagttcagctccttttccatggggaaccatggagaaatggctgattttagcactgggcaggaaatacagagatggacagggtgcatctcacagtgctagaaagtaaggaagtgcttgaaaaccaaaaacaggccgggcgcggtggctcatgcctgtaatcccagcactttgggaggccgaggcgggcggatcacgaggtcaggaaatcaagaccatcctcgctaacccggtgaaaccccgtctctactaaaaatacaaaaaaattagccgggtgtggtggcgggcgcctgtagccccagctactcgggaggctgaggcaggagaatggcgtgagccattcgggaggtggagcttgctgtgagccgagatcgcgccactgcactccagcctgggcgacagagcaagactccgtatcacaaaaaaaaaaaaaaaaagaaaaaaaagaaaagaaaacctaaaacaaccaaactcttaactttaaaaatatttttc

SEQ ID NO: 36583 - DNA, 1052 bp, Homo sapiens
aatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccccgggagctggcgaagcgcggagtccgcatcgtctccagagggaagacacagcttttcgctgtgaatccgcgaagcggcagcttgatcacggcaggcaggatagaccgggaggagctctgtgagacggtgtcctcctgttttttaaatatggaacttctcgtggaagacaccttgaagatttacggagtggaggtggaaataatagatattaatgataacgcccccagcttccaggaggacgaagtggagataaaagtcagtgagcacgcaattcctggggcgcgatttgctcttcctaatgctagggatccagatgtgggcgtgaactccctccagagctaccagctcagccctaataattacttttccttgcaactgcggggcagaacggatggggccaagaatccagagctagtactggagggaagcctggaccgagagaaagaggctgctcacctgctcctcctcacagctttagatggaggcgatcccatccgaaagggcgcagttcccattcgtgtggtggtcctcgatgtaaatgatcacatcccaatgtttacacagtccgtatatcgcgtgagtgttccagaaaacatcagctccggaactcgggtgctgatggttaatgcaacggatccagacgagggaatcaacggggaagtaatgtattcatttcggaacatggaaagcaaggcttctgaaatattccaattggatt

SEQ ID NO: 36584 - DNA, 1066 bp, Homo sapiens
gcaagcttgggattatatccaagatttgtaattccaatgtacttacttctgtcagtgtaaacaaagtacgatttctggactagatgacttgggcattgtgggggaggtggaaattagaggtattctctgtttttcctgtaggatcttgcatttcttcctcttgctgcttgtctctttgtgtcgggaacaggccccccaaaatctggccataaactggccccaaaactggccataaacaaaatctctgcagcactgtgacatgttcatgatggccgtaatgcccatgctggaaggtagtgggtttaccggaatgagggcaaggaacacctggcccgcccagggcagaaaactgcttaaaggtgttcttaaaccacaaacaatagcatgagtgatctgtgccttaaggacatgcccctgctgcagataactacctcaatccatccctttatttccgcccatctcttcgtttcccataagggatacttttagttaatctaatatctatagaaatgatgctaatgactggcttgctgttaataaatatgtgggtaaatctctgttcagggctctcagctctgaaggctatgagacccctgattccccacttcacacttctaaaaaaaaaaaaatttttttttctgagcttggagaaatatatcccttagtacacttggcatttataaagcagacatcaataaatttatatatatgtgacagataccaacaacaatccagtccccttccctcataccttatttatgtacatatattttatataatagatataatttattaacaatttataaaattactttgttaatactctatatcattttctagctgaatttatcaatgataatgctcttttcccacttttatttttttcccattgaccatgcagcagttttgtgtagaccgtctgataacaactgatctgtttatctaggggggagaaatctaattcaatggaaaatataaataaaattgtgataaacttttgtaaatagagtggcttttaactacacttgagatggctagcaaattcataaagtgaatttactttctt

SEQ ID NO: 36585 - DNA, 1035 bp, Homo sapiens
ttaacagtagccatttttagtggttgaccaaaaaaaggatttatattttcaatgccagcacactcgatgttctgttgggaaaaataataatgatttttgtgtgcttctccatatggtataatggaatgatttgtggatggaaataaaactgttctaaaatttttgtgacagctggtttaaaaatcttaagtgcctaggcacattcttgattgagaagccacagttttaggccataaaagatgggggaaagatttttatatgagacaattttgtgagtgttactttttctttgtctgaaccatagtgaaatctaaacaaggatcttgtgaaacttattttaaagaagcagtttacttcaatgggatcttagataatttcaccagaaaatggatcaccgaaaccagaaggctggtgatcattatttggtttgggccatataagaattgaaactaacggcttagctttaggatttttaggacacttgttgataatttaggattcataattaacatatgtgttgattgttttctgagactaactgggcaatgggtttggatgtgtttacatttattctgattccagtcataaaattatgtcaaggactttccttgtctttttatgtgtatgacagatgtgtatgtatccatttcatctaacaagttaaagcgttcagctataatttaaaatttgtagcttcactgttttatagtacctaaaattggaatgtaatcagtcagaagacattcatccactgctttcattccagaagtattatgctttttgaagcagcaatagcataggaatgttgaggagactatactatacttttatagcatatttaatctcgtagatcacttttcaatgaattataaggctgatgacaaatgagcaaattgtatcagttttctttatgacatgtaacagagtatagctgtgatcatgaattggatagttctggtgtaaaaatctgctttatccccatataagatgtcaggttcagaaaagcaaacacatagtttcgaagagatgttgatc

SEQ ID NO: 36586 - DNA, 1078 bp, Homo sapiens
caaaaaaaaaaaaaaaatatctagagatgggagaatcatatggctggcataaaaaggtcaagtcaaagatatgtaagattaaggctttacgatgctccagttctagtaaaacagaccaggtacttgttttggtgtgaaattgccaatataagtatagtactgtacatattagttgtttagcttaggtaagtcttttaatctctttaaactccagtttcctcatctataaaataaagagaatatctactttgcaaacttgttgtgagagtgaaaagtaatgcatataaagtccctgtatggagcaagtactcaataactatttgttgaactaaaaatgataatactgatattcaccatttattagcatccctatgtgccagacactgtaaacaattaaaagttatcattctggtacccagagtacagtatgagacagacatgcaaaaaaaaaaaaaaaaaaagataatggagatctgcatagcataagatgcagtgggaccaaacgggaaaaaacacctaaatgagcctggagaaaggaagaaatgatagaggtggtgatgcttgagctatgatctaaaggttgagtagtagcttgtcagacagtaaaggggaaaggacagggcagggaggggccattgcaagaaattccatgcagagggattatggtatttcattatcactgaaccttaaactgtgtgtgtggccgggtacggtggctcatgcctgtaatcctagcactttgggaggccaaggtgggcagatcacttgaggtcaggagtttgaaaccagcctggccaacatggtgaaacctcatctctattaaaaatacaaaaaattagccaggtgtggttgtgggtgcctgtaattccagctacttgagcagctacttgagaggtcgaggcaggagaattgcttgaacccgggaggcagaggttgcaatgagctggtgtcaggccactgcactccagcatgggcaacagagagagactccatctcaaaaaaaaagtgtgcgtgtaaaacagacagtctttgtaggagatgaggtgaagcaagtaggcaggagttagatcctgagtta

SEQ ID NO: 36587 - DNA, 1029 bp, Homo sapiens
gggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaagctgaacgtttctgtataagcgatggaagctcctggcatgtgtgcatgaagtgatgagctgaggtgggtgctggaagaagggcggaatcgggaggccactttgtgtcattgcgcgtctagatgtttccgaattgcgtgtgtgtgtgtgactgtgcaatatggttgtgtatgcttgcaatgccgttgtgcctatgagacagtgtgcgattgtgtgcctatggatctgtgtaccgtgtgccattgtgtgatcggtccgctgtgggggtggggatctgagtgcggcgtgtcagtgtgcagtggagtgtgcagt

SEQ ID NO: 36588 - DNA, 1047 bp, Homo sapiens
ctcatgtttgtcacagctcatccctgctgctttcgtgctgtgtactttggacaaatgacttgacctgtgtgacccttggctttctcatctgtaaattggtgtcatcagcagagctgagcctgggatgtctccatgacagggttacccctctatggggagctgtggactaaggccatatcataccctgaagagaggagcattttcccatgttgccaaagaagatctgagccctagggctgtcccatagtgagaagtaggaagtgggcctggattccagaagtcccaatgccatccctgtgctctgtcactactgctcatatgaaagggtctgcacgcaagctgtcctcagtaccatggatacttgtctctgttcttcacaatgctggtgccttttcttctggccttagcccacacgtcacccccacagacaggctttccctgactccttgtcttgtcaggaccccttttatgctctgtgtaactctctgattagtttccttcttggcatttaacatcactagtaattactctatttctctctgtagttgtgttttgtctttctaaacacaagatataaacttcatgagggcagaaattatgtctgtcttacttgctattgtatgcagtgcctggagcaacaagtaagtatctgggtcaacctgtgtgttttttttaggctggagcgcagtggtgcgatcctggctcactgcaacctctgcctcccaggttcaagcaattttcatgcctcaacctccgagtagttgggattacaggtgtgccccaccacgcctggctaattcttgtatttttagtggaacagagtttctccatgttggctggtcttcaactcctggcctcaagtgatccacctgcctcagcctcccaagtgctgggattacaggcatgagccactgcacccgaccctgggtcaaccttcttaagcataacataaggagagacaggagacagggaaaaccaaggagtctctgggataagagctagctcaggtcttctgcagacctgtcagagaagaaacacctttacaaa

SEQ ID NO: 36589 - DNA, 1039 bp, Homo sapiens
aaagtgtttaagcctgagtgtggtccgaaggtttagagcagacacaggatgggagctttgatggtggaggcggaaagaaagatcccaggcaggagagacaattgaagcaaaggccttgagttgagaattggccgtgccctcatcctttcctgtttcctttttgtttgggcaatgaaaagagcatggactttggggttggatgtgcctgcattcaggtcttgacactgctgtattaccgctcccaatttcttcatgaaacaagattaacagtatcacttgtatcagttagggtttgttggttatgagcaacctaaacccactctggctaacttaaacataaaaggaatctattgggatctattgacctgccaagcctcagaaaggacaggaatcagggaagcttcagagacctaagaggcagcagctgatagtatcttcagagtgctgctgtcagaataaacctacaagggctgttttctctccttgtcccaaccagatcaaggttcagattcctgagaaagaacctccgtggttaggaagaacacaagcacattgattgacagcactaggggaggtgttgttcccaatgggaaatctagatgctactaccaagagaaggaggaatggtttatagtagggcagaacccactgctgtccatggcaaaccagtgaaatatttagaagatagaaatatatgcaaaggccaggcacagtggctcacgcctgtaatcccgacactttgggaggccgaggcaggtggatcacctgagatcaagagtttgagacaagcctggccaacatggtgaaaccccatctctactaaaaatacaaaagttagccaggcatggggtcaggcatctgtaaacccagctacttgggaggctgaggcaggagaatcgtttgaactcaggaggtggaggttgtagtgagctgagattgcgccactgcattccagcctgggcaacagagcaagactccatctcaaaaaaaaaaaaaaaaaatatatatatatatatatatatatgtaaagtgtctggca

SEQ ID NO: 36590 - DNA, 1048 bp, Homo sapiens
ttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggtgagtgccattggcagggtctgttcaaggtctctgaggcctgtggagcctgaaagtgaccaagatgccttcttttccttcctccttgaccacaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtact

SEQ ID NO: 36591 - DNA, 1050 bp, Homo sapiens
gtttttttaattgggagagtgaatatgattcatgtagtgaatgtaagcacttttcatatagtgtatttaatccttgcaacaacctaataaggtaggtgctattagcatcccactttataggtaagaaaactgaggcaccatgaggtagagtcacgtgcctgagttaacacagctggtaagtggtagagccgtgatgggagtgcagacagtctggctatgcagctggacacccagcctctacctgatcctgttcctcccaggagcatagttctcagagagaggagagacaatcgaggatccagagctggggcaaagagcatagcgttttttgttttgttttgttttgtttttttgagacggagtctcacactgtcgccctggctggagtgcagtggcgcgatctcagcgcactgcaacctccgcctcccgggttcacatgattctcctgcctcagccttctgagtagttagggttacaggtgcacaccaccacacctgcctaattttttttgtatttttagagacggggtttcactatgttgggcagactggtctccaactcatgacctcgtgatctgcccaccttgccctcccaaagtgctgggattacaggtgtgagccaccgcgcccaggccaagcatagctttttaaaggagaagagtttccttttctgtcagccctcccaggcagagattcaggaaggcacagggcctttgggaagacaaccctccaccttcgcctccttgctgtttcagggcaacataggagcccgactcccaggtttgctataactggcctgagtgtttcctgtagccttcgttgtgcatgctttcagccagcctatgcaagagaagcctccacactgccctggctggaatctccctgggtggagggatccccctctcctttgtgttgggtgagctctgagcctctggcatttcgtagttgagatcccttgctatggggcgggccaggactgggccttgaccgtgtgtggatgaagtcccagcatgcctgacttcatcttcctcctcccttagcatgtcagttc

SEQ ID NO: 36592 - DNA, 1085 bp, Homo sapiens
ttgttgaccagatgtaagactatgttgtagagaaggcaaaatggtgtcattgaattattcatttattcatcttttcattcattcaacaagtacttaataagtgccaggcagggtggttgctatgggagtaagaaggagaaggagccccagctgctgccctcagcgtggtcacatctgtcaggatgtgaaggttgcaggcagccccacagggaggctggctggagatcagggcagcgaagagtgtttaccacaggggttgcctctgggcatagggaaagaatgggggctctgtgggagcagagggcccctaacccaacttggagcagggaggaagcaggggggtggtactggattaagttaattcattcatttcaacagatgttactgagttcataccacatgccaggcacctctgctgagacccaaaggctccataggagtttggcaagtggaaagagaatgaaggtctgggcaaggggtggggaggttttcaggcagaagcactgcacactgaaaggctggaagagaaggtagagtttcagaaagactggagaatggagtaggggatgggtgagatatcacggccagaccctataggccattggaagggagaggcaacagatcaagtcctgggaggcggagttctagttcaaggccatttgtagcttattgtatagcattagacaggtttttagacctcctcagacctcagtttcctcatctctaatagggggctagaaatacccacacgccttcttctcagtgttgtcacgattaaatggtttgaaaaagttaaaaatcctctgcaaaagcaaggagtttgcactgttattcctagaaacactgcttcctcctcctgggtccatccccattcctcccttaggaggtccaccatgcccctctgtgcagcttgaggtaggaagtgtcaacctcagaggagagttggaagaggagatggccaggactggggtttcactgtgacttgggagactcggggtcttattgcctgcctcagggaagatcccacctcccagcccaggcccagaagccctcctaagatacctgccaccctttgctcaagtgac

SEQ ID NO: 36593 - DNA, 1079 bp, Homo sapiens
gtttcaccacgttggccaggctggtcttgaactcctgacctcaagtgatcctcccgctttggcctcccaaagtgttgggattacaggcgtgagccactgctcctggccagttttttgttttcttattaaagcataattttacttaaaataaactacacatttaaatcatacaaggctagcatggtagcttacacctataatcccagcactttgggaggccaagataggaggatcgcttgaggctaggggtttaaaaccagcctgtgcaaaatagcatgactccatgtcttaaaaaaaaaaaatcaggcatgatggcaagtgcctgttgccctagctacttgggaagctgaggtagagaatcatttgagcccaggagttcaaggctgcagtgagctatgattgcaccactgcactccagtctgtacgacagagtaagaccccatctctaaagaaataaaactaaaatataaaataaattggacactttgcttagttttaacaaatgtgtagacccctataattgtcatctcagtcaaaatgtacttggtttgattttgaagtgaaagagaggttttaatttatgtgcccatctggtttacactagcatcctaagaatcgcctcaggttcagaactggttgtggaatcatcaaacctatggtgttttgtatttccctccaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcaggtatgttttaactgtgaacccaaacccccatccccagtctctccctcacatttcactctactaccagggccttatgacttcattcttcaatttggaagtattcatttagcagatatttctgtgtcagtgactatctcaggccttggggctgtagtagtgaccagaagagac

SEQ ID NO: 36594 - DNA, 1050 bp, Homo sapiens
tttgactagtcatcaaatgctttctccttgagcccagagaggcctcagaatcttcctcaacatggcacttcggaaagctaccctctgatgaagtagacacaggagtgaaatgtgtttgccgtttccagtctacgtaaggaatcataaatcaggcccttaacgtcgatttaattggactttggtggcttagtcttcttcagactaacagggataatgataacagctacctcacaaaattgcagctagagcagataacaataacttcacggggttattctaaggatgaagggaacgaatatcatgctattcaaaattgttatatttgttacactggtgtataatatatagaaattgagagggttagaaacttttatagtgatttcacataattttatgtcaaatctaataaaaatttagactttttttcatttttctaataattgattgttagctgactgtggtggtgcacacctgtagttctagctattcagaaggctacagcaggaggatcttttgagcctcagttgagactagcttgggcaacgtagtgagactctgcttctaaaaaaattaaatcaagcaaacctggttatatcttataaaagtgttgatctttgacgtatcagagaaaaaataaactgggcctttaccataaatagtttgagaaacagtgggctaatacatgtaaaatgcagaatggggctgggcatagtggctcacctctgtaatctcagcactttgggaggccaaggtgggcggattgcttgagtccaagagtttgacactatggcaaaaccccgtgtctacaaaaaaatacaaaaattaacgaggtgtggtggtgcacatctgtagtctcagccactcaggttgctgaggcgggaggatcgcttgaaactgggaggtagaggctgcagtgagccagattgcaccactgcactccagcctgggggacagagtgggaccctgtctcaaaaaaaaaaaaagaggaaaaagaaaaatagtaattattaatgctattattattgtagttattacttgctaatgttagca

SEQ ID NO: 36595 - DNA, 1053 bp, Homo sapiens
ttacaaagttatataaaagttaattttccatttcactttgtagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagaggtaaatgttttgggacagacttggaggccatcagacttgcaaggatgttatgattaccttaagaagccttactagtcaattttatgacttacaaaacacatgctggtattattacaccttcttacgtggaaggtggaaatttcactattagatcttgttatcgaccttaaatgtttgtagacttcccttttcaaagtatttgcttacagtgaccattgttctcacattgtatccacctcaaaattgaatgggttgtaaggagggcatactagagctatggtcaactcttacctcatctatgtgattaaaaaaaatcaaatctgatctctcagaactatttatcctggaatgctgcacacctgtttaagatacactcaggaattaatttgagtcaaaataattagacagatatattgcttcttgacaaaaatcttaatatgttttaaaatcaaaatacatcttagcatttgattctattgttctaatctgttatgtctgaactgaacatagtgggctccagttaaggaaactaggactatatgtaatcacttttttttttttttttttgatactgagtctctcttgcccaggctggagtgcggtagtgcaatctcagctaactgcaatccccgcctcccaggttcaaggaattttcatgcctcagcctcccgagtagctgggattacaggcgccagccaccacacctggctaatttttgtatttttagtagagacagggtttcaccatgttggccaggctggtctcgaactcctgacctcaaatgactcgcccaccttggcttcccaaagtgctgggattacaggcatgagccaccac

SEQ ID NO: 36596 - DNA, 1072 bp, Homo sapiens
gctagaggttcaagaccaacctggccaacatggagaaaccccatctctactaaaaacaaaaattagccgttagccgggcctggcggtgcacgcctatagtcccagccactcgggaggctgaggcaggagaatcacttgaacctgggaggcagagattgcagtgagccaaggtcgtgctactgcactccagcctgggtgacagagtgagactcagtctcaaaaaaaaaaaaaaaaaaaaaagcagaggttgtaagtatacagtttggtgaatgttaaggtttgctttttgctgttttttgttttttttgctttttccttttgagacaaggtcttgctctgttgcccaggctgaatttggagtgcagtggtgtgatcacttctcagtgtacccttgacttcctgggctcaagtgatccccccacctcagcctcccaagtagctgggacttgcaggtgtgcaccactgtgcccggcttttgtttgtttgtttgtttgttttgtttttttcagtttttgtagagatgggtctcactgtggtgctcaggctggtctcaaactgctgggctcgggatcctccaacgttggcctcccaaagtgctaggattacagatgtgagctattgtgctcagcctattaaggcgtttttgaaagtgactagcagtagacataagtgtgtaaaacctgatagggaggagtttttcttgtttgctttttggggaaagacagaagaatggatgttttagaggaggtatggtgacggttgtggaggacaggctgtcttttatcctttggaaagtcatttaaacagaggcaggtgtaaggcactcttgttcttgggtaacaggacatgtctaacatctttcccctcctctgcttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattc

SEQ ID NO: 36597 - DNA, 1727 bp, Homo sapiens
actcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattctt

SEQ ID NO: 36598 - DNA, 1030 bp, Homo sapiens
tttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgcc

SEQ ID NO: 36599 - DNA, 1024 bp, Homo sapiens
cttatttgagtagtttggcagatgtcctttagtcttgttttctctttcttcattcattaattcaatatgtattgattagtatgcttaaagcatacatgtatgtgaataactctcccttaaaggaggataccatggggggacagtgagatccagaaccactcggtgtgctaaggacttttcacgtcttatctcagaacaaccttatgaggtgggtaggaaacctaagaaggggtctgtgaaaaaatgggtagcggggggtgattcatgaagggccccatgtggggctgccagagtgagaatctcagctctgttgcttgctctcggtgcaccttgggcaaatcactgtgcctctctcaccttctgttttctcatctgtgaaacggggataacagtgcctgtctcatgggattttgagagtcaaatgaaacaatgtttgtaaatttcacagcatttctctgatacacagtaagatctcaataaaaggtggctatttttaaaattactattattaggtactgttatctccttgttttcaatatacagaacctgagccttggggaagctgcctcagcttaggtcacacagcgaatacagcaaaggatggagatgtcttttttttttttgagacggagttttgctcttgttgcccgggctggagtgcaatggcgcgatctcggctcacagcaacctctgcctcccgggttcaagccattctcctgcttcagcctccggagtagctgggattacaggcatgcgccaccatgcctggctaattttgtatttttagtagagacggggtttctccatgttggtcaggctggtctcaaactccggacctcaggtgatccgcccacctcggcctcccaaagtgctgggattataggcgtgagccaccgtgcccggccaggatgatgatgtcttaactgccattaggtggcacaaatagagtgccacgaagaggctcaagggagagaagcagcacctgtgttgtatgggtggtgggcagtgctgcaggtggactggc

SEQ ID NO: 36600 - DNA, 1031 bp, Homo sapiens
cataatggatgatataatggccagtcatgtctcaccagtcagcttcatcaaatcttgacactttaccacatttatttttgaaaaaggaattaaagcattgctgattcatatcctctgataaagcaatgctagggtaaaggaaaaaggaggcgaaactgtttaaaacaaaagtgacttaagacacctaatgaaatgcaatgtgtggacttgggttgggacttgatttaaccaaagcaattatacaaagacctttttgaggccattatggaaatctcaatgtgggctgcctatcagatgatatcaaggaattattaattttgctaggtttgataataccatggtgaagatgaaaaaaacgttattagcttaaagaagataggaatttgtaggagagaagtttgtctttttaatgtttctactttctgcctccttaataaataacagtgttaccttggcagtttcatctgggcgttgtttctctcctctctatatcatcccccaagtctactgaattttgaggtcccagctggtgtcagagttttgctctgcaattgcttttttctggctcagtctgtgtgtccagttggagtgagtctgctcagaaagtggattcttccaccttgggaaccctgtgcatccagagactatgggacatattccttttgactcaatgtttcacttgggatctggcaaacatagacgtatctcttgagggctaggagtgccactgatggggccacattatcaatccctgcagaagaaaacagcaggaacaggctgatggcttgtgaaatatttttcaaatttcttccatacacaatcaaggaaaaaggaaaatgcagaagtggaggccccagcttctgttctggctgtattgtttgccttccaggcaaagagagtatttgtgtgagaattaagggaaagtgtctcactgtgagcccaatcccagaaggtaattccatatgaagtttattctctgcaggcactgttgtgggcgtgccagaggggagggcggagtatgggaggtgggc

SEQ ID NO: 36601 - DNA, 1061 bp, Homo sapiens
ttgcattgtggtctgagagacagtttgttatcatttctgttcttttacatttgctgaggagtgctttacttccaactatgtggttaattttggaataagtgtcgtctggtgctgagaagaatgtatattctgttgatttggggtggagaattctgtaaatgtcttttaggtctgcttggtgcagagctgagttcaattcctggatatcctttttaactttctgcctcgttgatctgtctaatgttgacagtggtgtgttaaattctcccattattattgtgtgggagtgtaagtctctttgtaggtctctaaggacttgctttatgaatctggttgctcctgtattgggtgcatatatatttaggataattagctcttcttgttgaattgatccctttaccattatgtaatggccttctttgtctcttttgatctttgttggtttaaagtctgttttatcagagactaggattgcaactcctgcttttttttgttttccatttgcttggtagatcttcctccatccctttattttgagcctatgtgatgggtctcctgaatacagcacactgatgggtcttgactctttatccagtttgcaagtctgtgtcttttaattggagcatttagcccatttacatttaaggttaatattgttatgcatgaatttgatcctatcatgatgatgttagctggttattttgctcgttagttgatacagtttcttcctagcatcaatggtctttacaatttggcatgtttttgcagtggctggtattgttgcttccttcaggagctcttgtagggcaggcctggtggtgacaaaatctctcagcatttgcttgtctgtaaaagattttatttctccttcacttatgaagcttagtttggctggatatgaaattctgggttgaaaattcttttctttaagaatgttgaatattggcccccactcttctgacttgtagagtttctgccgagagatccgctgttagtctgacgggcttccctttgtggataacccgacctttctctctggctgcccttagcattttttcctt

SEQ ID NO: 36602 - DNA, 1050 bp, Homo sapiens
gttgaaataaaggtggtcttttttgataaagaatatttgtattataaatgaatggatcttctaatttctcagtcttggctaacattccttaaaattaaaaacattcttacacctccgtattttcattttttgtgtaaaaatagattataaagtgtctttttctgttgtatgaatttttaatgtcatttttggcattttaattttaaaaattggttaaatatgacatatttaaaagtgtacattttgcatcttttagaactcttcagatgctgcctttggcaagagaaaggaaagcttctttcgccgctgatgactgaactaacatgagggctgaagtgtgcagcacatccgtgaaatcctagacagctgtaccaaatcccactcgtttgctaagagctgagctgagtgacaggggactttaattagagcagcttttaggaggactgagaaaatgaaaaaaaaaaaaaaaaaaagtgcatttggctggattggcctgacttgtgttctgacgtgcctctaattaaatcatcactgtttctttcctcagggatcaacgagcaagggctgtatcgaattgtgggtgtcaactccagagtgcagaagttgctgagtgtcctgatgggtgagtgccgcagtggctctgctaggcaggtccctggatggggggcccactctgaaaagtcaccaggtctgtgagtagatacagcctgtggcaaaggaatcggggtgtccgtgagctgtcacctagaagtcatctgccccatcggtcagttgtcatggcttcagacactgctgggaaaggttctgagtaggactggacaaaataaaaaatgccagggcccagacaccacaccctctctgtctgtaggctcagtgctctggtccaagtggcactcagtcactcatgtgaccaccacaccctactctgtctttaatagcttatgactccctccgttctcttttgggacaggtatttagtgggacacacccaatgcccaaggaaaggcatcattctgggctccagaggacctcagagttcatgttcctgat

SEQ ID NO: 36603 - DNA, 1034 bp, Homo sapiens
aaatgtatgtgagatcaccaagcataatgctccccagtgaaaacaggactcatcgaatgccaagacgctcagtcatggttgattaccagaccacagaaaacctggcagagctggcacgtcagtagcagacacgtacatgtatttgatatgcatgctcacccatagctgccttggagacaaggtgctgtcggcagaccagaagttgggaaaaatttctgataggcttaggatctggctggcactgctgtcaggaataacaataatactacaaaatatatttatagtgcttttcagttttcagagccacttgaaacagtttgcagagtgtttcatttgattttggcactaacccaaatcatagcacttggcatactgtactatagttgcccattttcttctctgattcctgctctaagctgtaacgtaggtcaggcccacacctgtttcttgttcactattgtttccccagcacttgagggtgctctttccaggtgtgtgataaatacggatggaaagcatgatgagtgcagggcaactactatctcctacattttctaaatgagggacactgaggctcagagggcataagtggcctgttcaagtctgtgtggcagtccttttttttttttttttttttttttttttttgagacagcatctcactctgtcacctgggctggagtgcagtggtgtaatctctgttcactacaacctccgcttcccaggctcaaatgattctcctgcctcagcctcccaagtagctgggattataggtgcatgccaccatgcccggctaatttttgtattttcagtagagatgggatttcactatgttggccaggctggtctcaaactcctgacctcaagtgatctgcccacctcagcctcccaaagtgctgagattacaggcgtgagccaccgtgcccagcctgtgtggcagtcttaacctgtaagctcctgttcaagcctggacctttggattcaaagttcagtgctctttctgttgaatcagtacccagaagaaggagcattgtg

SEQ ID NO: 36604 - DNA, 1032 bp, Homo sapiens
gctctgtcttgaaagctcacaccagggacactcatgagctcagactccaggactcaaatagtagctgagttcatctcagatctctgtcatttcttcgatcttttttccgagtacaaacaaaacaggcaactcatcttatctctgaatactgtgctcagagcacccagcccacagcttggcccatattaggaattttttttaatggaagagtaaataaataaacacaatcatgcctgtggtagacctcatgggatcatgaaataactcctcattatgcagaaatgaaccctttatgaattgagccattacagagctatttgagaaacaagtggcacactatattaggcataaagtcatgtggtgactgaaacattcttgctgtgaatcaccttattaaatacctttttgggtgatgaacatcattctcgggaaaatacagtgggccagcttcaagatctcttagctcatgagtcgctaaccctaagaagataggcagtgccactctgcatatgactaaactcttacatcatacaccacaaatttcatgtgctctttgatcttgagagaaacacttcatcttaactgacacttagtcatagggataccagtgacagaaaggaagaggctctgaaagaatttgccactgagtttatgagttgaactgacctggcctccaatatgaagggaagacagtgtttccagtagaaacatggcccctgtacttgtgctgccaaagccctaattttatcagttttttcaacaattatattttttattgtggtaaaatacacataacataaaatctaccatgttagcctttgctaagtgttcagttcagcagcattaagtacattgatcttgttatgcaagtgtcaccactatccatcttcagaactttttcatcaccccatactgaaactctgtacccattgaacaataactttccattctgtcctctcccatatatatatatatatatttaaaataaaattatatatatttaaattatttctgaataataggaataggtat

SEQ ID NO: 36605 - DNA, 1085 bp, Homo sapiens
tgaatggatgaataggaatgtgaataatacacatttatcagttgatttagctattggtgatgagaagatatcatttaaaataagtatttactgagaaggagaaaagtaagtatggcttctcaatctaaaacataggattacatattttttcctacattttacagctctttttgtagaaacaaagcaatactgacagaattttttcccagtacaacagctacttaaaaaattcctccccagtacagatgttttcttttctaaatgtgttaatttacattacttgatttacattaaagatgagtcttgtgaaatgtagagccatgacaaaagagaaagcaaaacatatttggggtaaaaggccaaatgaatgtttagacgtccaagaattctttgttataaaaagttagaaaggattggccaggcgcggtggctcatgcctgtaatcccagcactttgggaggccgaggcgggtggatcatgaggtcaggagattgagaccatcctggctaacagggtgaaaacccagtctttactaaaaaaacacaaaaaaattagccgggcatggtggtgggcgcctgtagtcccagctactcggcaggcctggacgacagagcaagactccatctcaaaaaaaaaaaaaagttagaaaggattttagtaattaaaaaaaaaattacataggtaatatatatgagaaggaactatacactacatttttaaaaggataagaaaataagtaaccataaatttgccaccagagataaaatcactgttatcagcttgtgtgtgtctttctagactagcactgtccaatagaactttgtgcatatggtctatatctgtactttccatttcagtagccattagccacatgtggcttttgagcacttgatatctggtaaataggccagagaaattgattttttttttgagacagagtttcgctcttgttgcccaggctggagtacagtggtgcaatctcagctcactgcaacctctacctgctgggctcaagcaattctcctgcctcagcctctcgagtagctggaattataggcatgtaccaccacacgtggctaattttt

SEQ ID NO: 36606 - DNA, 1784 bp, Homo sapiens
aagtgatctgcccgccccggccacccaaagtgctgggattataggtgtgaatcactgcgcccggccgagagggaccattcttattttgttttttgtttgtttttgagaaaggtctcactctgtcatccagcctgtggtgcagtggtgtgatcatggcttaatgcagcctcaaacttctgggttcaagcagtcctcccatattggcctcctgagtagctgggactacatacaggtgcatcccaccatgcccagctaacttattttatttattatttttagtagagatggagtctccctgtgtttcccaggctggtctcaatatcctggcctcaagcagtcttcccacctggacctcgtaaaatgttgggattacaggtgtgagccaccgtgcctggccctgctcttacttctactcaatattttcatataggtatttcaggagccagcagaggaagaacgagatggcagaaaaaagaaatatcctagtccccagaagactcgttcagaatctagtgaacgaaggtttgtgtttatctttaattaggaagacattgataactcactttttagttgccttgcaaggacattaaagggatttttaatatatatacttactcctctctctgtaaactcattaaagaaagatgttacctttcttcctttcattctttctgttttttgtcttttgtcttactttctgttccttttataaacagtcattattatgtgttttccccaagagctcaggggtgggagcagtccccttagagaatattaatgaaatgttccatttggttaggggtgcttagtattaaaatcatccaagtcatttttttatgacaagtagtacaacttgtatattgaatcatcagcctaacatcaaaaattggtctttgtttaggaacacttttttttgagccttttttcttttctatttcaaattttctgttttcccctgcccacccctccccatactttggattcacctctttttttcatttctccccacccagtataattgcaggagggatgttttttctctgtatatatttgattagaggaattatgtggtagatttgcaactttctaaaaaagcatagatatgcatttggatgactcaagagtagtatttatactatagatttgtttgcagacttggtttctatagcctgcatatggcttttatatctgtatattataggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttggtgagtagatgagtgtccccctaaaaactctgtagttatttatctgtctctatcacaggggtgcaagaaattctcttaaagttgtacctttaatatgtctgagcagtgtaaaaactggaattgtctcaagaagctcaatatccattttgttagaaaacagggctctattctggggatggagtcaagggagtttgattaaaaaggagctattcaagtgtatcattgtacatgtctagacttaactcattttgtataatggatacaaatatcctttaatcaataaagctatcacgtgaggaagagggttgcctgcttttcttctttgtttggttttctaaaagtaattgatttgctgtaagggtgcttgaagtttataaaattaaatggat

SEQ ID NO: 36607 - DNA, 1083 bp, Homo sapiens
aaatctctaataggaatgtcattgtgataataatttattaaaatttctgtgccattgttctctgaggaggacagtacagatgccccaaatgattaattttcaacatcatttaacattttattagagggagacagttcttaatctagtgatgccttttttgtgtgtaattccatgagctgttttcaaaacctgaaaaaaggggaaaaatgggggtgggaggaagagaaggaatgccaaccagcagttctagttcttatattagatatctcagaatcacctgtgctttaatggcattttattattattgcctcattatagcttctggatgttttgtgcaagaaggaaattagcttgtgaatctgaagttaggaggagcacaatattcgtgggagaggtttaatctaagagtattgggggtgagacgttttctggattgaggacttctgaatcctagttgtgctgcttattggccgttgactcaaatgcctgtagtggccaggaagatcccctaaatgaggataatttgctgatcttatattctgaatcacttctatactgtaaatcatagaagtgactgacgtgtatgtgcgcgtgtgtgcttttttatttgaaatatggtttatgtgtgaaaccagctgttctcactctagtttgaagaagtgtacataaccaaatgaatacattttcttttcacctcaattaaaaaggtacctagaaattggagatatgatggataacagaggaaactcaattcttcacatatggtgtttgtgtatgtgaaaatttgtattaacaaatgtgcattgggctgggcacagtgactcacacctgtaatgccaacagtttgggagactgaggtgggcaggtggctgaagcccaggagttcaagaccagcctgggcaagatagtgagactccatctccgtttttttaaaattagaaaaaaaagtgcattgacatttggattaggtaattaatatatagagtagaaatgagtaggtgagtgaatctgaaagtatcagtatttaagaatggatgcatatatctatattctgtaataggagcatttttttttttttcagtt

SEQ ID NO: 36608 - DNA, 1050 bp, Homo sapiens
ggctccaaagggcaaaatttagtcttggaacagggactgaatcttttttcacagcaactcaaaatgagacaccttttgcattgcaacccagtatacacacacgaaacaaaagtttacaaaacaatacctacccaatatgcacctgatattttcatcctattagataaaaattcttgtcaggacccactatatggctttcaaaattacagtttggaaaaacagcctattgagttgcctgatggagtgcattttaaagtcactgtcttccttgccgtgacattgtagaaactattttgaatataaaatgttattactttatcttctgtttttcctttttttttttttttacttgatgttttttcttgaagggtattttgtagtttttaattttagaagcaagacaactcagtgacgttttaaacttgcctacagttttatatttttgtcattacttgtcttgggaagggagtggaatattaatatattggtgctacattttatgcaattcaaatcactctgcagtacttatttgtatattttttaaaaagctgtgaagtccataaaactacagctctttcttcttttttttttttttgagacggagtctcgctctgtggctcaggctggagtcagtggcacaatctcggctcactgcaacgtccgcctcccaggttcaagcaattctcctgcctcagcctcccgagtagctgggactacaggcatgtgccaccacgcccgactactatttgtatttttgtagagatggggtttcaccatattggctaggctggtctccaactcctgaccttgtgatccacccgcctcggcctcccaaagtgctggcattacaggcgtgagctaccgtgcctggcccacaactacaactctttaagggctataaatcaataaaagattatttggctttgaattaaattttgcacttaatttagagttcacttagccatcaacaatttaaagtgaaccaattttgatatctaaaaatatatattctaacattgtgccattgaatttcacctttttcaaacatat

SEQ ID NO: 36609 - DNA, 1023 bp, Homo sapiens
gtgctggaaagtaagaggaatgggttgtaaatattttttgtcatctccattggtgttcttttccacttgaaatttgatgcccttatttattttcctgactatagtactttggatcacaattttagcaattatctgaatactataataatatttaaattttaattttctgagctacagtatagatctgtggggtaaatgggactaaaaattaagaatatattttaatcccagttgagcataaactcattttgtgcaagtttgtgaaaaatgatgaagaaatcctacttctcagggaagttgggaacaatgaccagatacattttcagccagtatagtagattacaaatgctaaatggtatatgtatgggactgggcaaatgttgcatgtactttgtatttttcacactgttataaaattatattaatatgatactgtaccctaaggctaggtctatgctagaccaacaattcattcctgggcccctgaagatacttgtttggccctgctgtctatttagccaaggtgagtccctcattaacaagtacgaaattgctcacatcttcccagcctaagtgagtttttcattattagaagctagaaaaagatactgacagattttgttgtcagttggattattgggtgatttgtattaaatagtgtgcttttgtttagaacaaagttggcataaagattgggaaagcactgttttcattttatttcatttgacaaattcattcttagtccgatacaggtagacatttttttctttacatcaaaaaaagatgaagtatttgttaccaatgaattaccaaaatgaattttattttggaactagatgggttatgaataaataacaaaattgttttgtaacatgtgagaattgaaactgaaaagtatgaaataaggattttagtttttagtttgattttaaatgcaattactaggaatgggatgttttattttcgatatttaaaaataatgtgttagcagaacccaaatgatcctgaatttcacattttcct

SEQ ID NO: 36610 - DNA, 1040 bp, Homo sapiens
ttctaatttctgcttctggcctacctttccagccacacaactcactagttttgttggtatgcctactgtttcactcattaattgcttgccttcaattttctaaacaattccttttggttctttactctttgccttattcatacttttctcactggtttatttttttcttctaccccttcctgctgtttttcttgttgaaatcttaatttttcaaggcgcagcatcccaatataaacttttctataccctctcacagttagaaatgttctttgggtcttgatttttactcctatatgtttatcccattttactttgtattcatttttgtatttcatttaagtattttcaagcttcttgaagataagaccttttgacaaatttcttgcagtgcatagaatggtcccttaaatacttaaattactgaatgtgtaaatgatgaatgaatatagtaaaatgatttatgaaggagtgatacatgtttttgttttatcttttatcagcacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtaaaccaacagattataatggtctttccagctatgttttcatattgtcagttagtttgttctcatgtgtctgttgcgtttgaaatttgccttgaatctcacctgtttgaaacgtttttgaaagattcatggctaactgcaatattttctcttaagttttggtaaatgtcctttttttgttgttgtttacatgtcctaaaattagagccacatttaaagctacacttattttggataatgccctcaatgagttaaaaatgattatcttttcatgtaaataatgttctaaatgcaata

SEQ ID NO: 36611 - DNA, 1016 bp, Homo sapiens
cataattttctatatcacaagctgctattattattgttgtttttaaaatttgagacagagcctcactgtgttgcccaggctggtcttgaactcctgggcttaagcaatccttctgcctcagcttcccaggtagctgaggattataggtatgtgtcattgtgcccagctcaccaaacccccttttctattcctaagtatcttagtatcttatcccttttagcaaaatgaatgattgctacaaatgatatatgaatgacctgaaagatttaatgtgccttcgaagtcagtaggtcatcttcaaatcagatagttacctgattggtatagcaaggtatttgaagttgtgcattacataagattcaaatcaaagatataaggaaagacattttatcttcatggttaatacttgggaatggaatatcttaatggcttattctctgaaagttcttagaaaattacgtcaaaacctttgagtgacattatcttaatttttttcatagaaaagttagaagagaagattaaagagccaattaaagaaccctctgaagagcctctgccaatggagacggaggaggaggatcctaaagaagagcctataaaggagataaaggaggtaaagggccatgacctgttaacctgggagccacattaattgtttcctacagcttacttgtatctgagtatctattggatagatttaaaaataattgttataaatttgatctctgaaattttaggattcttgcaagttcttaattcagttttttctttgaaagtgtcattaaattacttcttgtactaaactgagatccatagaaagacagggccttggaccagagcttggacctgatctctaaccttctgacttataaactgagtggtatttgttaaaattataagtgtaacttcttacttggggaatgttagatatattttatctgtcctttctgctgttgtgttcttgcatagcatgatccatgtatagcactaaaagagttttttattcagtgaaggat

SEQ ID NO: 36612 - DNA, 1051 bp, Homo sapiens
attaaatttaatgtaaagggaggataaatagaggaagtgtagaattatgctttgtttaatgttttataaagggatgaatattaagaggtgaatatattatgtaaacagtaatttttaaaaagaaaagtttgtgaaatatatgcaaatgactttgtaacaatatttgaaatgtttttgccagggcacccaactccgacaatgctgtcgatccaaaagtggcaattctctatgagtgcaagtgagtgaactaaccataaattgcagcttctttttaatactattaaagcaagtgttctggtagtgattagcagaaggattcattcctaaatattttaattaaattttgtcttatagttaaagaggaacaagaattaatggaagaaattaatgaagatgagcctgttaaagcaaaaaaacggaagtaagtaatacatacgatttgattgaggtagattatatcttttaaaagtcgatttggtaataatttgtgattggaagggacaggtaatgtgaatgttgttaggaggcatgattgctctcttaggcctgataataaatagctttgtttttcattgtagaaaatgtgtcccttcttttgctagatttgtagaagatttgggtattcatatatgtattatgactccaaatgatagttttggaattaattctttttggaaatttattaggtctcaattttatgaaaagttagtttcctccctcatttagaccccaatggataccattccagagatctcataaaaacagacacagacttctccctctttatatggttatcttacgacttacctagtccttgagtctggtcattaactccttggtgaggagagaacccataagcttaggaagtgctctgcgagaaagagactgctaagaagtagaggcattagcttggccagtgctctagagttgggtaaaatgtaaatgttatggcggggggaaggatggggtagagggtatgcatgtatggggaatgggaccattatttagcagcaaaaaggaaagtttgaagacattaacaggaactggttaa

SEQ ID NO: 36613 - DNA, 1027 bp, Homo sapiens
tcacagactatctcgctaagttcctgcaggtcacggactatgtcttctatttcttttgattcattgcctaagttgctaagtacctctcacttgcatttgtgggttagccttagttccatttaaatctctggggctacctacagtttcctgtatagcatgcttttgaatttccacatgttctgttttcctaattcccttaagtttgtatagggaataagagccaatttttaaaatatacttagcagatcatatttaagaaggaagatctgctaaaatacacccagatattattgaattacatacttttttggattatttacgtgaatgggcctttttcatagtgcatatatttgagaggtgccgtgattccatgtttacaatttcacttgagtaccacacagaaacagggttgcccttacacctgaggtgcatttttggaggaacaagaagtagtttagtcattgatgaacagttctaattccacctaactactcctgggcccatgttgctctctgggacctgtccttcaacttaaatctcaacttatcacccagaaagtgagtaataaaaagtcaggtaggtaaggtatatatcttacatattcacttggccaagattgcagatattttagttttatttttaaaatgaatgtttgagattactaaaacattataccacttaataccaatttttattagattttacaaaatattttatgtgtttataatgtaaaacattttggaaaatactgttttttctatatttcaagaactaaaaaaattatattttgtgctgtttgattctgacacatagaggtttactgcagtgttaaacttttttttttttaagtaaggttgctccctttttatgttattaaccagtgtcagggagagacagcccattaaaggtgtatttttttcctaataatgtagccattgtaaatcattagaagcccattttaattttgttattatgaaagttatttatcccttagagttcatttgaaaccctcaatataatttgtttt

SEQ ID NO: 36614 - DNA, 2314 bp, Homo sapiens
aatacgtttttattttaaaggtgtctgctttttcaacgtgggagaaggagttgcacaagatagtttttgatccccggtacttacttctcaatcctaaagagagaaaacaggtaaaaggaaaatggcattaactaagaatgtatatctcttgccaacatagtttttaaattataaggaataaagtaccatcccttttttttctgatacagcatttcaaaaatatagtcttgcatcttagaacatattatgtgtctgtgtgtggacatttctacttcaaaattcttggatatttttgcccttatgagcatggctgttgtcttgtaaacattttgtccttatgcctcatatacctaggttatgtgtagtatggttttaaaattgatttcaaatgcatttactaatttgcttgtttgggccaatgatgcaaatttagagtagaaaaatagcaaaatacagatgagtaaaaaggataaaaaagctactgtaatcccaactaatagatatgactaccgttgaacactggtttattattgaatactgaacagccttcttgaccattatgtgtcagtatgtacatatatatgtgtgtgtgtgtcctgtagatagtacttgaacataggtttatgtcttatacacaactgcatatacaaagttcacatctaagtagcatctgttaaaatatctgtttccatcataaactcagaaaaacagtggatacttaagggtccctgttgaattagtgttgctttttattcccatgatgattcagtgacacatatcatttcgtgattgcctcttctaaagcattgcacacttccaacttacttaatttctgaattacctgaactatcctgacactgatctccataaaatggtgagtatgtggaaccacttgctatagtgctgttaagctgtaagatttcatttggtaacagtagtgcccatctttgatatttttaatgtaacaattgaaataattcttcacatggtgtgtaccattatgcatgtaggtctaatcatggacttgaatgaagggagaaaatttacaatgtgccagatatgtattttagtacttggaatagaaagacataacttccttaatgtatttgcatcttcattttaagctttgtatcttttttaaaaaacaaactctgtgtgagttttttattctcatttcagtttatggctctatcaaaatttataaattagccttgattccttacttttcccacttcccctttacagtcttatcagcaaatctataatctaccttcaaaaaattttcaaaatctcaccttttattaatcatttcccccattaacaccctaatccaagccaccataaacaacccttatcatctgtgtagcctattgttgatctccttcattccatctgttcttgttcctctttagtcaagttctttttccacacagcagccaggctaattttaaagtttaagtgatactaaattaagtcactgttcccttgcttaaaactgtttagtgctttccatttcattgagaataaaattgaagctcttttcatggtctctaatattctacatagacttacccctgtatacctcttgatggtcttttttaatgtctgttgattacagccacactggccctgatattacttgaacaagccagtcattctggtgtttgctattccttctgcctggactgtttttcctccaggtgttagtacagccagcttcatttcattaaggtacttgtcccagtgccttctaatcaatctaagtattgtctctttgccttttctaatttctttatggtgctcatggctctaattgtataaaattatgtttttattatttgtctcctcctcctgcaaaatataaattgtatgaggctagaaactttgtcttcattgctttatttgtagtgcctggaacattgcctaatctaaatatctctgaaggctttaaaacttttatgacgtattcctcctggtactgagtgttatagtgaaattagaagtaacatattgagaactatagttctttcccaatttttgaagcattctataagctgatggtggtatctccttaatagaattacgtttgaaaagagaaaatattattctagtgttctgttttcaataaaatctctagttaaaagttctcatgccatttatttatttatttattttatgcatctatttatttagagatggagtcttgctctgttgcccagactggagtgcagtggcgccatctcatcttactgcagcctctgcctctcagggttcaagtgatcctcccaccttagcctcccaagtagctgggatt

SEQ ID NO: 36615 - DNA, 1016 bp, Homo sapiens
gaaagttgatgtcatagaagtcaaaagtagaacagaggctactgaaggctgagaggggtagggagaacttgggaggataggaagagatttgttaaaggatacataattaaaactggataggaagattaagtcctggcgttgtgtagccctgtaggatgactggttaacaatagtaagtagtttcgagtagccagaaggaggatattaaacgtttttccaacacaaatgataaatgtttgagattgatatgctaattaccttgatctcatcactacatgatatgtatttaaacacatttcgattgcacatgtattgaaacacagtaaccccatgaatatgtacaattattatttgtcaattaaaaaaatccctgcccttgaactctaagagaaaacaccaaaataaacttttaaatatctcatttgttattcagagctttttaatattgacagtattacagtatggtaatatgttaccaacatgattactcggaattgtcaaccatctgggccactgttactgaataatttgtcattgaatcagtgtgaaattaaaaatatgagaatcaaataatggagacttacttttagtaaatgtattttgaaacagaaaagataaaatcataagtgaaatttcacaaaatgaatatatcatgatccaaaaaatggaacattccaagcactccagagctgccttgaaggcttaaagggtatagccccttaatatacatttttgttcatgcctataaaagtgaacttaacagaattatttttaaaatttactcattttcattgtattatgaaattttgttcatgagttgaagttatcagaaaataaccacttaacatagggaacataaagccaagcgtattggaaagcatgacacaaattaggagcaacttggaagcataacacaacccctaattttctatgagatattaatcttagagagtgattcctaaccttggtctggggtagcccagcagagggaatacgaagttctttctagattctca

SEQ ID NO: 36616 - DNA, 1062 bp, Homo sapiens
tccctagtattctgaaatgccatagtggtatttttcctagaggaagggtctattgtgctcagtacttggctgaccttttcagtgtggaaactcagctcttttagttacgggaaattctcttgtgttactttaaaaaatttgtttccagttttctctgttttttcattctgggacagaatttgaatttgccttcatggattggttcttcaactttttctctttcctgttaattacctttgtctttttatttaactttttggataatttccttgcctttattaaccaactatttagatttttaaaatttattgtgtcttttaattcctaagagttcttttatgttttttgaggtttttcttgccttatgggtgcattatcttagctctgtgaggttgtttaggaacatttttttcttttatatttttatttttctgtatagtttctgattccactaagtttgttctctttagggctctatttttcatgttggagagtttccttagatgtcttgtagaccctgactacttaagtgaagcactaaaatgctgtttgggtactcttttttttttttgcatgtagagatgggattttgccacgttgcccaggctggtcttgaactcctgagctcaaatgatcctcctgccttgccctcccagagtgctgggattacaggtgtgagccactgcccggcctatttgggtattcttagcatttaggtgggccctcgtgctttggggctgtactgcagagtggtggttctcaaccacgagtagttttgcccccaggagacatttttgtcaccattgaagtgagtgctgctgggatctagtgggtagaggccagggatgctggtatacatcttgctcaaaacatcactgtgccaaggttgagaaacatgctgtagggtgagttaggctggtttgttgagaacccctggagccaatgttttaggctggtcagattcccaataaagacttctaatctggctggagggcacagatctctctgcttcggatctgagagaactaactgtgtcttagtatttggtatgtgtttggttaa

SEQ ID NO: 36617 - DNA, 1930 bp, Homo sapiens
cctcagcttctcaagtagctgggattacaggcgtcagctactgtgcctggctggagtctcactgtgttgcttaggcttgtctcgaactcctggcctcaaatgatcctcctaccttgccctcctgacgtgctgggattgcatgcatgagccactgcacctggccagtaatagttgttttaaagttattgtctacttagaacgacatctggacatcttgggtttggtttctattgacttcaaaaaattttttctatggatcacgtttctttgtatatttagtgatttttgattgaatattggactttgtggctaatatatagagactctggagtctgttacctttcattgaaaagtggatatttttgttttagtaggcagtttatttactggttgccaccttaattttaggcttgactttatgttttgttaatgtgaatctctgaaagtgtaatatgtttcttttagccttccagctctgttttccttgtggatcttttgtggactttgttggcctgatcctattctccctttaatactactgactctctgttatctcttctatgctcttaaccctgtagtagcttgatatatagagtgatctttccctgctgttacacaacttggccttagctgtggactcatgggtaatcgctaagtcagatttttcttgggtaccctctctttgtagattcctcttcacccaagctctaatctttgcttcctccagttcattaagactatggtactctagttggacttgagctctctctgcacctcataaatttcccttctttcaggcatttcagtcttactctttctgttgtctactccttgaaatcggttgcctcatatacttttgtccagttttatagttgtgtatggagagctaatccaataagaatttttctattatggctggaggaaggacttagcttcatcgcagagtggaaattgatgagctcttgtctcttgaggcatgcaaattctttactctgtgatctctttctttttttttttaataataatatttattctcctaattctatgctgatagcatacaaatcccttaaccacatttttgctcattacctctttttactcctttctgaaacttactgttcactgttaggtagatgttgagtcccagtgtctctttgtcatatactcttgttggaaaaatggtatcttctgctatgcctttatacaagcagaagtaactgccaaagttagcacacttgtaattttgttacagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaaggtaagatggttttagttccagtggtgtgattgatgggagtgtgaatgggaaaggtctatgctggtgttatgtttctaaccttattcattggcataaataataggacgtacatggactgttcttttaagttaacttttataattatttatgtatgtatgtattctatcactttacttacataatgcttattttagtagcttcactaaactatatacttttgctttaaattgtgttaatattaagatgcctggtaaactcagaacaggttgttaggactgcctgctcagtggtgccttctaagatttcaagattctttataggttgtaatatttgaatttcaaaaagcttctttatcttttttgccctctaaaagatagcattttagtgactttctattctttcagtaaacatatcttacatataaattattgcttatcagaattaaaggtcagctattaaagattaatgaattccaaatgtcatttgatagcagtgtcaggagtggagaggagcttaccactggggag

SEQ ID NO: 36618 - DNA, 1467 bp, Homo sapiens
tacttattgaccaggagtggtggctcatgcctgtaatcccagcactttgggaggctgaggcacgaggattgctcgagaccagcctaggcaatatagcaagacccccatctctacaacaaaacaaaaaaatagctggttgtagtgatgtgcttctgtagttccagttactctggaatctgaaatgggaggatcgcttgagcccaaacagtcaaggttgcagtgagttttgatggttccactgcactccagcctggacaacagatgggattctttcaaaaaaaaaaaaaaagaaaaaaaagtctacttattttgtttgccaaagtaactattcttaagctattttattgtaatatattattataaccaatttttataaaattgtggttcaaatactttaccttttgaaatagcacatttgaggttgtatgtaattggagttaatacactgttacaaaattgacatatttttctcttccctctcttttaaatttcctgtgcataaattatttttgttatagtaaggaatggggagaataataaggccttgaattgcagctaatggtaaatgacatttttttgacatttatgcagctgtcaggcaattgttctcatactgatagccttagtaagccatttataacctgtcatggtaatatccacaatgaaaggaagttaaagtttaattttatttaaagttcacttgtttatacatcacacatttaaaaacctatatgataatccttactttataggtttcgtgtctaatatatgaaaattgttttaagctaatacaaattcctgtggcttagaaagattcctatttgatataacttgcatgttttatttaacataaattttgtaaattttgccttccagttgtcaaatgcatctaggaatttggtgttcatcatgtcagatacaaagtagacaagatgaacagaaaaatttaagttacatcactacatcaggtggtttcttaatcagtgtctggaaatactgggtttatgagtatttcttattagttcaaagtgaaaggccaagtttagtagtggagaaatccacagccaattagctgttgtctttagaaacatttctgatgcagatattctgtttcttataaccttaaaagtattttccagaaagaacatcaacttcacttttttttttttttttttttttttttgagatggagttttgcttgttgcccaggctggagtgcaatggtgcagtctcagctcactgccacctctgcctcctgggttcaggcaattctcctgcttcagcctcccaagtagctgggtttacaggcacctgccaccacacccagctaactttttgtatttttagtagaaacggggtttcaccatgttggtcaggctggtctcgaactcgtgacctcaggtgatccacccacctcagcctcccaaactgctgggattacaggcatgagccaccatctcactttta

SEQ ID NO: 36619 - DNA, 1900 bp, Homo sapiens
caaaatttttatccatctagtttttaaataaatcatttttaccttgttgatattaaagaattgtcagcttcataagcctgactcttagctaaaaagaaatgcagctcgatgtaaatttatattccctatgaatacatggcagttctgagatctaaagttatcaacaatctgaaaaagcctttttctatattttaataatttctttataaaatattatttatcttgaatttggcaaattttagatgaaagcctatatgcttgtcgatgtttacatttctagtaaaagaacacttctgatcttttactgtaattctactctaaatgcctatattttaaaagttattattctcatatttaaggtaggtgaactttttttctagttgtaaatatttaagatatgatgaatttctcatggtacattattttccctcccatcccactacctgttttaaaatacagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaaggtaactgttgtgtttacttgtattgctttcattgaataatacaattcttgtgtttaagggtatatgttgttgttggggatttttctattgggggtttggattttttcttgttagtattcttaacataagagtctagttgatttggagatgagaggtacacagtgtttaggtatattctgggcaaaaactagatttggaattttttatttggcaagctagttattctgtaaaaacatattttgatggagttggtaagaaggataatgtagtttttgcttttacagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtatacgttaatcttttactttttttctctaaagtactggatattggaaatttattatgttactgttatgaatattttaatgttctttaattctgagggagataatttgctaaattagaaagcatttaaaaattgaatacttggtattagtactgttagtataggaaaaaacccaagttattcaacaaattcagaagttaggcattttgcatatatggaaagtcataatcatttagtctcacaactttattatttattgttcttgatgaaagtcattgtaaactattacacacttacctgccatagtgataaacaaaacgtgctgaacacaatttaaccttttcgttgatgatttagggccatcattgtgatgatcagttatacttgcagatggtatgagattgtaggactggaggtgtaactgactgcaggagataccctgaaactttgttgaaaatctttctcccttacccctcagagttgttgaggtatgtagggttttttgtccctacagtgaatgaccctagactaccgtcctacttgctaatatattttggagttgggggtggcttctctttgtcatatctctcctatgctatttcttttctctttttcagtggagcttgctactcttgtcacttctgatttcttcccttgcatctgtttcttactctacccaggagtatccaatcttttggcttccctgggccacattggaaggagaattgtcttgggccacacataaagttcactaacatggctgggcacggtggctcatgcctgtaatcccagcactttgggaggccaag

SEQ ID NO: 36620 - DNA, 1035 bp, Homo sapiens
gtgatatgcaagattactttgatatgagcaagctgaaaccaatagaaactaaagaaaggcatgagaaacttgaagggcagggaagcccttgaccagataggatcattgagaatatagggaagtttcaagtgagagggggtatttttcacgagggtaaagaaaagtaatttgagtttgggatgggaaggagatttgaattgacgagataggagaacactttttggaaacaactctggtttaagaatgtgcttgcaacaccaagacaaaagtaatgcttcctgtggctaaggtcagctaagcaggcagccacagagtgactgtaatataccaaaggtggccatagaccactgcatgggagcctaaattaaatggaccataaatcctaattggtgaaggtagggtgtggtcagatgcagttctatcagagcatctagaagcctttctccaagcactagggcattgctctggaatgcaggaagacaaccacagtgacagaggactgacttgatgatagaatgtttactgtaacctgggaagtctgtatcccagcctgaaccttgacactatttaatcttgggcaagtgatttgtcaccttatcctctctggttctgtttgttcatcttaaaaatttgggatcactagatgagcttcgatgtctgtgaatatgaaccccctgaaatcgtgtatgtatttctgcttgcatgagtctggaaaacggatgtgccactttcatcgtattctcagatgggtttgtgacccacaaaaaattgagaactgtgtgattaggtagtgtctctggtcctcttcaacttttaacattctgggattctgtaattctgtcatttctgacatttccttaaggttcagagtcttagggtctagaagttgctaagcctataggtaacacctggtaccgcaaagtatagtctttatatataatactctcctccttatttattcaggcatagctcagagatactgcaggtttggttccagactactgcaataaagcaagtcacaaagtttttggtttc

SEQ ID NO: 36621 - DNA, 1036 bp, Homo sapiens
tcccatgaatcacagacgttcttaacagcttctagaatgtgtatcctttccagaaggttttgaatttagtttgcccatatccatcagaggaatcacagtctatggcagctatagccttagggaatttatttcttttttttttttttttttttgagatggagtctagctctgttaccaggctcgagtgcagtcgtacgatcttggctcactgcaacctctgacaccctggttcaagcaattctcctgcctcagcctcccaggtggctgggattacaggcacatgccaccacacccagctaatttttgtattttcagtagagatggggtttcactatgttggccagactggtctcgagctcctgaccttgtgatctgcctgcctcggcctcccaaagtgctgggattacaggtgtgagccaccgggtccagccaggaaatttgtttcttaaataatatgacttgaaagttgaaagttcttgatctagttgatctattagctgcagaatggatattgtgttagcaggcatggaaacaatattaatctccttgtgtatctaatggacctcttgaatgactaggtccattgtcaatgaacagtaatattttaaaaggaaacttttctgagcagtagatcttagtagaagtcttatttagtatactatactgtaaacagatgtgctgtctttcaggctttgttgttccttttatagagcacaggcagagtagatttagcatcattctgaagggccctaggattttcagaatggttagtgagcattggctgcaacttcatgtcaccagctgcattctctaacaagataatcagcctgccctttgaagctaggcatttacttctccctagcagtgaaaatctgatatggaatattattccaatggaaggctgtacgtactgaaaatctgttgtgtagtgtagctactttcagccgttatctaagttagatcttttggataacttgttgcagcttctccatcaacatttgctgcttcaccttgtgcttttccgctatggagacaa

SEQ ID NO: 36622 - DNA, 1034 bp, Homo sapiens
agctggaagaggttttgattcctcatttaatgatcacacgttacatatgaagaaattgatacttggagaaattgagtgaataagctaagaagcaacagtacaaattaaagcacaatactcatgattcctggatttttgctctttctaagtaatgcatatttatattatcttcagaagttgattatccactcatcttgagaaaaagatgttctgtgctttttgcacagaacaaattaatatttttattaatttgaatgtgatgtgtaccattatgatacctctgcttgtgtgtgtttgaaaataaacattgtttaacctgggttttagtagggggtgtgtttttttagtctacttcgttctgtttgcttttcaggtactttgaactcaagtaaacaaaagggaagattttctcgttgatactggagactgcacaacaatggggccacgaaagaaaagtgtgaaaacatgtatcatgaataatgaaattccagaagaaatgacagcagatgaaacaaaggactatatgaatcaactttcacatgaagtactttgccatatttttaggtaagattgtgtttggttggcttacctgcctggaatggataagagcaaaccctgaggcagtgctgtctaatgtggtagctaccagctacatgcagcatttacatttcaattaagtaaaaatgtaaaatttagttcgtcagttgcactggctacatttcaagtgcttagtagccatatgtggctagtggacacggtgtataggacaacagagtatagacaaaatatttcttttgtcacatatagttctgttggacagcctttctctagactgttaacatttctaggcttcttgggatttttattggctaatagatttgttgacttttgttactgcattataacagtactgtgtgtttacactgcacaatataaggcagtgtttctgactttttctgactacaacccacagtgagaaacataacatgtaagtgattgtaactaagttttctgagataatacccatcataact

SEQ ID NO: 36623 - DNA, 1027 bp, Homo sapiens
ttggaggttcgaaatttggccagaaatggcagggtttctttttttacaattctctcatcagcttctgactttctaaaaatccttacttaacaatgtaaatcttttagagtagttttcagatgccatcagtgtctttgcaaaatgagggtctgctttcatttccttttaggtcaccagtagttataattcatcttaagatattaatttcaatgcaaaaacaaagcttagatttacttttaaatcagtaattatcatctcagataatactttataatgtatagtatataaatacttcactaaaaatgctatggtcaaacacttgtttttgttcctcgtctttaggtggttttagaaatttgcacactattgttctgggagcttgcaaaaatgctcttgaagtagatcttggttacctcatcattactgctgcccgtaggtatgtttcctctttgtattgtgtctctcactttagaagtaattatgtttttccctattttacaaaaaattgtggaatgtgtgtgtatatatgtgtgtacatttgatcaagccttgttcaaatttaaaatacgaagaagtccaaataacagataagtataacatcatggtagtcttaatgttataactggtaaccagttgagctgcatactagcaagctccagagtggcatggtctcatatcagagaaaagcagtggaatttctggaaatggctgagagtccaatagaagttagcattgaagctctggtgtctgtagccctctcaggaccattgtctccatctctggatgattttctgaattgttctagttacttggtgataatatttgctattcagaaatcagtgttttaaatcagcttttccaaagtctgaccttgtaacacctctatattttttaaccaagtggttatatcactttatgccacatttactatttcttacatatcaatggtctacctccacttttattttataatattttctttaagcatttttaaaatttattcagaaacaaagctttttccatcaag

SEQ ID NO: 36624 - DNA, 1047 bp, Homo sapiens
atttaaaaatgatttatattataccaaaggatcttactctgtatacactgtcctgtagcttgttttttgtactaagtataatttggagagttttccatgtcagcaagcatattaagctctccttaattcttttgaaatagctacataatgttctattaaataaatatgccataattttttaattcagtgtcctattgttgaaaagccatgtaggttgttgagtggatcacatttaaatcagggctgattggattcaaattaatgttccccaggccatttagttctcacaatggaattaggtatgtaaacatcataatttagaatcatcgggttttagaagtcatgaaaaaaaggaaaagttattttaaaaaaaaggatttgaaagtctttgtgacctgtatcaaaattcatcagtaatggggaaaatgttacttagattttctctggtcatgtcatttctttaacagaccactcaagatggactcgattggttgatatcaacctagtacggtgccatgctttgaagctggactcttttggccagtttattgaattattacccagcctagagtttatttcactggatcagatgtttcgtgaaccacccaaggtaagatacatttgagggagtttttgtttattttgataggaaagaaaataaaaacagcctgtgatttttttttttttttcttttcaatgatatgcctttacggtgttacagtcggactttttactgccagcctcagtgaaggcataaaggttgtaataatgcatagcctctcattcttctaaatgagaattaagggttctctggggaagggtaaggaaaaaataagtggaagctgtctgttagtatataaacaaaaggtaaggtaagggtgaggctggaaatttaagacagaaattattacgtgggataattcattggtggattaaatataattaggttggtagattaaatctaattaggaatccaaagtataaacaagaattaaggatttatttggggaatgttttactttgctgctatctttctgttaagttgta

SEQ ID NO: 36625 - DNA, 1046 bp, Homo sapiens
gtaattatctgtccagttcattaatatatattgaatacttacggtgtgccaacccatgtgtgaaggtgctccatccatccttctgttgatgagtgaagtgatgtgagattgttttgttaccaaattttccagtttcccagttgacgcttaggaactggaaaaggaatcttttctagccatccttttgttgttccccatttgcctactcttgcacacagtaattaatgagaaatagggtgccctgatatgtacctgcttttacaatgaaatgtactgtgtacagggcatgatttcctttaggggcactctgagtatacagttcctgacaaaagaatcatctgtaggcaatgtcttcactttctcatctcacttggtccctatagaactctccactttggctcttggcaaagtcactagtgattgtcttactgaatctggaggtcatttcgccactttcatctaatttgacatctcagcagcattagacattgttgcctagacttgtacactcttgagacactttattctcttggcatctctgaaacgattttgctggtttttctcctacctcattttcctttgcttgtagcacctcctgtattccacttttgtccatgatatctttctctacacattttcactcaagctcaaggttttagtaccaactatatggtattaaatccaaatctttgtttccagccttaacttgtatacttttctgaagtaaatgcagctatatctagctctgtactttatgtccatggtatactcttaagcatttcaaacctaggtaaaatctttccccaaccagtctcccttaaaaatgcaaaaatgaaagtgcagagccaacaggtgttaagggaaagagagggcgagacagtcacgtattgtctctttgctttgttgtcctgagtgctatggtacatagtacaggttactaccactataaagatctgcacttcagaggacatggactgtacgtgggaaacttacagcagctgccattcagaactacccaaatcctgtgaactcatttgtggtttgag

SEQ ID NO: 36626 - DNA, 1048 bp, Homo sapiens
tctgccatatggtgaaagtacttttcccagcttaaattgtaaatgtttgataatatcttttttttaattggtggtaaaatataactttaccattcagtgtacagtgtataattcagtggcactaaatacattcatcttgttaggcagctgtcaccaccaaccatctgaactttttcatcatcctgaactgaaactctgtgtccattaaacagtatctgcctcctatgacaccttttgttgtgtggtttttcgtatttgcaaagtcagatatgcatgttttcctttatgagtttatttttatgctgcgaaaggcctttcctacacttggttcagataaatgtgcgcatcttcttattcctttattcattgatttcagtttagttccttagttcagttggaattttatttcaatatgtgggagctaatttttttttttttattccaaactatcaccatcttgtttcaatattggttatggatgtccattctcgtgctatgattttgaaatgctcttttatcatctactaaattctttgacatacttaggttgatctctggtcattctattctgttctggtgctctgtcttctttcattattctttttcaaaatttccttgactagccatgcatttgccatttatttttatagatgtgttttgtaatatttttatcaagttccaaaaactaagcttggtttttgtttgaaattgcattcaattgataactgaaacataattgtcattttaacagcactgtgtcttcctgtttagggactgttatgtttgtcgttttacttatgtctcttgataaaattttaccgttttttgttgttttgtttttaatacagagccttcatattagccattgaagttttgatgttattttttgccttgtgttctgcttatcccttaactattttattcttttttcatgtctagaactttttcttaagttaaatcattctctggatttaaaataaagaaaatatcatttatgtagtgctttttattgcttttattatgtgatttttttcaatttgagaagact

SEQ ID NO: 36627 - DNA, 1053 bp, Homo sapiens
tggattttatgaactacatgtgcatgtgtctgacttgcctttggtgcagtatttttaccttgagactttaagcatgtattctgtcttaggcatcaaacataagaacaaactggtggtgacccattccttgacctattcatgcatcagttacattatagtgcagtatatgggactgtcctatggaccagcttatcagtgattttccaaatgattctgattatcatatgtatctctccttttatttctaatttcaaaggcactatctatgctcctagaaggaaaggacagctgtctgcagacatctgtatggaaacaataggagaggaaatttcagagatgcgtcagatgaagaagggtgtatttcagcgagtagtggcaatttttatccactattgtgatgtcaatggagagccagttgaagatgactacatttaattggtccctcctcctttccagctattttgtcagaaagcaagtagggccatccagctgccagagtgctccacagggacttgaggcatgcagttgggaggtcctggctcggtttgctatatagggaatatataaggaacatcgaaattgtatacaaagatttgtacataaaaaatatacaaagacgcttcctaaagtaccaactttatatcatatgtttatacaatttaatttaaaaattcattttaaggaagacagataatttgaaagacttttgtttttcttgacttaattcatgaagtatcattttttgactgagtctccatttacttcattcttaatgattattgtcatccctttaaatctgtgcctttttcttcttgagcgaagctgtttgagtaaacctgttgaagagtgtttgtgtcttttgtgcttttttgttgttattaaaacaccaactaaaccttatagtcaagacaaggctctatgtttctgtacaaagctgtagttctttcttagtattatagttgccatgtttcttaaaatcaagtaaaaagacttatgagcttaaaaaaaagtgagtttgagagggaaatggaaaagtttccagagtatttctag

SEQ ID NO: 36628 - DNA, 1038 bp, Homo sapiens
gaagagaagctgctggaggtgggcagtgtgacctaccaggaggaggccgcccggcacacataccaggcactcaactcgctgctagtggctgagctcccacagtttaaccagctggtcatgcagtggctgggccagatcatgtgcacattcgtgaccctccagagggaccttgcaaagcaagtgctgcagagggcagagggaagcatggcccaggtaaggcctctgagacttggacacctgtggggagtagccaggcaaggccctgcagccccatcagccagctgtgtgtaggggctaggatggagggaggatgggcctgaaaacaggtcatcaggcccttaggaagaggcagtgggaaccttccagatctctctcatgcccagtctccctctgttagtgaagtcagaccatgaaagcaaggataggactgagatttcagaccattcccaagtcctgcaactcagaagcagaagaagctttgctcatacaatggcagatcttgggactgatctctggagtgtactagaagttgatgacagagacagaaggtcgtttctacacagtaaggagtaaatgtctcaagccggtgttactattactacttccagcagccatcttctcatgagtatttaggatgtacctgtttggagcactctccatgcatgatctcattcaatcctcacaacaaccctacagaggaggtataattatactcattttaaaaataaagaagccaaggcacggagaggtaaagtagcttgtctagggccacacggctaatagcaagcattgaactctgacagttcagctccagggcctggactctgaaccacaacactcaagagcctgtaaaaggagctaccggctgaaagcataaataggttccacagaggtttggataaacctccaaatgcaaactttgattttagaatttggaagactggagttgatacaagaaagaacacccaactgcttccagatcttgctctcagatgtcaacatgagagctgaattgctgttgggtcccaccttgggagc

SEQ ID NO: 36629 - DNA, 1050 bp, Homo sapiens
caggcgtgagccactgcgcccggccttcgaacgaggtcctattccttctcgagcctcagtttccccagctgtgcagaagaagcaggttgtctcgcaggacccgcccagcgctaacgcaacgtgattcgctctggcaggagccgggggctgcccgcattgctgcgcaggcatcgggctgctggctggggcaccgccacctggctgcctgcgctttaccccttgctgagggctgcgtgagctggtcgcggcgccagacacggcgcaggaaagtgggtgagcgacccccggctcccgcgggcgccgcgcggccccgcccccgcagctagcggccctgcggcagccgggggctcgagctccgccctccgcctcccgccggcctcactccctcctccctcctcccttgctcgctcgctggctccctccccccgggccggctcggcgttgactccgccgcacgctgcagccgcggctggaagatggcggggaacgactgcggcgcgctgctggacgaagagctctcctccttcttcctcaactatctcgctgacacgcaggtacggccggctggggctgcgggcccggggccaggggtgctgagctgcgggggccgcagctgcagccgcggaggccgggaggcagcggtgggagccctggggtaactgggggttccaggctgcagagccccccttccaggcgccctgcgatgcgctccgttaccggggcagggagccggaggtctcccggcgcgtgccggagcgctgggggcgctacggccgctggggagggtctagccttggccgcttggagtctgccaccccgcgggcaaaactggggggtaccgcgcttcctttgggaggtggaggcgcgccacggtgtggggtaccctcaggctggcgctgggtgctggaggcgcgccgtcagcgcccggcacttgctgccgtactttcacgtggacttgtggccccggcacgggtgcatgcccgggtctccggagtcccctagtcctccaggctgtagtccccagagtgctgttgctggccccccgcggct

SEQ ID NO: 36630 - DNA, 1053 bp, Homo sapiens
ttggatcttaagtggaatgaaagatgttaaacgcttggtgtgtttttcttttcttgtcatcaggggctgttggtcatgaagagtggagttcaggggcagggggaggtgtttggagtctctcattgaggcctctgtgagctctgtcctggctgtggctgagtggaatgtgtaggtcctgagggttcagagcatgacagctagaagggccttcagaggccattcactcctggttttttttttttttttttttttttgcagaggtctcactctgtcacccaggctgcagtgcagtggtgtgatcacagctcactgcaacctctgcctcccgggctcaagtaattctcccatcttagcctcctgagtagctgggactataggtgcgtgccactgcacttgactaatttttaaatttttcattgagataaggtctcactatgttgcttaggctggtctcaaactcctgggctcaagtcatttctctgcctttttttcttttttttttcatttttgagacggagtctctgtcgctcgggctggagtgcaggggtgcaatcttggctgaccgccacctctgcctcctgggctaaagggatcctcccacctcagccttccaagtagctgggattacaggcgcagcacttccaaagtgctgggattacaggtgtgagccactgggcccagccactcctggggcttttcccctttattggtcatagccccatcagagactctaaagagtatggactctcttaatgtaagaatgtcaaaacataaaaaagttcgcatgtgatttcatagactctctaaaagccatgcacaagcccagagtaagaacttctatttgagtccttctgcattctttatatagatagagaaactgaggtccagagaggcacccacacacctcacagtcattgataggagggcagagggggcctggattggctcagccagaggcagggctgggccatgtgtggatgggagcaggattagcagtggggagatgagcagggaagaggaccagagggacctcagcccggcgagcagtggcct

SEQ ID NO: 36631 - DNA, 1034 bp, Homo sapiens
tcagctttcctgtttgaaaaatggcttaacctctgccctgttgtgagtgtcaaatgggagaatatctaatttacagcataaaggatttttatgagccctgagacccaccagtcctagtagagtgggagaaacctagtagggcaggaaagtgggttctcgtggtacttacatgtgcgtatggcaggggcttcatttgacaaaacacctccttgttctgtcattgagagagttcctcgcctcctgcctgtttctcttagtcctgggtggcaatcaagcatctgattttccccctttcctagttcaggtgcctgttattctgtcattagcacacagtaaggaggcccaggggtggggagcctgctgcagtgccacccccaccccaggacacatccctattacttgagaagaagggagtgtggaaacgtgtgattcagttgacacagattcattgtactcgcccagttcttcgctctggaacgcacttctacataaggcaggctcagctgtggcttaggaggccagccagagcctcgagtctgcaggacctgagcgagtggtggtctgctcagcaggcctccttggcttcccttggcctctggccctcactgaccacatgaccaaggagagcctgctggggccaaagagaacctctttcccaccagctttatctgggagcctgtgggtctgcgtttctcatcatctgacccactggaaaaggaaaggcaggagtttccataagggaataaatggatgcggaaggaaaccacccctcaacccccggtaaaggggggttagtgtgagagagactgcagccttcacgatagtgtgaggcagagatgccaaaactgtcctgggaaatagtgcctctgcgcctccaccccacaccctcccgtcctgcaaaggtttagtaagcacctactcagtgcttggcacctttccaggtgctgggactcagcaaaggacaaggccaggtgcttggacagtttatattctggagaggagacggatggtccctggttccatgctatgcttaa

SEQ ID NO: 36632 - DNA, 1050 bp, Homo sapiens
cctgggaacatgaatgggtgtttctccagaacctagcagtcacacaatactgtcagtcattattattgctgttttttgtttcattattaatatagaggcattgttagctttaagaagtccacttataagtggggacatatgtgtaaaggattagctcctctatttacagtctttaataaagttttcaacaaaacagttctggtaacaggaggacagagatgtatgtgggcagggccttgagggatatgtaggagtgcagaggggagagcagcagggggttttgtactgctggggcctagcttagctaccagaagattcaaccaaggggtgaagctgatctttccatttcttggtcatttggcaaaatcgggccttggccacgggtccagattagctgcatcattattgagagggcccctgcttgggtctagccagcctcagctctgatccacctctttccttcctgtctcctcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccaggtatgccctttccagtctcccctcctcccaccctgccaggcctctctctcctcaaaatcccggctctgccctgctctgccttctcctgcacttgctcatgcagagaaatcccctcacccaccaaagctgttgggccccggtttctcgtgctggatgggcccctgatctggcgcagcgcacatgcctcacctggcccttgctgtgtcacctccagaaagtaagggtgagatgaactgctctctaggcctcccgagcagaaccaagccccttcgtgtgccacagaggtccaagtcctctgttccctacattatctcatccagtcttcgtccccaccctgcaagacagggtccagtattttcccattttacagataaggaaaatgaggcttggaaaagttaagt

SEQ ID NO: 36633 - DNA, 1074 bp, Homo sapiens
ccggtctttgtaagttgctcactgccttcccctcttccctgcctcttcacccccatgcccagattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaatcaatgtttacattgaacaaagctgcttctgtctgtgagtttccatggtgttgacgttccactgccacattagtgtcctcgcttccaacgggttgtcccgggtgcacctcgaagtgccgggtccgtcacccatcgccccttccttcccgactgacttcctctcgtagacttgcagctgtgttcaccataacatttcttgtctgtagtgtgtgatgatgaaattgttacttgtgaatagaatcaggactataaacttcatttttaattgaaaaaaaaagtatatccttaaaataatgtatttatggctcagatgtactgtgcctgggattattgtattgcttccttgattttttaactatgcactgtcatgaggtgtttgccactgagctgccctgctccccttgccagattgccctggaggtgctgggtggccgctaggctggtctgcaggaaagcgcggcctgccgtttccgggccgtatctgccaagccctgccttgtctcttactgagcaagtttggctcaaattataggagcccccatcttgtgcccagctcatgctccaagtgtgtgtctatccatttgtactcagactcttgagtaccttgtaaggaaggcggggcaagctgcatcattcctgttttccaggggaggctggcagctcctcaagaggcgaaatgactgtgggaggtccggttaccagtgaggaggcagagcggtgacccagaccaggccttctggttcttggtccc

SEQ ID NO: 36634 - DNA, 1037 bp, Homo sapiens
attgagtggtgttgagagtgaagtttcactagcagggaagtttccttgagcctaaaataaaaagaaaaaattaaaaagaatcagtttttttaattaaaaaaatagaaagctgttaggctcctaattcgtggggtttttttttgtaaaaacagtttagataatcctgaatgcaatcattaacttggttgctaattacaagaatgaaaattataatggaaaaggacaaaataatataccagctggtttgttattatagtccgtgtattaaaatactattgaaatacgttaaaggtaaatttttaaggtttaaaaaaaatttagtaacttacagggatggagaatttagatgtcagaggtggggagatttatttttataaggtaatttttatcctgataaggacttaaaaaaaagttttgcaactgaaattttaaagtaaacatgttaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatagctaagcaacttaagccaaaaaggtctttcaactgaagctttaatcaacttattttggagatgttctcttcccttatctcatgcgtcatccctaaaataataagatacatgggatcaaatagcccttgccttttcaacacaaatcagttggaaaattatggtttgagtcctgttgctgccatggcttctgtttctcagaaatgagtgtgtatgaacataccaatctatgtaataggctacctttttttgtcttctttggaactttgtacacaaaccaagacaatatcagggtgacaggtgaatgaacttaaattctcagtcttgtctattcaccaaaaaagtatactgcctgttttttctttaattattcaaggttgatgacttttaggaacatgttttatactgtattttttaattaaagcaagtgcct

SEQ ID NO: 36635 - DNA, 1025 bp, Homo sapiens
cttgccaagtgcaggctccagtgatatgccttctagtctataaaatgagtatcattcaggccttccaggtttctttgtgcttggatttgttaagtccaggccatgctgtgtgtatttgccaccatttagtcttgttctcctaacatggctgcttcaaagggtggcttgagaatgccatttccccattacctctccaataaaggctccataaaagattcagtccatctgcttttatgtttcatctgagtgctgcttttaacttttcatttctgagtgcttcctttatgccttaagtagtctcatcgacttcttgcttttgatttattgaagaatccttttgtagttgactttagtgttcattttaaaagatacttctgaaatttttttttgttctgtttaattttaggtctcatttaactgttcactttgaacttttctgttttccttattgggtgcctttaagtttaaattgaaaaaataaaacataaatgactttttcttggtgccaattagccattcaggactgtgctttttagtacctggccttcttgatacttagaagacctggcctggagtcccagctttactgtttactaattttgtgtttagggaaagtttacctccctgagtttcatcctaaattttctcatttgttaaatgggaataataatcttatctaacataatagtgttgtttttaagataaaatcagataatgtgtttgaaaacattttctaaacctgaaggtactgggtcattgttaatattcacatttttttccgtagtatattcaggaccttgtcacataaccccttctatatatactttctgtcacgaagccttctaatgaagacccttagctttgtgatctgttcatcctcttctttgtaagtctggggaaaaccagtgaggtcagaatgcttacttgctgccttgagtttcatcttagcctgttaacttgtattttatgctttttgggtttttattgagcgttatacattctaatgtttgaatcttatgctgctt

SEQ ID NO: 36636 - DNA, 1021 bp, Homo sapiens
tttctttctgttttttcgtggatatctccaatactataatattttgctttttttaatttaacatatcatgcctttaaatagtcttcaaaatagtacctgtttcataatttccatgaactactacaccatgtttatttacttgtttctgtcatccccccgtctgtatatagagatgtctgtatctatatgtctttaacatttttatttaacactcatcatcagttaacaatgtttctgtttatgtcacattgtgagttccttaatgaccttggtatctcccacagcctttgcccatagaagacactcaataaataaatgagcatcactgctgtgcccttctgaagttccgtttaacatgttgtcacctgtgtatgcttggtgcgaactagataaaacatatatacttgccacattttttatatgaaactatacattttaagggctaaaatggatggaagaggcagtaaattctcacctagttcagagaggagagacatttataaggactgagacagacaggcaaggtattatagaagagagagagttgaagattcaacagaatttgggtgggtagaaaaggaaagagaggacattattttagtgaaaatggcttaggttaggttcgtgattatcacatgtttaactcagcatggtccaaacttgtatgtgtagaaaaaccttgtatagcagcataccttaaacttctctggggcaattttcacatctctttgagaaatactgggatggtgacttttgccctctggatgagtgttttggcttctggctaagttcagggtagcactaattccaggagacaggataattaagaacacaattctggagttagctacctcagttcagacccctgcttcccaaggtttttaactatgtaatcttggtcaagacattctatatctgttcctggatttaagttttgtctcatctgtcaatggaagttagtacctacttcattagggatgttagcagggtcaaataagattatccatatagactaaatggc

SEQ ID NO: 36637 - DNA, 1030 bp, Homo sapiens
cagccagcctatattgaatgcctgctatgggccaggctttcagagatgaataggacgtggccctttcccttgaagagcttacagtctagtgggagagaaagataaccaagctattacaaatgaaagttgtcataggtatgcggagttaataaaaagctccttattaagtgtcctagtctgttttgtgttgctataaaagaatacctgaggctaggcaatttataaagcaaagaggtttatgtggctcataatttggcagtctgtacaagaaccatagtaccaacatcttttttggtgagggcctcagactgcctccactcatggtggaaggcaaggggagccagcatgcatagagatcacatacagaaaaaggaagcgaaactcattcaccacctcccttgctcctgccccacgataatctactcatgagggatctgcccccctgacccaagtacctccctttaggacctgcctccaacgttggggatcacatttcaacatgagatttggagacggtaaacatccaaactatagcattaagcatttaacttctacagagccatgtataatatgtccatcacatatgaatcagtatcttatgtgtgtctcaggcatcatgctggttgggaatcagtaaataagcagaatcctacccttactgaagcggggagggtggtggtttagcagctgtcagatgatgaattctgcagtcaaggggtgcactcagagaacacaaagcggggagtgatttatgctgccttggcaaaaaggatcagggagaagctccattgaagagagacctgcttgagaaagacctatttttaatgagtatttcagaacattgttcctggaagcctctgactggtatacaaaattaccttgtacccagaagccaccgagaattaaagacagataactttaagcagtgcagatacttgtttatgtatcaaaactatcattcatagagccttcattgcaccataggcattgtgctaagtgctttacttataatatcttacttaatctgtat

SEQ ID NO: 36638 - DNA, 1044 bp, Homo sapiens
gatcaatccactctcttcccaggaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaagtaagcaccccttaactctgcccctagctaccccatcccatttggctcatactgctcttttcttcagaaaacattaaaactataactgtgaagatgttattctctgccgtttttaggcttcctttaactttctgattgctgaaagtaaagtaataattggtaattatcatttctgttgaaatgcctgaaagttatcaccagattaggatttagtttacatctggactgccccacacaatgtttaggtttgggagttcattgggattggttaaattatgtaataaattcagagttacattaattgtagggatgattccacagattccaacaaagtggaaatacctacctagaaaatcctaagctccagcaaatgagaatttgccattgatcactgagccctggaactccataaagaagtctctttcccttctttttttttgttggtgatgtttctggtactagctccctggctgggccccaggagtgctggctgctgacagccagccgtctgcagacagtgactgcccaggtgaagatgtgtctgaacccccattgtctggccctgcacagcttcatagacatctacacaggtgggtgccaaccttctcttccctcagagcatcccaaagcaggcttgggaactgcctctatggatgagacctctggccctttgaggactgggccttctcagatggggcttctgaggaagggggagtcttc

SEQ ID NO: 36639 - DNA, 1023 bp, Homo sapiens
ccagggtctggcacacagtgggtgccagagcctggttgtcaaaagcctgaggatgctgtgggcctctgagaatcacagaactagctggtaaggagcctttgtgtaaagcagagaggcagcctgtgttgtgcacagggccgggcatcatcccccggggcagcctcttgcacagcaacctcaaatggatagactgtgtctggagcaagaggggagagttggagaaggccgtccttagctggccccgagctggagatggactgtttccttgctcattgcctgcctccctcatcagcctctgagctctggggaggcactgcttccctgcatagggcacgtccctggcacacggtgcataatgcctgcacatacttgtgaatagatgcatgagttagagtgcagggacaagagtgggggccagtttcttcaggctgctttctctctgctttctcagagactaccccgtcctactgcttcgggggacctgccaggcaggaggggcttggactggcccagagaggtggaccttggtactgctaggatctgctccaaaggtggagccaaccccagctccctcggtggggggtgggggaggagccgcctaaaggagcaggggcggggggcgggcgggggggcggtgcgggtgcgaaggctccctctcacctgcagagatgggtatgaaggcccaggagccactccccacgctgttgtgggccctgcactcgtaggtttggttgtgctctaaggtctcaacagtcagcaggctctgcaccgtcaccttgtggaagggctcctggctcaggacctcagggtatgggtcatcccagacctgcagcacttgggcctcatcacacctggcaaaagcagaatgtggctcagagcttcagggttcccagcgccagcatgtccctcccactcacagggtgcccagcccctgagcccaggtgagggaggtgagtggagcccacttacctatcagtgtggccactgcactgcagccatgtcacgttgggctgggggtaccca

SEQ ID NO: 36640 - DNA, 1506 bp, Homo sapiens
cagatgggggactctgagttcaggaaccttctccagcctttctttggtgtcccctcaggcaaaaccagctctgaaaattcctcagaccaaggcctgcccaaagaaaaccaataccactgcatctgccaaggtcgcccctgtgcgagtgggcacccaagccccccggaaagcaggaactgcgacttctccagcaggctcatccccagctgtggctgggggcacccagagaccagcagaggattcttcaagcagtgaggaatcagatagtgaggaagagaagacaggtcttgcagtaaccgtgggacaggtgaggcctgtgttttctgggcgggcctcagggccgcccctacgtggtcctttggactcctggagacacctctcttccccttgtcatcccaggcaaagtctgtggggaaaggcctccaggtgaaagcagcctcagtgcctgtcaaggggtccttggggcaagggactgctccagtactccctgggaagacggggcctacagtcacccaggtgaaagctgaaaagcaggaagactctgagagcagtgaggaggaatcagacagtgaggaagcagctgcatctccagcacaggtgaggcctagaaggagcaggcccatcccacccacacctgttcctgagccagggctgaggatgggcttgactgggggctagtgttgcctgcaggtgtgcagaagcctcagaggtagcctcaacacagcttccttccctatctttcactccatgtctcctctgcccatcagagctccagggtctctgtcttgtttgccttttgaggtcctcctgctgattgattccctgtggttttcacaagctctggagttcccaccctgccaggtgctgcccttgtctggggttgctgaggcgctgttcctcagggaagtcctgtctctgtggagcatggacatgctcctgcagtgtggagcgatggggttgagatagagggtgtgagcctgggctgcgcagcatgacaggtgagagcatctaggccttttacaggaggtggcagcatctgagccatgggctgaaagagttggccaggtgaaatgggcagggagagtgttccaggcagaggaagcagtctgtgcgaggccagggaatgagagagtgcctggcttgggtgccttgccacaggcggcacattgtggtgggatggctggcagttgtttagagccagaccgcctgggttcaagtttcagctccacagcctggcaagtgctgtaagccctcagagcccttactctcctataaacaggaaatcagccctcacaggtttgggtgagaatttaggtgagatctcacctgctacacccagcaagggagctgcacacagcaagttgtctctgtcaccctgacgatgggccaggctaatgtggaacagatcaggagtgaggtctccaagcctggaagagctgagagaagatggctcactccctgcactcacccacccactgtttattatttttaattgtcgctctgttt

SEQ ID NO: 36641 - DNA, 1050 bp, Homo sapiens
tggctcctgccatcttgaagaatccccagaggatggaattgggcctccagccgtcccgggggcccctctgcctaacctggcctgccctgcccagtccacctcccccagcccaccgcagctctagagccaaaagtcgccagaaatcctggttggggctgaggggccaagctcactgcatgctgcagggggcagccctagcctcagtgtgacatgagtaccacatagagtgtgacatggagtatccacctgggccttcctccaggcaaacacctccaggaccaaaccaccaagccacctttcagagcccagcatgcaggagtgttgtgcccatgagacccagaatggggcagagacctccaagtcacttggaagttagagccggtgaggagacccagtcatggggctttcagctgcagcttgccccaggctgggtcggaagaggaattgctgctcactttcttccccaacattctctgtgagaggcggtgcgacaaggagacattttagagggggctgtggaaggtttttttttttttacacgtgtagtcagcacacaattatcaaaggcaagcagaggcgtggaaaattctaaacaaaggctgcaccagaagtctctctggcaggcagtaaacctgcttagtcagccaccacgtgtatatacactgcacccagagctccccaccttgcctggaccccctgaccaggaagggccgagtgtgggtaatcatcagttgaatgtctgcatggcccccacttttattataaatctacaatgtatcataggaagccttactgttcatccacccctcacgttatagacagggaaaccaaggccctgggaggagatgggtcctggccagaatcacactgaaagtgggtgggaaagtcagacctagaacccaggtctccttcctcccagctccagactccatctccctcctttctgaattttcattccattgatagatttcaggccctttcattaacattctggagtcattttctgtcccccaccctaactggagtttttagtataaagagacagggaaa

SEQ ID NO: 36642 - DNA, 1069 bp, Homo sapiens
tgtggtcagagcaagaggaaaggcctctgggggaatcaacaagtaaagggagggccccagcaagcaagagaacatggatagtgagcctcctgtcgcaaggaggtatgcgacgaacagttttgtaatcacaagttgaggatgtggtcaagaatttaagatcataggctgggggttggcgtctgacaaactcacaaatgggctctggtctaggcagcccagagctctctctgccctaggctttggacctgcttggctgtgctttggccgcccttccatgctttgggaccaaagccaggcctgcaagtctctggaggctgggccgacttctactggcctggaatttggatttgagtatggcttgaaatatctggactgtttggaggacttggacattctttacttgaaatggaacattagggtaatttgtgaaatgtgtatggaaaatgtctgtggctgagggtgacaggggacatgaaatggggtgcagtcctgctggattcaggagaggctgttctgatggaggacagaagacaaggattcaaatgatggctatggggcaggatctgatcagttatagatgggttttggaaggtcagtggaaggaaacgctttctgcttattaatgtcagcaaggcctcctggaggaggaagtgttttcgagggtgcagactgcgggaaatgggacaataggagacaagattaggtcatggggagcctgcagtgccctgctcaggagtttggattttattctgtagcctatagagaggacagagggttgtaagtagctcattgactcgatgcctgttcctgtgccttgtgtcaggcaccatgccaggctctttacagacaccccattgaaatatcacaatactctgcaaagtagctgctgctgctggtcccctatccctgccccattttcagatgaggaaatagaggctcagaggggtggagtcacttatagagctggaatttgaacccaggcctgaactatttctgccttactgtgttgcttctcaggggtcttttgaccaaagatgggagcaagactggcagagttaagaccaggcca

SEQ ID NO: 36643 - DNA, 1067 bp, Homo sapiens
tcatggtcctgcagaaagctgaccacaggctgactcaggcagcggactgacagggaaggagggggaagctgcaggactttgtagctgtcttggcatttggggtcgtcacaggtggttttaaggtttggggaataacccttaaggggcaatattactgctttcaaatccctgaaaggccctctacaggtagggggcatagtcttgtccttcagggttcctgaggatggagaaagcaacaagggtgacagctccaaggaagctagtccggaagtaagctgcccagaaagaaggcgagaacagcatggctgaaggtatgcaaagagcctgagagctgcagaggcggcaggaggatgcatcagcaggggcaggcctgggtggccactctcagttcccttttcacccaagaatctcagcatttggatggtgcctggcccacctccaccctctgttttctcatagctttggagctgcccttcctgcacgtcctggggagttccatatggcctggcctgcagagctccactgggagagtccttgccgtttggaatacactcagcccagctgactgtcaaggggccccttggggatgtctggagcagtggccagagctgggctaaggactgtactttcacagaggatttgaaccctctgcttccatttctcatctgtgaaatggggtcagtctctttttcctcacctgtgaagaaataaggctaaatcatgaatcaggctgaatcagtagggcttagggcaaaagggctggtgagtttgtggatttgaaagtgaagacgcaggcgggggttgttcccctccttccctgcagtggaggttaaaggaggctctcttggtttctgggggtcaccagcaaagttgctttctctgtctgtggggctcttacaaagctctgcctcacagcttctgtcttggaggtgtggagctcagtggaagaggtggatgtttgggggcagcggtcctggaccctgcggcctcagggctaaagccaatttgccatcaaaatccttatctagatggaggagagtttgtgctaagttgcctcctggcccttt

SEQ ID NO: 36644 - DNA, 1047 bp, Homo sapiens
cttcagcctcccaagtagctgggactacaggtgcccgccaccatgcctggctaatttttgtatttttagtagagacgaggttttgccatgttggtcaggctggtcttgaactcctgacctcgtgatctgcccgcctcggcctcccaaagtgctgggattacggcgtgcgccactgcgcccggcccatctacctacatttctaacatctccacagtctcttgtctaaaatctagtgtggtcagatgaattattggaagtcaacatttttcaggttttagaaaggtaatgtggtgcgaaaccatatatttagtaacatcttcagcgacacctggggcagcaccctgttagcaaattcattaatatgtctgtagcaaagtatgtgaatatttacactaagtaagaggaataagtcaggttttgttgccaaatggctttgctacaaacctaggaaacaaagcctgtgttttcaaagctttctcaattgagatattgtaaacaaaggattgtggacatgcaaagaaaattcagaaagatgagagaagacgtaattccttggcccaattcccaagagcttgattttgtaggtaggtctaaagtggggtgcaggaatccagcaggcccccagaacgctctgatgaagcacatccttgggaccagcctggatcagccccacctcacaggataggatagggaccctgtacccttcatgagagtggactttgcttcccacaagccccagaagttggaccctgagtttgcataggtagattcccctgggagggtctggagtgttcctttggtttccagaggttccttcatccagaggtggccattgctctggtgggatatgggcattagtctggaaagccgtgctcacccacagcaggctggggaggggttgtgggtagcaggaggtcctggtccacagtgacggcctagaaggtgttcccccaggtcaggaaagaaagtccgccctctggaggccccctctgctctgtgccagcctccctggggcagtcctggagccactctgagccccagctcgcc

SEQ ID NO: 36645 - DNA, 1074 bp, Homo sapiens
tctctgccattcctggggtccatgaacatggctttaaggtcggaagtgggtggctgagccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcagacctgatttcgtcaaacaagtgttggttaccttctactaagggctgagtgctgtggggttttgaggatgagccagacatgttctctgccttcaaggaactcctggtcttggaggggtatgagtcccaacaccactaagtagaatacaggcagagagtgctgcgcgcagtcagagagggcacacaagtgctatgggaattcagaacaaggggatgtcacttgaacctgagaggggtaaaaaaggctccttaaaggagggatgggggtctctggagttgcgcctagaaggatgagatccattttgtaggatttggacatatggaatgggagggtaggtaagaacagcatgtgtaaaaccatagggggaaaaaagaaattttaaaaatatatagaaaaagggtcacagactgggggtcttgttacttcctccttttcctacttgcttctgtttttgttttgttttgttttgttttgtttttgagacagggtctcgttctgttgcctaggctggagtgcagtggcatgatcatggctcacagtagcctcgaccccctgggctcaatcgatcttcccgcctcagcctgccatagtgctggtattataggtgtgaaccaccgtgcctggccctggccctgcccgccttgggttttgattattaattctctctcctctccctatcagaagaattttgacttagtgagctatat

SEQ ID NO: 36646 - DNA, 1063 bp, Homo sapiens
ctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaag

SEQ ID NO: 36647 - DNA, 1027 bp, Homo sapiens
agattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctg

SEQ ID NO: 36648 - DNA, 1138 bp, Homo sapiens
ataattgtcaggtttttcaaggtcaaaatgaaaaaaaaaaaaaaaagactgttaaaggcagctagagagaaatgacaggtcacctgcaaagaaaacttcatcaggctaacagtggacctctcagctgaaaccttacaagccaggaaagatttaaacctgcctcacatgaggtcttgaaaggagtgctaactatagaaaggaaagactcctaccagctaataccaaagcactcttaaatacagagaccagtaacactataaaccaaccacaccaacaagccagcataataaccagctaagagcacaatgacacacatcaacaataaccttgaatgtaaatgggctaagtgcctccacttaaaaggcactgagtggcccgctggataaaaaagcaagacccaatggtatggtgtcttcaagagcatatcacacataatgacacccatagtctcaaaaaaaagggatggagggaaatttaccaagcaaatgaaaaccagaaaaaagcagggattgcaattctgatttcagacaagaaaaaacaaacaaacaaacgaaaaacagactttaaaccagcaaagatttagaaagacaaagaagggcattacataatggtaaagggttcaattcaacaagaaggtctaactatcctaaatataaatgcagccaacacaaaaaaagcaagttcttagagacctacaaagagacacagactcccacataataaaagtgggagactctaacactccactgatattgttagatagatcattgaggcagaaaattaacaaagatatttaggacccaaactcaacattggaccaaatggatctgatagaatggatctatagaactctccacccaaaaataacagaatatacattcttctcattgccacatggtgcacactctaaaattggccacataatttgacataaaacaatccttggcaaatgcaaaagaacgaaaattataccaaacacactctcagaccacagaataataaaaataggagtcaagactgagaaaatcactcaaaaccatgaaaattaacatggttctgaatgactatggggtaaataatgaaattatggcagaaaccaagaagttctttgaaactaatgaaaacgaagatacaacat

SEQ ID NO: 36649 - DNA, 1048 bp, Homo sapiens
gttcagactttttccccaaatattccataattaccaaacaccactttcagaatgaaaatgattatttcaaatgtcaacattgcctgcttaaaagcctcctttgttttcttctttgctaacacagtctcatctcagtcatctcaaatctcaagctttctctcatcccacaccaattccatattcactctgtcaagctgccaaacagttagttgtccataacaatcctgttaattttcctattgtacatataagaaaactgaggattacagtggttaagtaaatacttgccaaagatgattacatactaaatatatgattgatgaactctcttatctgcaagatttattctcaatagtctaggttcttgactactgcagtccaaactgcctccctgatactgtaaacatcatgatcttttatattttatcacttcaataccaaccttagtcgacctttccatgaagcactctccattttagtttcaaaattctcagccttcctaaaatcactctgccctttctacttttacaaatgctgcttcctgtcctcagcctacttccctcatgagccaaagttcaataatcatttaagcctattacctacttccttagaaatctggttgttcccccctctctgctataacagtacctgctcccatgtctgctacagaacttttatgtgttaatgttagtttctacatctctttacatctctgccgatgtgttaatgttggtttctacatctcttttttctctgcagtccttccagaagaaaactatacgtaaatctgctcaggatattcaacagctagccagtgcatatgacatatactgggtacttaagaaacgtttgttaaatgaatcatgattataaagaaaaaataaattaaaacttatgtttagttaaacactgttttgtgtattagtctaatttgttttatctgaagaaaagtaacataagaaagataataaatgtggaatacagaggaaatccattctgagaggtaaattcatagatgttatcattctaacattctgattttgcttta

SEQ ID NO: 36650 - DNA, 1054 bp, Homo sapiens
tctttaaactaaatatagctttatgaaaaacctattgcaaaagacccatttcactggtactgttgaaaacttagtcattgacaggccctcatcctcaaaaagaattaggggaaaggatttggggaactgtttaatacacaccctcattttacagaagagagacccatcaatcaactgtgacttcgcaataatacacacacagatacttgcccaaattatatacctaatctggggattctcctataaggctttgtaacctcctagggttccttcagttaattcaacggtgttatcagatcttcaaaacgatattcattctagtttaattatgaaaagaattacacttatgccttgattcagaagggagggagggaggaagcgatgcaaactccaaagcaccactgagtctcaccactgggggatcctacagagaaactgggaatcctggccctggtttacatagcagctcccaggcatcgtctccacccatcaggtccgcacctgccagttttcttcctgctctttgtgcctgtacttcccaattctcttcctgcagggctctcttcctattcccaacccacatcttctccacccccaccctctacccactgaaaactaaaatctacctaaaaatggctggtctctaattacttgcattttgtttccacactatttcagctgtttttatagcatgtctggccttagccgggcagacagtttcatttctcaaagtgtccgctgggaattctcaagcttgacataaaaaaatggcactcagtcatctttttgtctgatttcctagttctggatcctttttcttaacagttccaatttgtgagaaaactcatttatttataaagtcgtgactgcccccacctcttccattctttgaagtcttggtttgtcttcaggacattccaccctgttagagaccatggagcccatagataacaaacccctatttgacagataggtaaactgagtcctctgtctagaaaaggacttactctaggccacacacattgagtgacacaaccagggccttggaatccag

SEQ ID NO: 36651 - DNA, 1015 bp, Homo sapiens
acgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagtttccccttgccttggctgcatatttcactgatcacatctcaggatttcaaaagcatttttggggtggggctcttttggt

SEQ ID NO: 36652 - DNA, 1032 bp, Homo sapiens
ctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaat

SEQ ID NO: 36653 - DNA, 1005 bp, Homo sapiens
tggggaatcaggatattttgtcctagctctgccgcttacctggcaaccttaagtgactcgcgtttgggtttctcagtctagacagtgatggaattgaattcttaagggccccttctgctgtgatctggatgttgtgcatctttctaggcttgtttttttgtttgtttgtttttaaatagagatgaggtctcactatgctgcccaggctgatctcaaactcctgggctcaagtgatcctcccaccttggcctcccaaagtattgcgattacaggggtgtgagccagtgcccctgaccagggtctgtttgtttttttattccgagagattttacccgctgtgtacactgagtatcagccttgcaacaagacttaatctaattgtgtaggaagcagtttcctctgcttattcctctgttgctataaaatcctcctcctctttcttcctatctctgtattatgtctaagctaaatactaacagctgaaaatgatttttaactgtctgttattattttaaacatgatcagggccctcttctgactcttgtctagagcctcgtttacagtaattaacttacttgtacatttagaacatgttttcgttaaaaatgttcttgaagtcaagtggaaagggacaaactttgtgtttgtctggggatggaggctacgtgcagcagaggctgtgctgataacagctttaagcctctccctttgttttctgattgtatcgtttatattcgcctgctctggagtccttgttttccctttaaggcatgtagctgttcattcagcctcctcttgtggcagttcgaagtgctcagagttttctctgttccaaaggcggtgtaagaaaaagggattccatttattttataatattctggagactacaactgggaccaatagatgaaagtgccataagggaagggtgtttggtaagtgttaaaaactttcaaagaattagtggtctcctgtattagaacactgagcacggagctccctgtcact

SEQ ID NO: 36654 - DNA, 1027 bp, Homo sapiens
tatatatacacacacgattgaactattgcacaaggtccaagacattatctcagaaaggagtagataatcctgacctaaggaatagggaatgcggaattccaggaagcacttctctttcattttcccccactcctcccaagcagtgcctcacttctgccttgtctagctgtactccggaaaattaagaaatttatgagtgtagcaccacgtataccaatgggaaggatgggagtcagaagtcaagtgaactcagcccgcctctgtgtactttgcacttttccatttcccttggtaccaggcactttcatacttaatccatagtggagctgtcacagtgagcaactctgacaatgacagcttctaccccagaggccaccccaaatatggagctaaaggctccagctgcaggaggtcttaatgctggccctgtccccccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacgtgagtagctgttaccttctcctctcctgggtgggattcgtgttcctaagcctcccttggacttatttttccccccaatttcatcagtcctccactttacagatgaaggtcagcagtgaagagattgggcgagtgactgcgctgagatttgccttcctgggctgccactctctaggcagtttcttactcttttttcctttcagctgtgttggccccccaaggctggtgccaagtgagagcttggacttaaaaaaagcttctacagaggacattcttttaatttaaaagtgtgtcatctgtgctagaaccccaaataatttccaagcataatcggaagcttcctttgcaaagtctccccccgaattctgccccatcaccaaatcagtattcatttgactgaagaagtgggaagagagaagaattaacttctgcacttaaaaa

SEQ ID NO: 36655 - DNA, 1047 bp, Homo sapiens
agttcttcacgtcccctttttatgagactggaaggagggcctgtgaatgcactatagaccatttccattaccaaacaaggaagggtaaatatttacccatgatttcatgttgtaattagaactctcaagagcacctaggatatactccactgtacactaaagatgaattgagtgaggccacccccatagacagacacacctgctgcatttacttttaaatcattgcaggtagtcgggctgtggtggttgccatgatcagagggctgggataagaatttgggttcttatagcgtctcagtcccaaccaactggtagtatccatccagagtgatgtctatgcatagtacaaccaggacacagagcaatgtctgcataagggcagccctgctgatttcttgagagcaattctgagtcttcctctgggcttagccagaagttgtgctgtgatcaaatagtgccgtctgcctggagtacagcatgggggaagaggtttggctgtgttttgatgtagtcactgcccatagtgttgtagttgcttcattttgatgtgtcatacagctaaagatgctccctttaggtcatttttgttgccgctgcctctgcggcttgttactactgttctgttttggcattgtgccccacttaccatgaggattcccctactgttcaatgtttctgaattttttccctaatcctaagcatgtacatgactgttcctcttgcccctcatgcacgtgccattgtaggtagcagaccaaggtcttccacagagagcaggttcctctctgtcttcagcatgtggagtctcaaatggaacagttctgggcagagtgctttgcacagagggtgctcccaataaatgttttatcactgcatatcgttgcttctgagatgtattttttcatagttataacagtttcaggattgcaagagtacatctcacaatccatgtgtacctttaacagcattttctcaaaatactgttattataattgataatatggtaagacctcacttaatatcattgatacattcttagaaactgca

SEQ ID NO: 36656 - DNA, 1064 bp, Homo sapiens
attcttcataatgatttcccccttttgtattcatatgattgcaatacatttgtataaaatctcaactggtctgtatgggctctgtttgtttttatgatgtttgttcatgttttaaacgacttgctgaaatgatcttgtctctgagttggtttcagctaaatgattcggtcttttcccctgtgtttgatccttcaggtttggacatatttgactcttttccccccaggttgaattgaccaaagcaatggtgatggagaagcctagtcccctgctggtcgggcgggaatttgtgagacagtattacacactgctgaaccaggccccagacatgctgcataggtaagacatttttctcctgcatcatctaatgctgtcttttagtatgtggtacttatctttgagattctcccactcatcatcttatgctttgtagggttgttgcataatacttatttacatataaatatcccccaattttttatttgagacagagtctcgccctgttgtccagactggagtgcagtggtgcgatctggactgactgcaacgtccacctccccagtttaagtgattcttctgccccagcctcctgagtagctgggaccacaggtgcccacaaccatgcccggctaatttttgtattttttttttttttttttttaagtagagacggggtttcaccatgttggccaggctggtctcaaactcctaacctcaggtgattgatccgccttggcctcccaaagtcctgggattacaggcgtgagccactgcgcctagccccaaaaaataatttttgaaagttaaactaagttatctaaacttgtacattattggaaaataacaattgaaatgtaaaggtatagtcatgcattatttactaagaatgtattaaagattgctggagctgaggtggatgtaaaaaataagaatgtattgaagacaatccatgactgttcctgtaataccatacttttgtgttgatgcgctttaaaaaattagtgtctttagtagaaatgatgcatgcttattgaaaattagaacacagataaattatgaaagta

SEQ ID NO: 36657 - DNA, 1048 bp, Homo sapiens
cgacttcaggtgatccgcccaccttggcctcccaaagtgttgggattacaggcgtgagccaccgtgcccagcctttttttgtatttttatatttggttaatttctttctaccccatagaataaaactgacataaaacataacaaaaagaaaaaagcataggccaggcatggtggcttatgcctgtaattctagcactttgagaggctgaggtgggcggatcacttgaggtcaggagttcaagaccagcctggccaatatggcaaagccttctctctatactaaaaatacaaaaaaaggcggaggttgcagtgagctaagattgcgccatggcactccagcctgagcaacagcacaagactctgtcttaaaaaaaaaaatgtatttatctggaagacaaatgtcaaatcttaatagtggttatccctggattagagcattttggtgtgttgctttcctggtagaatattgttttaatgaaaatggatcaaaggaggacatagatgggtgaaaaccatgaggaattgactttgacattcttaattgcatcagcagaaatagttaaaaagtacttctaaaaccacttgcatgaactaggtgtttaaggggaaccgctcacgcttattctcagatacattaataaaaggacacttgaagtctatgaagaagatagctgttccagccttaccgcacattttcttcctgagtgaaaataggaacttatgtattggtggccatcttgacatgaaactacaagatccttcccaacagtatcatcctacactgaaacctggaaccaaatccattcccattcagcaaatgttgatcaagtggcatgtaggggatacagagatgattgcatacaaagatgaaaaagaaaacgtttctgccagggccaggcgcggtgactcacacctacaattccagcactttgggaggccaaggcaggtagaattgcttgagtttgagttcgagaccagcctgggcaacatagttgaccttatctctacttaaataaaaataatcagccaggcatggtggcatgtgact

SEQ ID NO: 36658 - DNA, 1050 bp, Homo sapiens
gtctatccttaaggctgggcgcggtggctcacgcctgtaattccagcactttgggaggcccaggcgggcagatcacgaggtcaggagatcgaggccatcctggctaacatggtgaaaccccatctctactaaaaatacaaaaaattagccaggcgtggtggcaggcgccttagtcctagctattcgggagactgaggcaggagaatggcgtgaacccaggaggtggggctttcaatgagccgagatcgcgccactgcactctctagcctgggcgagagagcgagactccgtctcaaaaaacaaaaaacaaaaaaaagtctgttcttcaaagccttagttctgtccttaaagtcagtgccatgattttaccaaattgtcctactttgtttatttatatatgtttttcttcactgttgttttgtgaacattgcgaaagttaatgtatatgtgaattcagtaagtacaaattactttaaatatctttttctcacttagagtctgaagaagaagtagaggaacctgaagaaagacagcaaacacctgaggtggtacctgatgattctggaactttctatgatcaggcagttgtcaggtaagaagattttgttcacatgtccggggctgcataagaacttgcattgtctagtctttccctttgttggagggcatttacatattctgagaattacctcaaaataataatttctcagaagaatggttttgtttctggtaattttgactaaacaaaaatatgtaacttgtttgttaatagtaaattgtactatgaaggcaatctactattgcttagtttaaatagtatcagtttctttttggtttagttttttcttggtgttaagtgaaaacttgcatattgtttatcaagagttgaatgtattgaggtattaaatgctttgagggaatatgaagtggacagagacctatttaattagagatcgggcataaattgatataaataccaatatgtgagttaagtagcaataaagaatttcattacgttagtaagtgcatcattatacctttgggtttttt

SEQ ID NO: 36659 - DNA, 1062 bp, Homo sapiens
atttttattctattcctagttattttttttaaaaaaagtttctgttcttttgtattgctgtttggttgacttgtagatacattttcatattggtggttcatttcagggaaatttcttagatattgagccatatgtttgataagagagaggtaagatgtgtattagtttatttcatcaaaagaaaccactcccttccccgaggtaacttgaatgcctgttagaccagaaattttaggtgccactgtagcaccctatcagtgattccttttctatttaatatttaatcttttacactataaattattacatacttgttactacaagtgcataacatcttttcaagaaaaataacatggcagaatatactttttctatgaaattttattgaagataactttatagtggaagtagaaatgaactgctgaagtaaaacttcttttctagttggcatacctgatttcagaagttttcagtttgtccttctgagtctcgtcagggtgattgttaactgaactatcgttgaaacctttgcatttggtgctctggaaaggaatataatttttagtgctgtgtttataggctcagggttatgtcatttgtttgttcaataattcaaattcctgctgtgtgttaggcattgttcaaagtgtaggttttatattggcaaaacagataggggttcttgttctctggcagctaataggtgagtaggaaagagcaatgttgaaatgactttagcttgcaagtggaaaaaattagctgggcatggtggtgcctatgtgtggtcccacctgcttgggaggctgaggtaggaggatggcttagcctgggaagtcaaggctgcagtgagctatgattatgccactgcattccagcctgggtaatagagtaagaccttgtcacaagaacaaaaccataagaagcaagtggaaaagtaggttggctggaccagctgaccacttagttggttattatagtaaccctagtgagagagaatgatggcttgaattagagttgtggcagtggaaatggaaaagaaataattaggtagaataacaggtt

SEQ ID NO: 36660 - DNA, 1041 bp, Homo sapiens
ccagcctgggcagcagagcgagactccatctcaaaaaataaataaataaataaatttgaatagaacacttccgcgacacatagtaagtactcttagatactcattttaagaaattagaaaattacattgctggtgaagagcataaattgaatatattgaaatgtttcgtagccccttaactactttggctctgttaggaggaaacgaaggccaagactatccaaaattctcaggaggtgttaaagagcaaattaaagtttatgtcaaattaatgaagtttttattttaaatgtatatgtactttgcataaatatgtacagtaccatcttttcacactggtgatgatgaggttttattctaagcctccaaatctatggagaaggtggcaattttttttattttttattttttattgggacggagtctcactctgtcgcccatgctggagtgcagtggcacgaccttggctcaccacaacttccgccacccgggttcaagttgcactccagtctgggtgacgagtgaaactctgtctcattaaaaaaacaaacaaaaaactgaactgtgagaacttagctgatttataatctgctggttcttttttttttctgagtcggagtctcgctctttttcccagactggagtacaatggcgtgatcttggctcactgcaacctccgcctcctgggttcaagcaattctcctgcctcagcctccttgaatagctggaactacaggcgtgtgtcaccatgtctggctaatttttgtgtttttttagtagagacggggtttcaccatgttggtcaggctggtcttgaactcctgacctcgtaatccacccgtctcggcctcccaaagtgctgggattacaggcatgagtcaccgtgcccagcctctgctggttcattattacagctttctttatctttgatagtgatagccagctcatcagtactcttaagtctggtcaccttgattcttacagcccatcatgttcagaggtgaggtccgtctgaatgtcgaagagaagaagactcgagct

SEQ ID NO: 36661 - DNA, 2003 bp, Homo sapiens
tgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaaaaaaaattactttgtggtaacttcaaggtcataaattatggatagcctagaaattatccttcatgagtgaatactaaattatacatttcaaaacagaagttcttcctacttggagacttaagggcattaactagatgcagcaatcctcagcttggtgttatcacatactagaggacatttggaaatgtgtgaaatttggaagggttgttggagagacatgcatctggcatttattgggtggggtctaaggataccaaatgttgtgtaaaaatgaagcaaccccattgagaacactgatagtccctattcctgtgggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaattagacatcttgggccttaaactgtatttt

SEQ ID NO: 36662 - DNA, 1907 bp, Homo sapiens
agcaaggagcacatttgcctcccaaactgatgctttttctctagaaccataatgcccccctaattacatttcagtagcatagaccgcaatgaacttcctactgtagggagacttgagtctggaatacattcagaacaaggttaacattacagttcttaatttcctttagggcaaacaagataattaaacttgggttttgtgagtctttttttgatttgcagattatatatggtaacacaataatggtggtttgtttttaagttttttctcatcaggtttgataatttaatgcaaacttcaaatctggatgtgaataataatatttttattatagtataatccaggtgagtttatagaatttgtgttttgtgcttataaactgtcaccttctgatacttttcttcatccctctatttgaaaaacccttgtagaatttaacgatttaatggaaaatgttgcactttatagaaggccattttagaacttacaggtaacctttttgaagagcttagatttgtagaccactgtttatgctgagtgacatttcttttaaatggttgcatttgtcaaatctataaagatgttttttatattgcagttttctttttgtgctacttaaaggaatctttgcaatgctgcatatagataattgttgacctttttagttcagcagtttttaaacttgaagtaacatcagcatttatttgaatatcaggttttagctaactgcctaatgtaccaaaaaaaaattagcaatgtcttatgtgggatgaggggttaagttaaagttgctgatcaagtaatggccgtgtggcacaagatgataactaagaatttctggttctaaggtagtaatgccttttgggatttatatttgtttaatgttgagattctggggaccataggtgggcctgtcaactcttaacagactatagtaaaggagagatggtggcacatgtgagataaaacttgtttatatttacattcttattagtggatagatatcacctcagtacaacactgaaattaaactgccttgttcatgctttcatgtctcaaatcaaggcctaaatgagtaaaaagatgattacagattacctaaaacccttaaccagttttggtttttgattatgcatatgtgttggcttgcaattaggtttttagtttctgtttatgtgacttgtttgaaaacattggattcgtcttctctccacagtttctacttgaacctagtagcttattttaattccctgtaagaggaaaataatatagggaatctgttcaactattcctttaataaatcatgtgacttggccaattacagaaattcctaagtgtagtattttgaaatgtggccagtgtcccagatttgtaaggtacagtgtgcatacagtgtgtcttaggatttttttaagtaaattaaggatgtttaccagaaattattgatttactgaaccaagtatttattttcagaagcccacttttggggaaggttgcctatatttttgatagtaattagatggaagattaaatcctgtttaacctggatagaaacagttttaactattgctgaagttaaaatcactttggggtggggtggggtggctcatgcctgtaatcccagtgctgtgggaggctgaggccagaggattgctcgaggccaggaatttgagaccagcttgggcaacatagcaagaccctgtctctacagataattgaaaagtgagccagatgtggtggcgcattcctatagtctccgtctctcaggaggctgaggcaggagattgcttgagcccaggagttggaggctgcagtgagttatgatcataccactgcactctaacctgggtgacagagtgagaccctgtctctaaaaaacaaaaaattagaaaacaacaaaaaccact

SEQ ID NO: 36663 - DNA, 1030 bp, Homo sapiens
acctcccacattttttttgtctagataaagagactgaagtccagggagaattgagactggctcaatgtcactctgaaaatgtagggccagagctgattttagaacccaagtgttctgacttctagctgagagtttgctcagttgcctcagctgatcctagaggaactgaaagagtccattcagtttctattcacaacgtgaggagctattatggtatgggtagatctcaatagcagaaaactgggtcaggcagttaagaaatatttccattaagaaagtttttggtcaggagcgatggctcatgcctgtaatcccagcatgttgggaggccaaggtgggaggatttcttgagcccaggagtttgagactagcctggccaacatgatgatacctcatttctaccagaaagtacagaaggtagcagggtgtgatggcacatgtgatggcctgtacagtagcctgtagtcccagctactcaggaggctgaggtaggaggatcacctgaacccagggaggtccaggctgcagtgaaccatgatcatgacactgcactccagcctgggtgacagagtgagaccctgtcacaaacaaataaacaaaacaaaaaggaaagttttaaattttgttacagagacattgtaaacctggagttcatgaatatcatgacacaagtagagtttagggtatatttgtgtttcccaagcaggaagggcatagctctctatgttggatctcccaaagggtctatagttccccaaatgattaatatcctcagttcaagtccaactttaaatgctttcctccaaggaataatctccatacatgaggacctgctattcccgagggtgctggataaatgaggtcatgcaatattttcttttggaatgctgcttataaatcctcatcagtcttgatctgttatcagcagggataaactaaaacaaacaaccttcctccccactctcaccctcacccctgctcaattcctcctacagctcatgcctcagtctgtttgcctatagaaatatca

SEQ ID NO: 36664 - DNA, 1020 bp, Homo sapiens
gttgcagctcacgttcactgggggacctgccaatcaagagagattcctgcttagccccaaggccatggaagaacccacagggtaggactcattcccagaacactgacttctggaatggatcgcctttggtggaggagatccttgcttgctctccaccccacccccaagcacctgggattcccagccaccatttaacatctctatgccagacttcctggtccccaagtgagcaccaggtacagaataccagaggctgagctgagatgtactttcattaacacaggatgattcatcagccgccatatggttgaaattccttccccaagtcccattggctgcctttcagccacaaattagtggctgaaatatatttatgtctacaacatttggaggccatcttgggaattacaaggaacagcaagctccttgccttcaacttatgaaccaagaatgattgtctgaaaggcattgatgggaattaccagctgaggaatccagaaggaacctcaggggaagtccacagactttgttaaatactttctgagcaagtcttttgaatcctactgcaaagcgtaggaaagaaatggaggattattcactggtttgctgtctcattcctagaggagatgttgtctcattgaagcccaatctcttcactttatagtattaattatagcagttgccatttactaaacattacgggggttcctgctgtgctgagagtattattaacatcatttcatttcatcatttcaacaactccaggagaaggtatggttattaccttcattttacaggagagaaaacagaggctcagagaagctatttgttcatgcctacataactagtaaatgggtgagtcagagtttgagttcagatttgtctaactccaagggtgctcatcttaatggctattctgtaggaaacaggtttagaggaaggaaggggcatgctcacgatcacacagacagtggcagagtccagaattttcagcactgggtttccaaataagctgacaaa

SEQ ID NO: 36665 - DNA, 1024 bp, Homo sapiens
tagacaacttggagaaccaaaagaagagtttagtgtgtgtatgaaggagggagggagagaagagaatgggaaatgatgagaaatgaggatgaaatacttgtgggtaggctctgtcttgttcagtgcctggcatgtagtagtaattaaaaattcgatttgactggcctttgccctctaattatttactgtccagtagatagaatagtttaggtacttaagaaattataagaggctgccactctgcttaggtggcaaaattggactgctatggtggctcagtggtggaaggcagtatttgaggggaaggcggggattaatcagaaattgtctgagttttattaattgtagcctctgtgtgcttttagaaagacccaatatttgccattttcaaattgtgtattcaggggagaaagctttctcctgccccattgcctgtgggctggtctttttctaaatgaaaaagaaatggtggatggtgaggagtggtgggtgtcctgggcttctgggaagaggtggggctgagctgggctggcactcttggctttctaggctgagccagtttcccatccccggctctgaccccaagggacttggggattgttgtgcagcctgggccctgctggtcaccctcagctttgtctgagttggatcatcaggtcagcatctggcttcccgcagccagctgtgcaattctgattttatttgattgcagtaaggggcttaggctggccagggagtgcttgacattttattactgtcactgtcacttcatgatctgctaagcacccctgggaacagaatgtcacagttggcatgccctgagcccaattcacctcagggtcttatggaacaagacacccctcccccttcctgtcctacctcccacagttatgactgcttcctatagggaacgcttatctgaataagaagcacatgtatttgaacatgattttcttcttgtagcaaggtaaaatcctggattcttggagctggactaaaccttaaaatctcatctggttctgcc

SEQ ID NO: 36666 - DNA, 1030 bp, Homo sapiens
ggctctggtcattctgtcccatagacacagccaactctttgctatttttttagcaagtgtttcttgagcctctaatctcatgctataagctttgggggatacagaattggcagataagtttctgtcttccatagttaccttctagttgaagaacatgtaccaaagttaaataatgttataagcctatgggagagacatcactaggtagacatcaatgtatacagtaaatgtttattaactgcctactctatactgtgagctaggcgttggtttatcatcagctgaagttcactggtcagggtgcacaagggttctggaaaaaggaaaaatctcagtagggtgcaaagttttattattctaatagcaacaaatatttatttatcccctgcatggtattaaatgtattatgtagatacaaatattatcttgtggaggagggacaatcaccatctcactttacaggtgggcccaggagtccaagaacttcccctaaggctgctagtcggtgagtggcagagctgagatcaaaccccatatctatctgactccaaggtagcaatccctaaaggcttggctcttctgatgggaactgagctggaatttgaagaagaacaagcagatccaagaaggaaagattctcatgggttgaatagcctcagagctttgaactttgctaaatatttcaaggttcccctccattcttaagataaaagaaaactggtaccaacataaccttctaaatggcccttccagatgggccagctgttcaaagcaaggacattaccttctccattattacacttattcctgtagaagaacaagcaagaactgactccatcttcccaaatgcattttctctatatgccatattaggtcctgtaggctgcctcctccgcccaggtgctacctgcatgaacttgatatgagctttattaggacttaatttctttataattggatatgataattacctttgaggtgtagtgaagatcaaataagataatattaaatacacagtttctagaacaga

SEQ ID NO: 36667 - DNA, 1048 bp, Homo sapiens
ttctttttcttttggggatatacttttacttctttttctttttgcctgcttcatatgggggtatacttttaaataactttaaaaaagtgaatataggccaggtacagtggctcatcctgtaatcccagcactttgggaggctgaggtgggaggattgcttgaagccaggaggtcaagacaaacctggacaacatggcaaaacttcatctctccaagaaataaaaaaaaattagctgggcattttggcatgtgtctgtagtcccagttactcaggaggctgaggtggaaggatcgatcgagcccaggaggttggggctgcagtcagccatgctggaaccactgcacttcagccggggtaatagagaaagaccctatctcaaaaaaagtgaatacgaatagtatgtttctcttagcccttgcttatctaatacaaactggctgagtatatgattcttgggttataactcattttagagcaaaaatatgagacttgcctgattgttgtttcttcacagaaatcccctttttttctttaaaaaatctctgcatgtatgtagcattcctcttgttacaaatcacataatttttgaaaaggtagtgctatttttttatatgagggtggcttttaattgaattgatctggaaatcagtggaccctttcaatttgtatatgaataagtcttttctatctgagtacatttaatttatactatatctttggttaatgttttttcttttggttttgatgacatttttagaaatgctaagtatcttcatattagcttttgtttttttttccaatttttttcatggttttctctttttccttttcctttgcagtctgggagaatgtcccacattacagttgtgattttatgctttatcagttttgcttatttactgcttcttttgtgtattttgattttacaattacagctatagtgttttttaatattaaaaatactaccttttattttatccttttatctcattgagtcataatatttgttatattttcattttagctatttgtcctaatggcttcctg

SEQ ID NO: 36668 - DNA, 1048 bp, Homo sapiens
agctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggttt

SEQ ID NO: 36669 - DNA, 1056 bp, Homo sapiens
gttactgtacctctgtcctccctgctgagcctggagatcatttcctgatccccaaggagacccataatctgacaaagattccaggtagaaaaagtagtctgggagttgtaatttaaattctgaaatatcagaatttccagacatttaaaaaatttctccgggcaaggtggtgtgtgcctgtagtcctagctactccggaggctgaggcaggagaatagcttgagcccaggagtttggggctttagtgcactatgctgatcgggtatctgcactaagtttggcatcaataaggtgacctcctaggagcaggggaccaccaagttgcctaaagaggagggaaccagcctgattggaaacaaagcaggtcaaaactcctgtgctgatcagtagtgggattgtgcttatgaatagccactgcactccagcctaggcaacatagcaagaccccatctctgaaaaaaaaaaattttttttagctttcagtatgttagtgtttatgagtcagtgggaacagactatttgaaattagagctgagaccagtaatgcaggatgtctggtcaccgtggttatcagttatagaagaaccataagccctggtccctcctgaattccaggagctgtgttgtctgttacagtagccactagccacacatggctattcacatttaaattaaaattcaataaaattaaaacgttagttcctcagtcacacaagccacatttcacatgctcaatagccgtatgtaactgagacagcacagatacagatcatcacagaaaattctgtcggacagccctactctagagacaagtgtggaacacatgacacagccgtgaacatttagtccctggctgctctgcctatgcagtagccatttttttgtttctttacttctctaataaagttgctttcctttaaaaaaaaaaaaatgtagtccccatagaactggagacactgagaatggggtaggggccagtggttgttctataatgtcaggacttgctctgttcttcagcatggctggggcatggtgcaggatcctgggtccgcagtc

SEQ ID NO: 36670 - DNA, 1056 bp, Homo sapiens
accagccccctaaataaaattaatattcacataagggtaatgttcaaaatatgtaacaactgtgataacacaagcacatccagtcagaacagataccagctataaacaatggtgcatccactccagcgtgtaacaagtgaagttcggtcctgatcatagctaacaggacagtgtgccaagcccttcatacatgctgacttgtttaatcctcacaacaaccttaggagagttgtatcattattatacccgtttcaccaggaaggcaagcaaagctcagaccaaggcctcgcacagccggaagaagcagaactggggcccaaacgcaggtctgcttgactccaaagcccacgctctgacctgctatttttgttgttgtttaaatcatacccagactgttctgaaaacctgccatgttttatggacctctgcctcaccctttctgggattttttttttttttttgcctcttctggtattattcctagtttacttggatattctgcaatttcttagttaatggaattaataacaatctaagtcggaagtggcaaatagggccaggaatggtggccgagatgggaggatctcttgagcctaggagtttgagaccagcctggacaacacaacacgaccccatctcattaaaaaaaaaaaaaaaaagaaggaaagaaagagagagagagaaggagtggggagggagagagggagggggaaagggagagagagagacagagagagagacacagcaaataggtttctactccctgccaggccaactctgatccattggtaggggctgccccaggtgggtgttgatatgcattctgaggctgcttccaagcttatcagcaaagagtagtcagtgggggagggatctttttgtgtttcactcaccgccatatcccaagtacctaaagcctggtccaacacagaaaagacactatgagaccaatttttatgagtcataatttttattattgtattaaatcttttctaaaattatatttatataaatatcttataaatattctaaaaatatgtaaaatgtataaaagtc

SEQ ID NO: 36671 - DNA, 1052 bp, Homo sapiens
tcctgctgaactcatgttccttttgtgttggcctcatgctgaaggtatcaaaatggcttccagaagcttcaggctgaccaacccctactgcttggccaacccagcagaaagtatatgcctctttcccagtataccagtaaaggtgcaggaatcaagtcttattcttggatcctgcacccatcactggggccatcggggaagacgaaaagcaagggtaggatggacactacggctggccacagggcgcgtgaggagcagtagccccatggaaagtcagggtggtgttaccagaggaaggggagaggcatggtgggctggcaggaacaccagctgtgatttgctcaaattcacacagcagtcacagagcccttgcctggctcagctgcctggctagcctaccccaacatcacctccagtttgcaggagcactgctgtgtggacttccctcatgaggctctttggctctttactagtttgttggcttcctcacttgtgttagttcaagtcctccaagaagcagatgccacagtgggattagacacgcaagagatttatggttaaaacacttgagaggaaaaatgaagacacctggggagactaggagagccatgagaccacaacagtggtcttacatctgtgaaggggtgagggaaggaaggagagccgggataggaagagtccagactgcagtaaagctgtaaggaagctttggccaggttgatgaagagtccccaagccaaatcaccagccagaggagttcaacatctcgcaagagtgggtctgcctcacccattggctgggatccatccatgggtggacacagtggtggattcagaatacaggatctgggtgcaatgagactctctgcaacaggaaattgggtggtgcattttcatagccaccacagccccctatccctcagataaagtaggattgatatctgtaaggttggaactacatgatgtgacgctatgcacctagcacaatggcctgcccacagtaagtgcccaatcggtatttgttggctaagcaagtgagcagcctagggcttc

SEQ ID NO: 36672 - DNA, 1048 bp, Homo sapiens
tcacagatgacttaatctgagcaccatcacagagaagtcaggactaaaccccctactgagcagggcggcggagtgtccaaaggtctcagttctgtggagcagagtaccacgctttctgtggaatggggacagggtcaccacgctcactaaaatgcagtatgttccattgcagcaaagctttcgcctgtgttcaaaatgcatgtctagcagattgcagccttttaaattaaatatatataaatggttgtatatagaatatactctggactgtgagggcatcctattttggtatgcctcctggctgtggatggcatgtccagtgctctgtgagtgttttcagtcattcacattcactatgtgtttagagattctctccctgcttacagctgaaggatgttgatacaggcatcaagaaggctgaggggcagatggggcctgcaggttaaggcattgttaacttgctccatggaaatgtccatatcttaatgagtaaaaaagtgtatttttctgatacgtaaaccagaattgtgggcgtgtaggtcacatcactatttctttagcagcaaatctgttttcccagttgagagagacaatagcttctgcacaagaatatatgatggtaggatccatctgttcaattgtgtctgaaagaatctttattccaaagcgaaacctggggaaatgttttaccttcagccagatgctgtgtgtgtacttgggtcccttgtctttcctctaaggagaggtgcttgtggaaagtggaggttgtgggcatcttttcaaccttttcaatctgacctttcaacaggtcaggtgagagaaaagacaaagctatttgaacctatgtttttcttatgtccagaaatctgttctttcatcaaaccactaaaccactcgccttagcctcttctgcagtttctggtggctctatctgtgggcaagggactcctgcctgtgagaagtggccaggccctccagagcaacggggtctggcttcagggagcagtggggtgtggggaaagcaatgttcatcttggctgctccattt

SEQ ID NO: 36673 - DNA, 1035 bp, Homo sapiens
gtaatggcagaagaagcagttggttctcaccctcacactccattggcttgtacctttcttgtatcatctgtaaatcaaagaaaatgaccaaggcaggtatcaatcattttaggaagaggtttacttgccaaagttaaggacgcaagcctgagagaaggatctatgcctttctccaaagatgattttgagggcttcaatatttaaaaagagaaagtgtggatattgggggaatgcacaattttcatgtgagaggggtgtagaggaaatcgtccttcattccttgactggatcagtgaatctgcatttttacataagataatgtaaacaatagggcaaaggaagcaatctgatacgcatttgtttcagaggagcagagagttgactttgagttctgtcctatgtcatgcacctgtgatgataagctgtcaatttacattgccagggtgaaattcaacagaattgttttagggtaaagatcttggggcccgccaggaatttccttgtgggcagactgtgagggaggtatgtagctttttatctttttttttttttttcttctctttgtagccatcttatttatgaaccaaatggggaggcaggtttgcatgacccagttcctagcttgacttttccctttggcttagagagtttgggattccaagatttattttcctttcacacatcctgtcagcataaggaattatgtgcgtgtacctgtcttagcacctgtgtctactagactaggagcccttcaaaagtgaaaggaagaaagcacatccacacaaaaccttgtgcacaaatgtttgtagcagcattattcataatagcgaaaatgtgtcagcaacccaaacaaccatacttggtgactggatagacaaaatgtggtagattcatacattggaatgttattcagccataacagggaatgaagttctgatatatgctataacgtcgatgaaccttgaaaacattatgctatgtgaaagaagccagtctcaaatgaccacatattatgattccatttatatgaatgtc

SEQ ID NO: 36674 - DNA, 1050 bp, Homo sapiens
ggcctgcagttctggttctgcactgactagctctgtgacctcaggcaaattgtttacctctttgaactcagttttcccagctgcaaaatggggattgtaatctgggcaatgcttgcctaccaggattgttcttatgaccaaacaaagtctgttccatggaagcttagattccacagattttaagataaattcagatttaaaaatacattttgggattgatgaggtaaggtaatgaatgttttgtaaaatgcggcctctgtagtaattattttctccaatcactgtgtgataataattaatgtgataaaagaattactgattatgatggaatcgtggctgcttgtttaaatccttttactttaaaaaaataccatttactgggactttttgaaatgtacaatcatataaacaaaaagaaaggggaaatagctcactgagtcatggtattttctaacgactcgtgggatgggaacccagtcctggaatgtggccccattggaagcagcaggataatacaatggttagaacaggcatgttggagtagaggatcttgggctcaaatatatactgtaagacctactgatgaccctgggtgtaagtcacttttcttttcaaagccccttctgtgcagtcacttgagcttcagccaccctgttctctcctttcctgcagctccctgctgagtaaataaatctcagagaatgttggtttcaagggttgtggcagcaccctctctcggggtagagcctatggtagaaggagtggagtgaaagtgaaagccaaaacagtttctaggaatagggaactcaggcaggtatttgagtaacaatgtgtgtgagcgttgtgtgcgtatacgcatgtgtgcatgtgcacaggagctaatgaaattaaaaatgaagccgggtgcggtggctcacgcctataatcctagcactttgggaggctgaggcaggcaaatcatgaggtcaggagtttgagaccagcttggccaacatggtgaaactccgtctctactaaaaatacaaaaaaattagctgggcggagtggtgg

SEQ ID NO: 36675 - DNA, 1030 bp, Homo sapiens
ttcctgcctgtaagccagatgggcaggtatgcttcctgtttcatggatggaaggctcaggaggctgcccaaagtcattcagcaaactcggagatgggacccaggttataaaccaattctcccagctctctagtctctcatgcagcctgctgtgtctctctttaggaagttgtcagcacaaggagcaaacaagcacataattaattacaaataggtttttgttttgttttgttttgtttttgagacggggtctcactctattccccaggctggggtgcagtggtgcaatcatggctcactgcagtctcaacttcccactctcaggtgagggtctcactctgttccccaggctggggtgcagtggtgcaatcatggctcactgcagtctcaacttcccactctcaggtgatcttcccacctcaacctccccagcagctgggactacaggtgtgtgccaccatgcccggataatgctttgtattattttgtagagatggtgttttgtcatgttgcccagactgatcttgaactcctgggctcaagaggtccacatgcctcggcctcccaaagtgttgggattacaggtgtgagccaccatgcccagcccaaataggtatttggacccattttattaatttggtgagttttattttttgagacaaggtctcgtctcactttgttgcccaggctagggtgcagtgatgcaatcacagctcactgcagcctccacctcccaggctcaagcaatccttccacctcagcctcctgagtagctgggactacaggaatgtgccaccacacctggctaatttatttatttatttatttgtagagacagggtctcactgtgttgcccaggtgggtctcaaattcccgggctcaagcaattctcccaccttggcctcccaaagtgccgggattacaggtgtgagccatagcacctggcctagtgtttaagcacatgatgtgtttaaactctaggcacaagttagcctgatccttgtcactttctgcctaaagcatattttgtc

SEQ ID NO: 36676 - DNA, 1060 bp, Homo sapiens
aagggtataatcatccccgggagagagcactccttttaaatggggctactcatcctggcttggctaatggtgaacctaccttgtgggttttaaatcaaccgtgacatcaggtggtattgggtgcctgagctggcattttgtgtaagtccaggagcccttgatagtgtgcgtcactggggttattgatcgtgggaagaagacagcttggctggcatctcaccttttcctctgagtggagaagctgacttgctttaagtgcccaaagcaaaattctgagtaagggtagatttgctctgttattgttttttggaatcttaaggcaagagagtgtctacttgttggtttagaacctttggaataggttttgacagcctaactcaagttaatccagtagcttctctctctaagcctgttgttagggtttgtgtgcattttgagagagaattctatgattgggttgtcagtctggtaaggctagatgatgaccctttctctggagcctacgtggatctctgaagtgcttttccagccctggttttatttacagcttcgacaaatttaaacgtgacactagtggagtggctgtgtggtcttgggaatttttgtgttctgtgatgcacatgtttttgggagtctacagaaatgagtacctcataagcaaactaaaagctttccaaagcttgctgtaaatgcctatttttagccttacttttggctcaaatgttggtgttttagttctttaagggacacatgcagtaactagtaataaaatatgtttcgtgatatctctactttcttgtggggttctgtattctggtttaagcgtccaagtcttacatttgtagttttaagtcttgggatttgcattttggttttttagatctccctccctccccagagtatttttaaatgtttaaaatttttgtcttatcctagccataccccttttaagtataagatccaagacgtctaagttaagagatgatacatagcgaatattctggggtcaaactgagtgggttcaaatgccactgtaccacttgttagctgtgcttccttg

SEQ ID NO: 36677 - DNA, 1047 bp, Homo sapiens
ttgggcaattattaactgtcatcacttaggggtagagagtggccgaggtttatgggatatctcagacccttcagaaggctacattatccagaatgcatctcatttgctggaagaggcacagttgctgatgaactggttgagctcatgcttgcctgcttgcccctgctgcagctggctgggtgggaacaacaagaggccctgaaagttgtagaaggggcagtggggcaggcttccaggtggcagtcggcccccttctcctggggtggtccacatggctaggcttctaaccatcagctggttttacagctatgctgagaacagtgggtttgcatttgcctacagataggctgctaccctgagttcttgagaacattgggctatagttaggcttacccagcccagtttcctagttgtcagcactgtctccattgctgtgccctcagggccttggttttcccttcctcctttcagagaagagggaatatttggaactggaagggactcagaggtcattcaatctaaacctctcatttacaggttaggaacttcaagcccagaaaggaaataggagttgttcaggattccagtcaattcaaagtgaggctgagacttgaaactgctcccactacagttctgttttaactctacctctggaggaagaagtaaaatggggtagttgagcatgaacttgggacagtcagtcacagttagcgcagccatttacccactgagtgcccttggataggttgctaacttctgggcttcagtaaatggggctatagctggagtgcccacgtactaggatcattgatgaatgtgagctaggtgaatatataaaaatactcaactggagcctggcacatagtaatacgtggtaatggtaagaatgttgaatgttcttcttttgaggccctgactttggcccaggtcttcaatttgcttaacagaagtcaggtgctatagctggccttcctctgttgtcctgggtcctcttccccttgattgctgcagtttggtcctgagtatacacaggaaggtagcctacgt

SEQ ID NO: 36678 - DNA, 1041 bp, Homo sapiens
ttactcaaacccttggatataacgggttggtactacctttgggaagacttaatctcttgcatttcctctgaggtgggattggagaggcagtaaaggtccctattggctgttgctgggcttgtagttgctctgggatgttctctgctgtccctgccccaggccttttctgcccacatatcatcactgccattgcccctctgaggtgccagctctttggagatcctagacttgaagcaggtcagaatctaaaagggctttggtcactaagaagccgtctggtcacttcttttacagaaaaccaagtctgtattttgaccaaagtctctcaggtggcaccaggggggatcacagtgcctgcattaggatttgtaggctttgtttccttgaggaaagaaacagttgaaactcagtaatttcagggaaaaaaagaaaaacaggaggccctttgaatggtcggtgctgccagggggagatcagaagaggactagggctggatatagtggctcacacctgtaatcccagcgctttgggaagccagggcaagaggatcacttgagcctaggagtttcagtctagcttggacaagatggcaagactgtctctacaaaaattaaaattagctgggtgtcccagctaatttagtcacagctacttgggtggctgatccaggaagatcgtgtgagttcaggagcttgaggctgcggtgagctaggattgtgccactgcactccagcctgggtaacagagtgagacctcgtatctaaaaaacgtaagtgaataaaaacaagaacttcaaatacaaaaattagttgggtgtggtggcaagcacctatagtcccagctactcaggggactaaggtgggaggatcacctgaacccggggaggtcgaagctgcagtgaactgtgatcatgccactgcattccagtctgggtaacaaagtgagaccctccctcaaaaaaaaaaaaaaaaggcgactcccctgcggctttggtgcttgctggagcccaggccttcaggttgcagatggttctagagcatt

SEQ ID NO: 36679 - DNA, 1109 bp, Homo sapiens
aattacctagcagattcctgactccaccattgctgagcaaaaaatctctgaaggatgggacccaggaatctacgttttgacaagctcctcacatgataattcgaatgcatgccaaaaatcttaatagcttatcctggaaagccggctgcatttatggagatcaatgggtataaggacaaaatcacaagatgttagaactggaaggactgtggatgataggattctgcccacccctaccacaggcctctgaatagagagactgaagacactggagggtagttcttgccaagcatccatagcaagagctctggtgtctgcgccaggactgtcaaccagtctcttgacttctagcccagggctctggtcactcttccactttcagtttggaacatggggcaatagtctttcctaactatggtgtccagttctaacaaactaaaaatacaggggacacccagttaaatttgaattttagataaatcaaatatttagtataagtatgtcccagtattgcatgggacatatttagtctataaaattactgtttatctgaaatttagatttaacagagtgtcctgaattgctatttgctaaatctggcaaccatattctctccccgcttaccccacctttttttgggcaccagtcaggttcaagaattgccccaaagaaatgaaaaataattaccatgcatttatggtactattacttcatttaatctgttaatcctgtgagctagctgtcatggaccccattaatagttcaggaaagtgagaggttaagtctgactcctgggatcatctcggtaagctgtcattttgcctcctcatgaacctagttgcttggctctcattgatgtgtggcccagttaatgcctatcaagttacaagctacatgagagattgctcagttttgactcatctgcccctggccttgtgagttacttaattgatgatggctcttggttagtacatccaagaatggactccaaagtccacgctgttaactgctgctctaacctgtctcttaactccgtggcatagtaaattgttggtagggtggctttggggtaggggtcggaccccctctacattctctctttttttttt

SEQ ID NO: 36680 - DNA, 1682 bp, Homo sapiens
ctcaggctgaaaagatagcttttctcattgtttattaaagaagtgataccacattctcattgtttattacagaagtggtacaacatttaccttaagaaagttagaaactataccattacaaaaaggaaggaaaatatttagaatctacccccttctgttcttccatttgtaatgacaacattgacagaatactaacatttattgaatccttagtatcggccaggctcagtgtttattgttgtagaggcattatcttagtcctgcagttcttatctgttgaattcctatgagctgagtcttttagccccagtttatagacaagcaaaccggcccagtaatttgcacagaatctcacagctagtaagtaacaaagcacagatttaaatccttttctgtcctattatagaacctttgttcttaaccactctgatatattgtctctcagtccagtaaggaagtcatacaagaaaataaatggttgcaatagagtgtttataagtgttttaggagcagaagagaaagtgaccaacaatatttggactggaatttaaaggaggatgaggagtttgacaggcatgtcgaggggcttagggcagagggagtgatttgacccaagcaaggtagggtgtcatgaagggatcacatcatttcttttcagccctcaacactgttggtatataggataaggatggggtaggtcagaggctgtgtgagattgctggggtgtgtagcagaacaaggaaggcatactcataaaactgatgcaccaatccctcggtgataactacttcttccctccacttagtgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggtatgtcttcctccctggagctgggatgcaggggaaagaaaggtccttagggagctggagtttgggccaaggcagaaagccctggaagagtcatcatctgatgacttctgctgaagtctcaaggcttggctagtctcctcctctccctccttccttcctttctctccctctcttgctcattatggaaaatgtcagacacttaacaaaagtagagtagtataatgagcccatcatcagcttcggcaggtatcagtttatggctaatcttattccatctgtaccctcatctgtttattctcacatactacattgaagaaaatcctagaaaacctagcattttgttcacaaatatttcagtatagatttctaaaagatagacttgttaaaagaaaatagccacagtatcattatcatacctaaattaacagtttaacatattaacagttccttaatatcatcaaatatttagttcagattcatcccaattggcgccatatatatatttatatatatattttatatatatttatatatattttatatacatttatatataaaatatacatttatatatatttatatattatatatttattatatatttatatttatatattatatatttatatattatatatatttttatacatattatatatttatatattatatatttttatatatattatatatttatatattatatatatttttatatatattatatattta

SEQ ID NO: 36681 - DNA, 1056 bp, Homo sapiens
ttgtgtatccattcatcagttgattggcatttgggttgtttctactttttgtctattgtgaatgatgctactgggcatattcacatacaggtttcctgtagacgtagtttctcctttattttggttagaagagtagtattgctgggtcatggggtaaccatgtttaaccctttgacaaaattaaactctgttttccaaagtggaaattttggaattttatattgaaatataaaattttcgttttatatttctaaaagcaatatgtgagtcttctggtttttcacatccttccaacacttgttattgtttgtctatttttctttatttttattatttaacatttatttttgagacagcgttttactctgtcacccaggcaggaatgcagtgacttaattatagcccactgcagtctcgaactattgggctcaagcaatcctcctgcctcagcctcctgagtagctgggactacaggcatgctccaccataccaatctaattactaaaagttttctgtagagacaggggtctcactatgttgaccatggtggtcttgaactcctggccttaagcagtcctccctcctcagcctcacaaagtgctggaattacagacgtgagcaaccttgcccagccaagatgcttttttaactggattgtttttctagttattaagttgtaggaattcctttatcaaatacgtgatttgcaaatattttctctgattctatgggttatcttttcacttttttgatgcacaaaatttttttgttttaatgatattcattttctcttgttttgttgcttgtgcttttggtgttgtgcattttttgatattactgttttgtacttgtgactattgtaggactcttgaggtaaatattggtaatgagctaaatacagtttgttagaatttacaaacaatttgttcatgccttgtcttgtctcgacggcacttgaaagtagtaccagttgaggtgaagagctagactgccagcctggttcagaagctgctgccacctgctcctggaaaagtacaggcccagctcccagcatca

SEQ ID NO: 36682 - DNA, 1028 bp, Homo sapiens
cacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttgg

SEQ ID NO: 36683 - DNA, 1162 bp, Homo sapiens
tccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaatactggctggtcttccatctaggttactgctattgggtgtgaaggatgggtttctggtagagttcccccagatccggaggaaccctgcactcaatgtgcacatgaaacctcggcaggggttctgccattgggcttcgaggagtctgcctaaggcaggggcttctacaagccttgagttcatgtccaccctgtgtcttaagtgagacgtgacagtcatagccagtgccacaaaacagcagtccagcataatgccaggatttcagcgcacttgtcagcttccaggttttccatcccctggctgtggcctgcattgtgttatgagacagccaagaa

SEQ ID NO: 36684 - DNA, 1074 bp, Homo sapiens
gcatggtctcgatcttctgacctcgtgatctgcccgccttggcctcccaaagtgctgggattacaggcgtgagccaccgcgcctggccttctcaattttcttaaacttatactctcctgctgggcgtggtggctcaggcctgtaatcccagcactttgggaggccaaggcgggcagatcacctgaggtcagcagttcgagaccagcctgaccaacatggagaaactgtctctattaaaaatacaaaatcagtcgggtgtggtggtgcatgcccgtaatcccagctactcggaggctgaggcaggagaatcgcttgaacccaggaggcagaggttgcggtgagccgagatcgcgatattgcactccagcctgggcaacaagagcgatactccgtctcaaaaaaaatgaaaaataacaacaacaacaacaacaaaaaacaaaaacgtataccctcccaaatgagatttgttcgaacctgactttctatagtttgcagctcaaaaacaataggggccaggagcagcggcatgcacctgtaatcccaggcactcaggaggctgagtgaggaggattacttgaggctgggtgcccagggattcaagaccagcctggataacgtggcaagaccctcatctcaaaaagcaatagagttttcttctcaaatatgaaatgatgtaactgaatatattcttttccaactaccctctcattcattaggggcttccttccgactgggaagcagtgacttctggaaaattattctaattttgcgatatccatgagtacagcatcatatccaatgttcaaaacgttaacactctaggccgggtgcggtggctcaggcctgtaatcccagcactttgggatgccaaggcgggaggatgacgaggtcaggagatcgagaacatcctggccaacacattgaaaccctttctctactaaaagaaaatacaaaaaattagccaggcgtgatggctggcgcctgtagtcccaggtactagggaggctgaggcaggagaaaggcgtgaactcgggagccggagcttgcagtgagccaagattgcgccactgcact

SEQ ID NO: 36685 - DNA, 1042 bp, Homo sapiens
cgccaggctctgcagggtgggcctgatcccagagtggtgcttactgtgctgactgtgtacttatcttccccaagagaaaatgcttcttttgagcacactgtacctaccatctgcattgagcagaaagacttttgttttactgaagacaaaagatgtttttattttagacccagaagagaggagtttgctctgaatttgtaaataagtcttccccattcctcatactcgagcctctcctctctggttgcctcctgccaccagcatccatggctcatttgacacctttttaaatatcaggacaagtctgaaacaaagtagtaaaatgtatataactcttacctgttgtcattctttttcttttaaatttgttgctaatctctgataatgaagattcttactctgattctcagctgagctgtgagggcttccagggaaaatggaacaaaatggtgttcttaggtaatgggttgtagatactgagtcttcctttccttttctgacccttctcgaggacatttgctttcctcacacttttgtagtctctctttacatattactatatggaaatgaattgctctgtgctgaaatttgaagaccagataatgaaactgaaaagcaaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatat

SEQ ID NO: 36686 - DNA, 1001 bp, Homo sapiens
tagtagagacggggtttcaccattcacaggatggtctcgatctcctgaccttgtgatccggccgcctcggcctcccaaagtgctgggattacaggctgagccactgctcccggccaagggtctcttctatatgaaagatttcattgagtggattaatttttgcagattattattatcagtcatgatagttctttcctctccctgtctccccaagaaactttattgctgaaaatgtaattaggctattgctatagtttcaggctgtctgcttctattgcaactgaaatctgccacatattaaaagatggccacttgagaaaactgctctttctaaggcatttgaaaatttccagcaggagtcagaatgttagaaagttttgagacctccttgctatagttttccataacacatgttttctaatttttttttaaatggcagtttggtatagtagtggaaagaaagtgggttttagagtcaatagaggaacttttgaaagtagatgtgctagacattgtatcaggtgtatcatacttctctgttctttgaattccaactttgtctcttgcaaacctctggtcttagacaagtcacttgatttctctgattttcagtttatatgtaaaatgtttcatccctcaactcatagagttagactaaatgaaataatgagtgaaaagtgctttttgaactatacattgtaattaaacaggacatacctacaactttaaatagaagataataaaagctaacatttactgagaagttaccatgtgccaagcactataaaatggtttcttgaaataggttactttatttccctctaattatcgttttatttattttacagaagaggaaaattagagagaggttaagtagcttgctcaagattatgtagctagtaaatggcagagttaggattcaaatccaggcaggcagtctgattctagaacctatgctgttggccaaacacctagaatattggcttttcacatgaaaacac

SEQ ID NO: 36687 - DNA, 1104 bp, Homo sapiens
ttattggagctttataacagccctgtgacttgcaaagggatcattatatccattttagggatgagaaaactgaggcctagaaaagttaataagcaggttgctcatgatcccacaaccagtaaatcacaggactggacctgaaatccaggactgattgccagtcctgatctctttctcctgttccgtgctgtctcacacagttagaattttaccagtcagagatgagacggggagagcacaccatgtggaagagctggtgtgagcaaaggcacagggcaaggattttcgaggagtgactggtatggactgtaaagtgcatatagggatattgtttacagattccctacaaataaagggtcggggcatagagggtgtattcgttggcttggataccttaacaaagtgccacagactaaatggcttaaacagcaaaaatgtatttcctccccgttccggagattagaagtccaagatcaaggtgtctgtaggttcggtttttcctcagacttttttccttggctcccagatggctgtttctctctgcatcctcacatggtctcttctctgtgtgcacacatctctggcaccttctttctgtgtgtccagatttcctctttttataaggacaccagtcagattagatcagggccctctctaatggcctcattttaacttaattacctctttaaaggccccgtctccaaatacagtcacattctgaggtcctgtggggttagggcttcaacctataaatttggggggcacacaattcagcccataacagaaggctttagtttatttaataaaaaattaaaaacaatggaaaaatctttatccttaaaagagatatgaacagaacgcagcttgggggacagattccatgtgttagtcatatgtagaatgagttgcaagtaggaatgaggcaaataaattagtcaagataattaaagttatctacactgcaggcattcaaggctgaatgagggtgatggcactggggtacagctaagaggatatggatgtgagggacactggcttagcagtcacctgggactgcactgactgagttcccaggaagaccaggtcaagacaccaacagagcag

SEQ ID NO: 36688 - DNA, 1050 bp, Homo sapiens
gaagcaggggctacccaagtctcctcactaggatgagcatatcagttatcatccaaaatcaggtgtatttgagagtgaaaaagggccctattaataagacagcagggccgtgcatggtggctcatgcctgtaatcccagcaatttgggaggctgaggtgggaggattgcttgagcccaggagttcaagactagcctgggcaacatagtgagacaccatccctacaccaactacaaaaattagctggatatagtgttgcatgcctgaagtcccacctacttggcaggctgagttgggaggatcacttgagcctgggaggttgaggtttcagtgagccatgatcatgccactgcactctagcctggacaacagagcaagaccctgtctcaaaaacaaaacaaaacaaaaaacagtaataagacaacaggtgtaaaccaggatgtgtgtgtccccattatcccccacaggtgaaatgcaacgagcagcccaaccgagtagagatctatgagaagacagtagaggtgctggagccggaggtcaccaagctcatgaagttcatgtattttcaggtgagtggggaggggcaggtctgcatctggagaactgaaaaggcccctagttttctaaccactggggtctgcagttttgtgccatgttatttattcactaagcaaatattttttgactgtgccctacacatccctgggtgagcaagacggatgagtctccccaccctcgtggaattttcatcctagtgagtatgtgagtgtgttttgtgtaggaggagagaaagacaataagcaatacacattaatattcagggaataataagtgctgtgagtaaaataacattttgaaaaattctgggttatagagtgcctgtgatgtgagtgctgctttagggacagcctctcaggaggcggcatttgagctgagactcagagagagaggctgacgtgtgatgaccaggaggaaaggtttcaggcagaagttgccacagaggcaaaagccttgaggctgaggccggaaggagcttgctgtgtttaagaaa

SEQ ID NO: 36689 - DNA, 1050 bp, Homo sapiens
agcttcgggccaggtatggtggctcatgcctgtaatcagtcccagcactttgggaggccgaggcaggtgggtcacaaggtcacgagattgagaccagcctgaccaacatggtgaaaccccgtctctactaaaaatagaaaaattagctgggcatggtggcacacacctgtaatcccagctactcgggaggctgaggcaggagaattgcttgaacctgggaagtggaggttgcagtgagccgagatcgcaccgctgcactccagcctggtgacgaagcaagactccgtctcaaaaaaaaaaaaaaaagaaaaaaagaaattagcttcggatttaaggactcctctgagaaaaattgcctggcagatttgcctttctcgagagggctggctctgaggagggccctagaggagcctggaccctgcccccataagggagcacagtggaccttactcactgcccctctgcccccagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagaggtcagggcaacctccccctctcccctttccccatccaggcccctcctccagggctgcctgtcaagtggaggaagagaatggagcccctctcacctgctttttctttgataccaaactagccatcccccaaacatagtgaggcttggcctgtttcagtgtggtttgaggaacagggcatagagctgggccttggaagaacttgatctttgtagagttttatatctcaagatggaatcaaaccctcagttcccccatctctggagcagcagcattttatgttgccccatgtaatatgggaccagtaagatcatcacaaaatggttacattagtcattttctgcaagaatcataaagccaattcaaacagtgtatgtaaaagaaggaaatgaattggctc

SEQ ID NO: 36690 - DNA, 1179 bp, Homo sapiens
aatgtctctcggctcccgcaaggatgcccagcccgggcagagagccgaggggccacttcagcccctcctccctccccagatccctgggcaggtggattccatcagaacacaggtgccggccggaggggagccgcgagggtgctctgagcccttttgtatccgccctctgctgccagcttcaaaagggctcagagcacagccacgccccttgtccagcccagcagtgactcgcatgtcctctcagcaggacagcaggagtccacctcgttccctgaagagtggccagccctcagtggtccagtgaggagaggtggcgttgttcctcctcacactgatcctctcaggttaggtgaccgtgcgctaagtccatcgtgcagtcgacgtgaattgggtgggcagcctcaccttcggccgctttataaaccacaattctgggtcatctatgcaaaggcctggggtgtcagtgcttcactgaagttggggggctccaacctctgctgctcttttggtctctgaggctgttagggaggttccttctgtgtgcttctcgcccgaagttatggcctctccacacagaggggaaccagccgtcctttagtcaagggcgagtgtgttggcatcttaagaagatatgaatggagtgtccttgaactgcatccgcctggagcctctgcgaacaagtgtccaaaggaaagctcatgtagtcgcttcatcaccctctggctgctagcgcgtgacggggttttgcaggaaaagcagggaatggagaatgctgaactcattcctcacttttccctgcctgacttctcgaccagctgaagctggctgggagcggaggctagggaagtgactggggttgggtgtgaggggccgtgtgctcccctctccacaggtaactctttgagtgatattgaagggaggcctgaggaaggctgtcactgttctaccattcttgtgagaaccatatcagggcttcttttgaaatagtaaattctccccagaatctttcttctgccttgtctggtgctcatgcttcatctgtctgctgggtcaccagcacctgagggtagaagagggtgaagggagtggtcctttttctcttggggatggagagtgaagatgttcattcattcatttcctctctgacttaggatggttttcctaatgacatcttttcac

SEQ ID NO: 36691 - DNA, 1048 bp, Homo sapiens
aggcaggagaatcatttgaacccgggaggtggaaattgcattgagccaagattgtgccactgcactccagcctgggcgacagagtgagactctgtcttaaaaaaaataaataaataaaaagtaaaaaaatatacctacatggaaggctatgctcagcatattgttaagttaaaaaagaaacaattaaagaacagcatatctgtagttttcatgcagacagggaagatgcaaaaatatatctagaaataaatatgcatatacacataaatgtggatatttttaaatatgtaaagaaatatgtaatatgtctaaatacgtatatcaacatataaaaaataaaaatccaaatatagacatttagaccaaaaacagaacagcatataaaatgattccacttataccaaaatataatatacttttatatatttgtgcaaaactgaaggacataaatatttatgatgtataccaaaccatgaacagtagtaatttctggaaacaggtctgtctgatttataaccttttgtattgtgttttgtttgattacaaaatgatgtttctatttgggaggaaaactcctttacactaggttgtgagtgacagctatttctttgaggaccatttgacacctacaagagacgaatctagaaatcagagacctggatcccagccccgggccctctggtcacttcagctctcagagcctcagattccttatctgtaaaatggagctaatcaaccttcccctgccccatcccagggttattgtggagaatcaaacaataattgtcaagtaagataatggatgtagatgagctctgaaaacttaaagggccatacaaatgtaagagattagagtcgtcatctctccaagcttcactttaaaggactgaggctcggtggcataatttcataatcacacttgacattgtcctgagtggctccagaccccttggcacttctattactaatgggcaacctggaagaaagttttgcagtcatcaccagaggacaaagtcatcctcaagcctatttaaagtgagacagtcag

SEQ ID NO: 36692 - DNA, 1045 bp, Homo sapiens
gggtacaagtagagggcagtttgccagggagatccgttctttccagaaggaagcactgagttgacaagaaatgaggccatatgtcccaccacagggagagctcagccagacagaatcatttaattcagccttgcagataaattctgaagtttcccagcccaactgcccttcctatgccttgtcagcctcataacagctatgctcagaaaagaatcatctcaggagcaggtagcttgtattcttaactgctacctgatgtgttttagtcccaaatgaatttttacaagtcttggttttatttgcaccctggactttttctttggactgactgtaaagtaagttgcttctaagcggtggaggctcaaggaacgtaagagagggatgaaagatggtcttttcctgactgtgaacttgtttctatttcccaagcaagtataaagctgtcttccttaaggggggttattagcaagcggctggctgtgtttttccctcttcaggtatgtcctctaccctctggatctgtacaacgacagcgcctactatgctctgaccaagtttaaaaagcagttcctgtacgatgagatagaagctgaggcaagtgatgtgcttctctttttgctcctttaatcttgttccaaattccggacttttccagtcttttgctattagcatgaagtaggagtatcagtgacttgttctggagaggaatctctgtaaccatggccatcagaaggcctgtgtaacctctgagggcagaagtacaaactgagacacccagctcagggcctgctgcctttctcttcccacccacaaactctgtgctgcaccatgaagggcttcatgtgcatgtgtataaatacccaagctctgcctgccaactctgctcaaaaacagtggcccttggctagacctaaaccctagggtcacacacacccatagtggagtccaccctcagaggggaagccagggaagagagcacgtggccctggaagaggcttgagccgcctgtagaaggcttctcagaactggttctagaaggggagaa

SEQ ID NO: 36693 - DNA, 1088 bp, Homo sapiens
tcagcttggtcggtgttggtgtatagcatgagcctttagggttttctaggtatacagtcatatcatcagcaaacagtgacagtttgatttccactttactcacttggatgccctttatttctttctcttgtcttactgctctggctaggacttccagtactatgttgaatagaagtggttaaagtgggcacccttgtcttgttccagttctcgggggaaattcccccactttaaaaatgagaatattataatgcctgtcttgtagtgttatttgtaacagatgaacccatgtctgtaaagtcctgggcttacgaatagtagctgttattattaagaagaaaaggtcagtggttcagagccatttcctgagttggtcatagcttcatccagaggctataatgagcaaagtttacaccctgaattgcatagcacttccttgcttttcctctcttaaatcacttttattggttttattttttaatgtatatgctcattgtacataaataatattgaaaagttcaaagatgacagtaaaactcatacaactcagaaacttgggaactttttctgcatttaacatgtgtgttctcgttttacaaaccacatgacaactccttgagatcggccttcttatcaccattgtacaacgggagagactgaagctcagcggggccggcttggctgctctcacaaagcaaggtcctggcaaacaatggtgtaagcctgggcctgttggccactagagctggagatcctggctggcctctttgatgctctgctgctctgcttgtaccatcctgtaacctgtgattcttcagtccatagtagccctttgctttgtgattagcttcccttgagaggtagggccaggacttcatagtatggtggactccagaatgctggagcaggtgaagaactaaaagctcttacagagaacatctaaccacctgatgtggtagcgtcagggaagacatcaactcatttggagaaatatgaccagcaagtgtttcctcttctgaacaggccctactctggagtctaagttcttctgtgcaagagctctgtcacttagagatgatgctcaataa

SEQ ID NO: 36694 - DNA, 1031 bp, Homo sapiens
atacaccaggagagggacctatttgtacgtgtgagggaaggcaggcctgagtcccccgggaaggacagagccctttagtctgccttttactgcaaggcctcttgcctggagtgttctttgccttcatctctgttacttcttctctccttattagagtggaccacagaaacactccggtcagtcatttgagagcattactgccctcaccagaggtgaggagagtctagacccaaactcacagatccgaatgccagtcagatctggaaaggcccccagagaccatccagggttggtttctcaacctcagcaccactgacatttggagccagataatcttttagggggttgccctggactttataggatgttgaacagcatttctggactatattccagtagtacccttcattgtggcaaccaataatgtctctagatattgtctgatattccttaggagggtaaaacctccccctgttggaaactgctcatctagtgcaacctcaaattttgtagataggaaaactgaggcccaagagggagctgattttcccagcattacagctagtgcaggagtctggatgaaaaccagatgtgccttggagtccaaagatccttaaggttagcgtattacagtacagacagatgcccagctgagctttgccgattgtttttgttcttttcaacagttccatctccacatctgaccttctgtctcctacttctaccttttaatgtctttcctctaattgttttattacataattgaaataaattcattgattgaaaactcagagaagcagaaagaaaacaaaaaccactttgtcacactaagatgacctctgttcactttttttttttttttttttttaagacagagtctcactctgttgcccaggctggagtgcagtggcatgatctcggctcactgtaacctccgcctcccaggttcaagcaattctcctgcctcagcctcctaagtagctgggattacaggcatgcaccaccacacccagctaatttttgtattttta

SEQ ID NO: 36695 - DNA, 1065 bp, Homo sapiens
tatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctg

SEQ ID NO: 36696 - DNA, 1069 bp, Homo sapiens
cctttgagaaaaaagaaatagaaacttacttgatgcagaatggatatttatatttctgcttgcaccatttccatagcagctgacaaaggcaaaatcatgaaatagaatcatttctataaattgcttctttaagttttctctaaattttgcctctaggaaaaaattaaaactattcaatgacagctagctgtcactggtgctaccccaaagctttccaatcttttatgtattttttgtgaatgaaactgttgctgtaggaaagtcaaggttcatgtaagagtatcgtggtgtaaatataatggtttcacagctgtttgaatttttcttttcctgtgccagatatagaatgcagtcaaccctttttcagtaacttatgttcaccagtctgtgcttttcttctcccagaaggcttttcttagtggttgtaaatgcaagaatcctgagccctgtgttgcaaaggtgggtggtctgtcagcactttctggcaaattgagttgatggatttaagataagcctttggggttcctgtcagttttctgggccctgaggaagggttgggcctcctttactctcagtattttgagtgtttttcaaatgtttgtacgttatcttgcactgctctaataaaaatgaaagctctctgacaagaaatagttctggatggtttgaagatctgcggggaaaaataagtgtgcacctgagaccttcagttagtcttttatttatttagaataaaaaatagtttgataacctaccagagttagtgcttctttaaaaacactccttggaaagatggggactgtcccttaggaaagccataaaagtgattcccaatactttgcaattgcttttgatttttagtcctttggaacaaatgtgtgatgttatgtctgatgttgtgtttttagagctgtgaaaagtctgaaaaatttcaaggggtattatttaaatgatgattatctggctgaattatgtgtgagctagaatctagggtagctgtccacttctttttctgttgtcctgacagtaaagcaaatagtaagccatgtcttgaaagtgatttgcttgt

SEQ ID NO: 36697 - DNA, 1050 bp, Homo sapiens
ctcctccatcccagtgtagccatggaaagcttttagcttactcacctttggtattagccattgttgggttatattagaaaaatcaccgaagtggcttgggaatgaggcttagcatggagaagtcaccaaaagaagagaattcttttaaataatagcaataacaataatcatagttaacttttattgtctgcgtgactatttgattaatgtctccccctctagcctggagtttccagtagtgaagagaagacaagtattttcacactcttttatatccactgtcttgtggccattccatatttactgaatgaaagagtcaactgttaattgtgagttaggcaccattggcatagatcctcttgttcagtcctgacaataatcctctaaggcaaagactgttattacccccatttgattgacagagaaaaaagaggcagcaagggttttatagttattaaagcagggtttcttaactctggcaacactgtcattttcggtcagacaattgttgtggggggctgtcctgtgcattgtagaatgtttagcagcacccgttgcctctattcacttgaagccagcagcacagcttcccctccccatttgtgacagcaagaaatgtctctagatgttgccaaatgtccccttgagggagaaataacccccactttttagtaggaaagatggcacgtcttgcctgcccttcaccgtgtgcatgaatggtgatatgtgctacatttattttaggtgatgtgttgctctggtgcagcttaagtgggggtcttttgttaggctgcttgagtgtgtttttgtgtgtgtgagcaggggatactcagccaggaggcatatcatgtttgggctctgggctcatggcacatcagtgataaactgggcaggtccctcagcctgaaacctggaagaagggagaagactccagggagtttgggaggttccttctgagaatcaaattaggtctgagagaaaattgtattgtctgtcctggaatgatttttgaaggcagtctaatatatgtaaacagcaaagacttaggag

SEQ ID NO: 36698 - DNA, 1047 bp, Homo sapiens
caaagtgagaccctgtctctacaaaaaacccaaaatattagctgagtgtagtggtgcatgcctgtgatcccatctactcaggaggctgaggaaggaggatagcttgagccccgaatgtcgaggctgcagtgagctataattttgccaccgcactccagcctatgggaacagagcaagaccctgtatcaaattacaaaaaaaaaaaaaaaaggcaaaacatacctttaaaataaaggggggaaaatctacctataatctactttaagtcttctgtgaagtagtattgcacactgatagctaagattgagatttcactgtggagggcaatagaaaaaagcaggtaacaattttttttcacattcacggtctgtttctaacatatacatgccttcttttgagggatctttgtcttaatgttagcaactactacagtttgtgtccctgcaggtgcccaagaaatgttgagtgaattaaatttcattttgaacccagagatactaattaaactgattttaagtgatgttttaaagatgaaaaagggccaatgactatatatttctccacaaacgatgaataaaatagttttcagaaagtttggagtgtgtgcttaaaactatatttggggggtggcctgatttttaaaatttcctgtaaccacattttggattatttcaaggtccaatgtgatacaaaagttggagaaattgaaaataaattttataaaaattataatgaagaaatatacagcatagaagaataaaagggaaacaataaagggttaaaagtacagattccagagctgtccagttcagcagccactagccacatgtggctattgagcatttgaaatatggctagcatggactgagatgcattgtgagtataaagtacacaatggatttaacatgatttagtataaagaaaagtctgtgaaatctctctctttctgttttccccccatcagaactctacttttgcattcagacaggcaggggatgcctcatcctttgaatactggcacattaagagcagtgacataggtaagaa

SEQ ID NO: 36699 - DNA, 1048 bp, Homo sapiens
taaagatgaggatttaattttagtattaatgatctcaaagctggttaatgtctgacaatgagcagatacatgatgcaggtatacttcatgaatttgtctcatttcttgttagaagctgctagactcagtgagctttaatttgctgagactgacaaaatgcagattttcactgaacctgactagctggttttcaacataaacttttgacacataacaatatgcttatattgacactatgtatacctgtgcattgcctagaagtaggaacatggaaaaaagtgatccaggcacccaagtttaagtttggaattgatagagtgtcagggctgatttaaaaagagagtttaggtcttgatttataaatttcctaggttcagagttcttttgagcatggattacctgtatcttacagataaaagttgtttaaaatttattctgtcttgaagacacactgcagtaagtttacttttatcaatatttaaaagaaaattaccataagtatgctagggactgttaattctgatgcatttaaacttttagttttgcttagaaaacttacttatacagattttttttaaagaaattcaagcttttcatatgtattgtattatcattcctcgtgttttagctgcaacaaatatgaagtggattgaagctaaaatgaaagtaagtgttagaaagcaatccatttaaaaatattttcaaactgcatttgtcttgttaaaagttctagaactgaattaattttattcttactggagggcacttagtagatagataaatgccattattgggagtagaggtgtttttaaagtgtgtttaataagtggattgtactgaatccctaagtcttttttaagaaaaagtataactaagcttgtcccctcccccacattcttcctcattttacaataatactttattttccttcttttgctctagtgtgcaatacttaaagagtcagtattctcctaaaatggtaaattaggaagtaatctatttctattttccttggtttaccatttattgacttggctaagtgaaacta

SEQ ID NO: 36700 - DNA, 1023 bp, Homo sapiens
tctcatactgtaacttaatgtcaggataagataaaacacatgtaaaaatttcataaatagtattaaaaattaccagtaacttgagtgtagcagagaaattagaaaagtttatcctactaaaaaaacaattactcataattttcctttttaaagataaccactgttaccatcttggtatatagtctttcagtcttttatctaaacccaaatgtttgcacaaatctatatagacgttgcctataaacatcaaggttttgagacagagaaaagtccccagagaagtggaaggtattactatgtattacagtatttgggggggaattagatctttgaggatctggttccagtaatacagcaccaaaagaaactatttgtgtaataataacactttggcttttcagattccacttttgacttttcagatcagtttgacacaagtcttctaagagtctataatcctaataggaagataaagcagacatttttacccccatctttaaattgcaaatgatgtaactgagtcatggagatagtaaatacttagtgcagtgccacaaagtgagcaaattgtaccagcaaaacatgtccaagtttgctgattttaggaactctttccccatccccacaccaccaattatagtagtttgtaaatgttagaaatagagatcaagtttttaatttagtggtagatttctattaaacaatatgaaaaacacttgtttgcttagtaatgtcttatatcttttacactcttgatcaaagacctttagcatcttttgcccactgtcttgatgtaacaaaaataagatctttatggagtttgatctgtatttggaagttacaatactagttaatatagtgactttcacattggaagtaaggcagtatggagtggtagtcaatgagtatgacctctggagccttgttttgaatctaggctcttccactttctagctgtgtgaatttgggcaaattgcttaacctctttgtgcctgtaaaataggaataattctaatagtaact

SEQ ID NO: 36701 - DNA, 1061 bp, Homo sapiens
gttctcagacccctgggcagcttgtgtggtgtgctttatggcagtagcagtggtggagcaaccaacccacttagacccagttagtccatgttggtgttgctggtggctgccatggattggttgaaatagttctcagtcccccagctgcctgtagcagggtagtgggtattgtcctaagtatgcttaggagagcttggtccatcttgttcctcttctggctgggtggcagctgcagctgtgtcaccttcaacttggcctgagggcaggcacagcccagaattaaactctcaaattgatgccttggccttgagactagagaggttggggcccctcccaggcaagcagcatgaacaagaagctgtggcgggtgcagtctgttcatgtctcaatctcaacagcaggctgcacagagtggtaggcattttctcatggggtacgtgggagtgcctgatctcgcctctccctccttgaagaagtgcaacagcagcagccatgtctgtagatctgtggtatctagcttctcaaaatggtgtccagctgaagctgctctaggcttggatgtctgtggaactctgtgtgtgttcccttcctggcgcaatgcctctgtgcaatctctaggcagctctctatgtcaggcctgaggccctgatgggttggaggattctcccatagccaagattgtaatagtctgttttggagtgtgaagccctgggggttactctcttactgtttccccacatccaggagcctctcccagctctcagctagtcccttgcctggcaagctgccttgaaccctctcctcacttacttctggtgattcccatcacttctctggtgaatcctagtattctctcctagatgatctgtttgaaatgtgagtatctactttactatcctggttctgctctatggacaaagacctatgtctagtcagtcgtcttgatcacactaccctcattgtttttgtttgcatttcccagatgatatatgatatgaagcatcttttcatatgcttatttgccatttgtatgttttcttatttgcgatctgtatatcttg

SEQ ID NO: 36702 - DNA, 1145 bp, Homo sapiens
ttttatgtcacttcctaggtaaaccttacttccccctataggaaacatggttcactcaaacaaagtaaataaaagggctttcctgaaggtgtgggcagatttaagggaatctgacaagaaaagtacgagctaagaaggtctggcagccactcccctgctaagctagaacaggcaggaagggagcacttactggggccaggtggtggtagctgtagggatgtaggacagggcaactcaggggacctgtggcctcatgcagagggaggcagccaatctatagccacctatcagggagggagctgggcaaataaatgtctccatcttgttctcctccttcttctctccaatctcctgccagtgcctccactggttgaacctagctgggagccagtggatcaaagatccagtggaccaaaggatccataaatgtgatcctcctgggggtataaaaaaggatagaaataggtggaaagtggatctgggagtggctaaatggaaaatatccaggatgttccaaattgcattcctctgctatatgccttcccagaccattgcactgccccatcacaatgctcatcctagtttgtcatatctgctgaaggattaggcatgcagagcatatgcctcatggaagttaaggactgtatctgacttgtcattgctgtatgcccagaacctatccctgcatctgattatcaatgatgtgtaatggagcttggaacgtgaatgggcacatatgtctgatgtcctcacctgaccattctttgggagccctttggggatagtgaatctcccagtaccctacttgggcacaataaggactatttagtgaaagaacattcacaattgagtgaatggatgaattctaagggtggatcactttgaaaatacctgaatgtcaatctcatggtaccaagtttatatcagaattcaacctcaaattaactaacttccattccagatctgttcctttcttggtgacatggcagcatatacatgcctcattttctcctgccttatatccatatcctcttggtctggtggcacaccttccatttcttcacaagcaacctgggatgattagcttaggtccccagcccagccctactcaatggatgagcttcaactaagatggggacaaggag

SEQ ID NO: 36703 - DNA, 1085 bp, Homo sapiens
ccacctctacaattaatttcacaataggtctacagttagaactgagcagtgctgtggtgtgtcgctaacagacgaaggaggaaggagaagggctgagggaccaatcctttatcttccagtgctaggccctttcccaaacaccaagctactgccctggcgcccctatacctccaagcctttgcttgagctccctctacctggagttccctcttctttcttcgttacctattgattttgttctttagaactagagagtatcacctggaagaaatcgtttctaatcttgcccttctccgtgggttaggagtctatcctctatgtagacccgtattttatttcatcattaaaagatgtattgtttgtaaaaatagttaacataaacacacggtaaaaagttcaagcacacaaactgatataaatggaaaagttgggcgttcctttgcctctgaccccagtttccctctcagaggccaccactgtttcctgtgtctccttccagaacacacacgcacacacacacacacgcacacacacctctgcacacacccccactgtaaatggcctacctccccagactccgaaccctccgaaggcggggtctccttgtttgcctccagggccctaacgactagggcagcctgattccctgcacaaattcagcaacagactgctgaaagccatgctcttgcacaaggaaaagtgggagggaaggggatggattctgtctgagatcactgggtgccacgctctatgatctacgagttgcttttaatttcctgtgctcggccgccggcagcctgatgaaatgaagcagatagcagggcttcagatctagcccttcctgggctagggcttgtctgcttgctgcaaggttataatctccagactctgaagagagaagagctacgtgcactgtacccccacaaccaccccccaccccaccctgttgctgcagcctcctgagccagggaataggcagaaatgaagctgcttgatgttgcctatggttcctagggcagtggttctgagttggccatttaggctttgaggccagacagagatggtttggatcctggttctgttgc

SEQ ID NO: 36704 - DNA, 1055 bp, Homo sapiens
gtagctgggactacaggcatgtgccactgcacctggctaatgctcctttctaagataaaaaccagaaaagtctaagaatagtccctgtgaaggagggaggcagcaggaatccaggactggaaggtccaggcatcacacagctaactgaggcctgccttcctcaggctggaagatagaagaggcaggacaacaaagtttgcttcctctcctgctaagaagggaggatgggggttaaactggatttgctttcagctcttgaatcaacatcgagcgcccgtcttgtctgccagaccatatggtatgcagaggcagacttggactgggttttggcagatggagggagctatgctgaaaatgacagagtctagcaactggggaggcatgggggctggcaggtgagaacctcaggaggaggctggttgggagcaggaggaaaacgcaagaagcaggagacaaagcaaaaagaaatcattttccagtagagaaaaagggaagaagcattatttgtcttggagagtagcaaggaccgctgaataaggatgtgtgtacagtgcaacacaatgttttcccagatcttttattttgccacatttgtgtgctacctatactatattcagttaagattttttctgtatactgacttttgaagaatgtaaacaaatttattttaaaagaaaggttttatcactgccacaggtgaaaagtttgtcataactgtatggtaatcctaagcatgaataaaaagaaaactttgtgacgatattaaattctaaccacatactacaacctactaaagactggactttcatctactgtttctttaaacgaaaatagagtatggaagacataacatcatcaaattcagcgtttttctttgatatttacagaaagtttgaaaaagaatatgatttgattgattttggagacagttagaagatagtggataggaaacagtactaacatgcagctctcacttggatggaagaacagcatgtggagactcacattgtgaacttttgcagtgaaacacaccaggaaaactgaaagagttaaca

SEQ ID NO: 36705 - DNA, 1064 bp, Homo sapiens
ctctgcccctggtagttggctgggtcgaggaaaggcaagccaaataaaacctctgacaaacttaaagtttcctctttagctagagggtacttttagggtaagggactatttgattctttagtataagatttttagaaacagaggactttagagtcagaagagctcttacacatcatccagtcatttggcagaagaaaaatggggagcagaaagtttaattccctctgacattggaactatgcactattctgagtaccaaggcaaggcaatctcatgtgcataaaatattattttacactaggcactatagtaggttttatacacaaattaattttatttcttcctcccaacaattttagaaaacaaatgctgatatcactgtattgcacaagggataactgaagcccagagtttcaaaatctttagacaatgtggtagcttgcattgttattttccattttcacctccttctccccatattggtatttatcactaccacatagatgttggtcttggcaatttgacttgctttgaccaatggaacatgagcaaacacagcataggtcacatccatccaagtaaaggcttttaatatgattgcatgattcaacttggtttattgttcctgtgccctctgttatgagaagtcatgtcccaaaagctgcttctccattaacttgggtcttgcagtaagaaatgaatctgagcccaccaatgcctgaggaagagctacaactgacctgtagccaacactatgtaatatgagaaagaaagaaatattttgtaagccattgagagttggaatctatttgttacacagcatggcctagtgaaaggtaatgaacacaaatggacagagccgggatctatatccagacctatctgcttccaaatgccatatccttttccccaccaaacagtcctttctgtccactccggtatgctttagcctcagtagcaaatactgctttttcagacccatacctttaaactcccctctccagcacccaagacattttccttgaccattttctttaggctcaatatcttgctcacacaagtgc

SEQ ID NO: 36706 - DNA, 1095 bp, Homo sapiens
gtgtgtctgcttaacaaagaaattttcattattttctgtgaaccttcagttatgttcatcttgtacttcaggagtctgtaatgtaacagtctttttgtttattttcaaaatgtatatatactttttagttttctgttatgaacttttctacggttggctgctgagatttctgtaatgaacatttttatgtttatgctacatttatgtttatgaacatttcctgtttatgctaatcccttgttagcaaaatatgactgcctgaatatcttggtggggttttggttgcagaggtcttgagaaacagaattgtgtatgattatagctagctatcctttgttgaatgcctacaatgtgccatccactgacttaaaatgttacttgtgttttcattaatcatcacaacatgcctatgagatacatactgttatttcccataaggaaacagcttagagggatgaagtaactagcccaagatcaaacacctaatgaattgcaaaactaattctcaaatcaaatctgttggattccaaagctagagtataatgtataatgtaataacaaaaacatctgtcttcctacaaagcagatagactaataaaatgtacactctcctgtttctttgccctggggccacacccttaactgggcaagccttcacttttggagactgaagtcctgctgtcctacttccttctgattgcacaagcaaggtagtctctgaagagttactgtaatgtcttgagtttgtctacaaagaacttgaactagattgtagtttatgccactaaggagctcactcactgaacaggttgtgatacattggtattgagatgagataataaatgttcagcctaagcctaacagtgggggtgggaaggtagcctggggtgggtaggagcatcttctctttctctctccttagacgcttttcattatcaaatcagttagctttaatgtgaacgtgttcgtttttgtgctagtgtgcaccaccagaacaggaggaaaaagggcaaaagtgagccaagttcataaactaccacagcaaatacagctcaaaaaaattaactactgttccataacattataacaggtttc

SEQ ID NO: 36707 - DNA, 1045 bp, Homo sapiens
gctcaagtgatgctaccacctcaagagtaacagtaataataatagaacagcctaagtcctgtggtccaagcccttgattcagtgaggaagaggtttgtttttgttttgttttgctttgtttttttgaaaccaggtcttgctctgtcccccaggctggggtgcagtggcacgattccataattccactgtagcctcaaattcctgggctccagtgatcctcccacctcagcctccagagtagctgggactgcaggcatgagccatcatgcccagctaatttttgtatttttatttttatttttttgttttgtttgtttttgagacgaagtctcactctgtcacccaggctgaagtgcagtggtgcaatctcagcccactgcaacctctgcctcccaggttctggtgattctcctgcctcagcctcccaagtagctgggattacaggcgcctgccaccacacctggctaatttttatatttttaatagagatggggtttgaccatgttggccaggctggtctcgaactcctgacctcaggcaatccacctgccttggcctcccaaagtgctgggatacaggtatgagccaccgcacctggcctaatttttgttttttagtagagacggggttttgccatgttgcccatgctggtctcaaactcttgagctcaagcaatccaccctccttggcctcccaaagtgctgggattacaggtatgggctaccacaccaagtgagatttatttttaacataggtctcgaaatgactataggtcagagctctggaactgaataacatgttttggagcagtgtcatccccttttcaaatgccctagttcttgacaccaagggaattaaaagtgactttttctttagaactatgaagcatataagttctgtgagttcacctttttgcagcagcttctgtgcattactcagttctacttcctgcaaacaattctttatttccacacctgtggaagacagtatggtcttgtagttaagaggatgaactttgttgttttgttttgttttgctttgcttt

SEQ ID NO: 36708 - DNA, 1031 bp, Homo sapiens
ataaataaataaaaaataacctcagaattacattctggagcctttcgctttgctacctcaactttcagtccttcaagttataaaggcaagatgagggctgggcacactggctcacacctataatcccaacacactaggaggctgagatgagaagactgcttgagcccaggagttcaagaccaacctggccaacacagtaagaccccatctctactaaaaacagaaagaaattacctaggggcagtggtgcttgcttatagtccccgctactcaaaaggattgcttgagtccaggagttcaagtttacagtaaactcttatggtgccactgcactccagcctgggcaacagaaggagaccttgtctctgaaaataaaaataaagacatggtaagtatttctcgagctggctgctcaggccggcccgtagcactgattcctttctgtatacttgagacgtggttttgcccattgggaacttgatgttataaatttcccaaagaatgattggtctcctaaaacatgaacacacatacacacgcttacttcacaagagcctaatccggcaatctgattgattcatctgtgttcatagaatattcctaatgagttggctctgaagagaagattatagatcagaaaatagcttaagatttacagtcaatgctaaagaaattgaaaactcttaaagagtgggcattaagatctagtaacttgatgatttaacccctctctaaagaatttgtttcttaaataactgttaactgaatttgttatgttgtcttggctctccaacatccaacaccccttcctatttggaggaattctcttgtgttgtgatcttgttgagtggcagtaccccatgtctctcacttcatcctctgataaccaaggcttgtgatcgatgcttggtatattagatgcttctgaccaagatcttaaatctagattgagtgaagcaaagacaatggaatggttagagttgatttgctgtcattgcagccctgtcctggcaagtctttcactaaaagac

SEQ ID NO: 36709 - DNA, 1027 bp, Homo sapiens
ccaattgggccgcgagttgtggtttaaaccaggagtgcgccgcgtccgttcaccgcggcctcagatgaatgcggctgttaagacctgcgtgagtgaatgggagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttgtaagtatacaaggctgcagtcggatacactggtattgtggacgtggcctggagctggacgagacatttagtgtactttttgggcaattggagtcgtttgttattggtcctttttcatttttaatatcttaatgagatgatttaaggaagttactgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacgttttggcaaaacgttcgatgccccaccagccttacctaaagctactagaaaggctttgggaactgtcaacagagctaca

SEQ ID NO: 36710 - DNA, 1070 bp, Homo sapiens
ttttccttgaggtgatagacttctttcattcctttaagaaaaagtgtgacaagcacccaggtctgagtgaccatgggatttcttgcagttgttaattcaagtaaaaacagtattccaggaaaatgttctctagttttagcttgcaactcatatagttgcacaaatccttttaatcgtattttggtgtacagtggaagtgctttatggcatacttctcattttatcacacagaacattaaaaagacatctcaaggatggagagctaataaaattaatactttctactgcatatggtgaagtgacagtaagtgaaactggcatttttaaactacaagcgaagaaggatgcagaacagagagactgctaatatggtttactgtcactgccttgatttgtgttgaggcaccagcagctttctccaccgctgccttggtaccatcattacaaatgtcaacccagtggaaaaaggtgtgaatattgtcttgaaaatagttttgacctcatggaccccctcaaagggtctcagaccacaagggatctacagcccacactaagaactgctgccctgacaaaaacgctttctctctgtaacagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccagtaagtgagcaagtgcccttctggaagggctgcaaacaatttgtttcataacacttccattaccatgggaagagttgtgcgggaggtgagcctgtgagtaatttctgtccttcaaatgacaaggattagttttcagaaaaataaactattctcgattaatattgcttttcagtcccaaatgccccagtaaaattgttattctggaaactggatagtcttactacagccaaaagattaattctcacttacatcttcttaggctataagttgaagcatatataataaacttgcttggaatgatgattccatgttatatc

SEQ ID NO: 36711 - DNA, 1055 bp, Homo sapiens
tgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtatgtttgaagctacatttttgtaattttgctcagtgtgttttggagatggaattgttaccttttggctggtattcataaacttgaccttttttttttcagcacgtagccaaaacattaattttgtctactacagcattaatatttcttatcataatcaagagtagtacatcaggtattagacttaaattctgaaatgaaaaatagtctaatatcaagtaacaaattgcagtttcctagtaagaaaattggctgtttttaaaaaacccttcttgataggttggatttgtccatttatttactatttttagatataaacaaatttattagtggcagaaatttattagaggctacattgtggctaagaattaagatatatttgttaatcactacccatatataaaattgtaaatgtt

SEQ ID NO: 36712 - DNA, 1792 bp, Homo sapiens
agtcagctaatatttgaaggcctttactatatacaaggtacaacatcttaggagtaaggaattatccaacctctgatacatacgttagccatttcattaaattttcagcttagagaacagcatcctccttgtagcactaaaatcatgcttttttttaattgcacatgatcttgctgtatgtatctgactgatttaaaattacataagctgagcaggacaacagcaccaaaagtctgaaccaagtatgaactaatttgagactgttagcttataagcaaaatcaatatgaacttggatattgtacttaaaagaaaaaaaagtaggccggatgcagtggctcacgcctgtaatcccagcactttgggaggccaaggcgggcggatcacgaggtcaggagatcgagaccatcctggccaacatggtgaaaccccgtctctgctaaaaaatacaaaaaaatttagccagtcgcggtggcgggcgcctgtagtcccagctactcgggaggctgaggcaggagaatggcgggaacccgggaggcggagtttgcagtgagctgagatcgcgccactacactccagcctgggcgacagagcaagactccgccacaaaaaaaaaaaaaaaaagaaaaaaagtaggatatgatagatggtctctacattgggtatctggaaactgccagagtgtgtcaacactatactaacctatcattgctatagcagctggactactgcaaagtagttatatgcataaaaaatgtaaacttgctttctgcatatgtgatatacattcttgccatataaatttcctaactcagtgatgatttattctactcaaaactaaatgttaacatttaatacatctacatgtgattatgaatattagatatgaacatttcaattttcttagtagtatttaggcagactggcttctgttaagttggattttgtttgttttctttatttaaataggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactaga

SEQ ID NO: 36713 - DNA, 1885 bp, Homo sapiens
aaccccgtctctattaaaaatacaaaaaattagccgggtgtggtggcccgtgctggtagtcccagctattcgggaggctgaggcaggagaatcgcttgaacccaggaggcggagcttgcagtgagccgagatcgtgccactgcactccagcctgggcaacagagcacagagcaagactccatctcaaaaaaaaaaaaaaaaaagtgaatagatagcttaattgtacttggaacttatggcaactaaagttcttatgttcttaaaatgcattaagacttttaagatgtatcataggtaaatatgattattcaaatagctagtaacattagaatatctacaagcataatgtcaaaatcagagatttttccagaaactttaggggtgattattggtagcatctccttatgttggcattctatcagtgaatcatttattatcaccttgtttttgtccagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaaggtatctgagcctcatgataatatttacaattgaataaatataaacacgttttttagggccgggcacggtggctcacgcctgtgttcccagcattttgggaggccaaggcaggcggatcacctgaggtcgggagttcgagaccagcctgaccaacatggagaaaccctgtctctactaaaaatacaaaaattagctaggcctattggcgggcgcctgtaatctcagctactcgggaggctgaggcagaagaatcacttgaacccaggaggtggaggttgcagtgagctgacatggcgccattgcacttcagcctaggcaagagagtgcgactccatctcaaaaaacaaaacaaaacaaaacaacatacaccaggcgattcagattcattttgttaagcaaacatgtttcaagaaatcctttctcagggacttgctttagagtcttgcaatggactttccagcatatagaggtaagtgaccacccaaacaacctttcaaaaatgaaccaacaggccagccacagtggctcacacctgtaattccagcgctttgggaagctgagacggatggatcacttgaggtcaggattttgagactagcctagcctaacatggcgaaaccccatctttactaaaaatacaaaaattagtcaggtatggtggcgtacacccgtaattccagctactcaggaggctgaggcatgagaatagcttgaactcgggaggctgaggcatgagaatagcttgaactcgggaggtggaagttgcagtgagcaacacggcactccagcctgggtgacagagtgagactctgtcttacaaaaataaaataaaaataaaccagcaagtcacattaaggaaaagagggataagaacagtagactggtacagtggctcatgcctgtatttccagcattttggaaggctgagggctggagaattgcttgaggccaggagtttgagaccagcctgggcaacatatcaagaccccatctctataaacaaattgaaaaattagctaggcatggtggtggtgcacaccggtaatcccagctactcaggaagatgaggcaggaggattgattgagcccaggagtttgagattatagcgagctatgatcatgccactccactctagcctggacagcggagcgagacttgatctcttaaaaagaaaagaaaaaaaaattaaatcaatcagtaattatggtgtaggtcaaagactgttctctctaccaaagta

SEQ ID NO: 36714 - DNA, 1031 bp, Homo sapiens
caaaatcaagagaagtctgagaaactgtcatagtcaacagacgcctaaggagagatggctaataaatgagatgtggtatcctgggcggggtcctcgagtagaacaaggccattaggttaaaactaaggaattctgatggatgttagccgatggtaatgtatcgatattagtcacaattgatattgtgacaaatgaaccacagtaaagtaagatattagaaacaggtggaattgggtgtggagtataggggaactctctgtactaggttcacaatgttactgtaaatctaaatctgttctcaaattaaaagttgactttaaaatccgtgacaacaaataaaaacagttaatgaattgcaacaatcgactatttcaaataagatagcacaaagccgtcattaaaaagttcaaatcagccttgaaataccactgtgtgtaattataaaacatgatttaattgccactttagaggatcctgactttggtgtaaggtaaagtatatctgcgttttgaattctgtgaaattaataccaaactttatgaaagtaatatttatttggtttatgcaaagtggcaatcaatgtgtagagattacaatgctaaatcatgtgcgttttcttctagatcatttttttctcccaagtctgcaaacttaacttcattttgcctgaatgggatcactgacatccaggcccttcacagattcttagtaactgtggttttcagggctttttataagagtcccttgctgacctcaatgctaaatctctctccatattcaccttccaattgccttatctgttactctaatttagaaagtaattatgcattcttcctcttcctctacatgtaacactaaatgcaatccatctgataagtatctcaccttttccctatgtaaaattccagtacaaacaagtacaaagtctattccatataactgcttttttttttgtatttcactcaggaaaaataaaagttactttttttttctgcctctggtagtgttccctacatgtgcaaagaaatgaa

SEQ ID NO: 36715 - DNA, 1038 bp, Homo sapiens
ttttacaaatggtgtgtgtgtgtgtgtgtgtgtgtgtgtgtgtgtgtatgcatatacatatcgagagactaagagattatttcattgctctctaagaatattctataagtcagaaatcacacttctgaattttctgagttaacatatagcatctatccatcatagtgttaggtactcctaaagtcttcacacagttaagatatcttatttttaatggaacttgtgtgcacggctctacagtttttcatattttgaagggggggaaatgggagatgctccagtgaaataatttagaaatgagtattgctacttggatttttctgttttaaaaacatactgtatagaataaattaattgtatgaattctctctcgggagaaaacatcaaatagccttaactctgaagaacacaataaagtttgtgattaagtatatctgtgatcatcttgtccagaaaagccatagacttttcagataaaagcgattactcatggagtaagacttgtaatgtttttttttcttaaagaatgcaggtggtagaatcatactaattgcctagagagttacagtttttgaaaatgaaattgtactctcatcaggcattatacatattgaacaagaaaggccaaactggatatactcttttgaaaattgctgtataaactctactagacattagagtttagctgatacatgctaagagtagtattttgcataaatattccacaatattgaatgtgtttttcctgcctgtaattagagctctgatttactgatagaaatactaactatgggataacaattagaatgcatgcctcataattgccggaatgtaaatcgagtctcttgatttaaaagaaaattaaataaatacacaagcacacatacacacacactttcttgaaagaaagcacaaaatattttaaggtaaaatattagctataagcatataacctttacaatttcatttgaatgaatgtgaattaatttaagttttatatctgtatatccaactactagacataactttaggacaagc

SEQ ID NO: 36716 - DNA, 1054 bp, Homo sapiens
gcttgaaatgttcataaaattatagatcatgccaagtttatctccgtaagccaaggccttccattgtgttagcttttacactccccaaaagaaattccatggccctatgtccttcctcttcagaaatagagtgacctcttattcctgccttcatctctcagaaaacatgctgttttctggaaataatcaaatatctcttctttgaagcttgttctgaatttttgactacaatattttcctccagggatatcttcagctacaggaactgtaaattttagcattttctactcttatcagtattacctgttaccttgttctcttccaccaatagtattgaacaaaccagccatactctgagattacagagaaagtaagagacagacactgtcttcaaggagctcacagtctagtgggggagaaaggcaagtcagagaagtttgcagtacagtgtcatagctaccaaccacaactgaggttggagtgaggtctaacagaggataaggaagaaacactttgcctgggaacatcttccaggaagtaacgtctgaactggatagtagactgagatagttaagactgtgaagaagagaagggtggttctgtctgaaggaactgcagatgaagaggtacagaagctggaaggcatagtcaccagggaaaacagtgcgatcactgagtgtttaagttcagctacaccccagggctcctgtggaggctcaaagggtattagataacggctgggtcaggaagtggtgcatgtgccttcctgaggagttctgactttgttctaaatgaggtgttgagaaattactgaaggattcggaagaggagaatgaaggctgtttacttcactctgcactgacacttctgcctgaaattgcaaccctcacagactcttgctttagaggtagtactgtctgtgaatgataggtgtcacctgactaaaatcacaggtgctgtggctggtaacccacgagaaatcctggataaaagttaaaccaatttatttactacctaactgctcagagcttttctaatgctcatgcacgtggaa

SEQ ID NO: 36717 - DNA, 1051 bp, Homo sapiens
gagtgtagactcagagagatacttggggcacaaagcagaccatgctgggcctttttgcccatggcaaagccttggggtttaaatatgagtgttatgagaagtgttgagtgggtttaacatcattccagagtgtaaaactataatcacatgcatgcataaaagaatcatctacctccagatatttctcatgttgatccaaatagaaatgaaaatattccttgctttctctagagctaatcataaaaggtgatcatcatctgccaaggagagtggaaaagtgtgacaattcttcaaattaaatgaactcatagggtatttcctacttggaaatcttatgattctgagtctgtgggatgtacactacacactaacaagatttatcttccaattcttatgtttctcggggagtagaaagtaaggcaacatgatgtattggcataaagaaaaggacattaggcttagattctggagactttagttctaattcacactgtgcttcccattaactgtaggacattggggacattgtgtgtgactcttgtttactattccaggctgtggcatctaaacaaaaaaattttaagtaggtaaacttttaggattttcagtgttaccaaaattccattattcaataaaatgcttatccacattcacctctgctcatttctttttcctttttttctcacagaatttgtgtcttctgcttgtcatgcttgtaaacttcagagaaagttgacttttaagaaagatattatttaaagaatagctagcaattaatactacttattttcatacttcagacttatcaaaaattagaccatctcatttccacatcaaaataactccatgtcatagtagaacagacgttgctactagttttaatagaggggcaatttaaagtatcagtgttaaagaatttgttcagcatcacataactaggcctattaagtacataataaatcctagggattatataagctttttcattaaggccaaactctggctgaagtaggataaaagtatcattcaactctaaacagtcttccctagg

SEQ ID NO: 36718 - DNA, 1035 bp, Homo sapiens
atgcttctttatagaaatgtaatataatattcgtttttctctccccttcagttaaagtctagtatttgctatatagccacgtcttagaaagttccaaacaacaataataatcccttcttcgagaaaattataatttacaggggccagtcgtggtggctcacgcctgtaatcccagcaccttgggaggccgaggcgcgcggatcacgaggtcaggagatccagaccatcctggctaacacagtgaaacctcgtctctactaaaaatacaaaaattagccaggcggggttgtgggcgcctgtagccccagctactctggaggctgaggcaggagaatggcgtggacccgggaggtggagcttgcagggagccgagatcgcgccactgcactccagcctgggcaacagagccagactccgtctcaaaaaacaaaaaagcaacaacaaaaaaccaaacagaaaattataacttatattggtaaaaatattaaaaagtataaatttaaagaattacaactgtaaacaacccctaaatatttcagtgggaacagtttacaaaatagtacatgaataactagcaaataaattgtatagataatcattatactttctatgaatacattaagggaaagagatcactttagcactttaggctaaattattttctgcttctgcaaggaaaagaaaggcttccaaaaacaagagaattttgaacattaccagataaataattgtgaaactattaataaaatgttattgttaccattaagatgattgtcttagcacttttacaaataatttcggatcaaaaagtgtttgaactttcagcaaaccataggtaatgctgtttctgttccttctggtcagtcagcttattactgagtacccatgctgtatcaagcatgtgacctgatgggaggatggtggctgttgacaagtcgaaaggtctgtactcctggaattcactccagagcctcaattcagaactgatttccttcactctcatttttttctagctggctcttcaccatctgtaac

SEQ ID NO: 36719 - DNA, 1033 bp, Homo sapiens
aaactgtttaaaaaaatgcttgtatcaacaattaaataaaccacctctgatatttagaaaactttccttagcttcctacttgacactttgcacattttctcccacaaagcaagtttctcctcttaattaaccaaaggcaagaatgatttctttcaaaactcaaacctatacatttagaaagaaaaacaccaacccgagggtaaattcattcacatcggtgtgtaaaacagaccacttctgttcaaagcccaggaagtgctgatcacgctcctggcctcaatagaagatacagatcattaaagctcaacccagtgtctgtagctaggttgtttattacaaaagtaagaatcactaacatgtcctctttgctagaaccataaatctgaaacttctctttattaaaactgagatttgacaactgcaataccatagctccccctgctgttctgatgcatattgtcagctgcctttggcaaaatcattttatgcctttcccttccattcggccctcctctgagctgtttctgatatctaagtttccgtttgcttcttaattcttcatctcacctccctgtgctatttagcaacccaatggcaatttggaaatcgattttttatgatcctcatgttaatatcatctttcacaggcagtgttggaatgattctacttttatttaagatcatttcaactgctctgctagagcagcttggagcctcggaaatggagtttctacttgcatggacccctcatacatacctccctgcacacacatacagtagtttaaacaaactggaaacaaaagaaacgtacataacagccaaaaatgttgctaagaactttataaagcaacgacagagcagcatcaaagcatctgcaaatgctttctctttccaaattaatactctatcagtataaaggaggccactcaccactggctatattttcatttttataaagtatttttatgactgtttagggaaagcctgtatacagccattccctccattttgtgtgtgtagttttcttgctctg

SEQ ID NO: 36720 - DNA, 1050 bp, Homo sapiens
cctttgagaaagaggcaaatacttatttaatgaaatgtaatgtaatctattttttttttttttttgagacggagtttcactcttgttgcccaggctggagtgtaatggtgcaatctctgctcatggcaacgtttgcctcctgggttcaagtgattctcctgcctcagcctcctgagtagctgggattacaggcatgtgccaccacgcctggctaattttttatgttttttattttttttagtagagacggggtttctccatgttggtcagactggtctcgaactcccagcctcaggtgatctgcctgccttggcctcccaaagtgctgggattacaggcatgagcctccgttcccggctataatctaatattttaagtgcttcaccagtttaaacaaattaccaagatggtcaataaaccgagtgtcatttttgctaggttaagaaggatttagaagccttcagacagcatggtttcacttgagatatgccttgaacattgagtagaattacaaatagaaaaaaaaaggaagaatatagaaagaagaaataagataatgcataaattatgagaggaattaacagatatcatatgtttaatgaatgggaagtattaagaaggagcttaaatgttacttgggtttggttttgttttgttttgtttttgagatggagtctccctctgttgcccaggctggagtgcagtggcgcgatcttggctcactgcaacctctgcctccggggttcaagcaattctcctgcctcagcctcccgagttgctgggactaaaggcatgcgccaccacacccagctaatttttttgtatttttagtagagacagggtttcgccatgttggccaggctggtctcgaactcctgacctcaagtgatctgcctgccttggcctcccacagtgcagggattacaaagccgcggtgcctggccttaaatactactttgaaatagaaaagttgaaagtgacataattgtttaagtgaggtatataagtttggttgggtgtagtcagatatggtatagtgagggacactca

SEQ ID NO: 36721 - DNA, 1059 bp, Homo sapiens
tagaaaaatttatggtgacaatattgtttgagtagaaagctaaaaatttcattgagtatgaagttggtataatactattacaagctgcctttttccgttgagttttgactgttataatcaatttaaaatgtaacttttctttttggaattataataaatacaattcttattttagataaatcattcgtcacacttgtaagatcacttcacagggaaaagtattctttcttgtcttctctatttttttactggaagaaatgatgtactttttcaagttttgctaagaactcttcaatggtaacaaatatttgatgttatgagattgacattaaatatttaatattattaatatataaaatactgtgtcatatcttgtggaagagagagaaaaacgatttgtgaaaacatactgcttcttgcatataaccatgtttctgctccttagtaatcttaatttcaattttgtaaagcttgtctttattattatcaagaaaagccataatctagacccagaattttgatcagatggcccttacctcagattttgaatcactgctctaagaaggcagatagataactgttaaaatttggataaaaatgaaataaacaaaaatatagttaagtattaagtttcagccaaggcacatgccaagagataaacgaatgatttgtagaattattggatagactctaaagaatattcagcaatattgtatattctacccattacttgatactgagatataaagatgttgataacaatggaaagcagatggacagcgcatgtttacctttcaaaatatatctgtcatggaggtagcatgttcacctattgataagtttgccagacttagcaaattaaaatacaggagactcagttcaaatcagttaaattttagaaaaacattgaaaagaattatatgtggaatatgcttattctaaaaaagtttaatcattgtttttctgaaattgaaatttaactgggtatccttcgtttcatctggcaactgtaactatctcgagtggtgtatgtatttatatgtgtgtgtttgtgtagtt

SEQ ID NO: 36722 - DNA, 1034 bp, Homo sapiens
gcctcctttctgtcactgccccctcttcttgcatgggccactattttatttaacagcataaattagctttgcttctttttataatatgtatacattgtgtatattattttgtatttggcttctttctcataacattatacttatgaaatgtttgcttcatgtaactataaagcatccagtttcatggcagcaaagtattctttgaatcctcttagagcaaatatcattcacaacttactaaaataaaagggcttttccttcttcttatatatgccaattttggattgtgtcactcagttccatatacctggactactcttgctctttttttatccccaatctattgtaaaaaggtaatttgtacaaagctataagtgtgtccctcatataaatataaaatgtgccatagattcatgcaacttattaataagggcaacaacaagatggtgaagctaattcaaagagcgtttgaagaaccaaatatgtacagagattaaaggaaaaaacgttagaacaagattgctaggtgagattaaaacctggaaatgcttttacaggataaacatcaatctgcaaattaacatgtaacttcaaagtctggtatctaaataataataaatgatatgtcaaacaaaattgtatcctcctagagattaagataataaataattcttgggtgagcctgctgcacattttttcagcataaccctgaagggacacacagatgccattttgccttatttcttatccctcgaggtcaatgttcatgccacttcccctctgaagtctttctgatctcctagctggaagtcatctctctggccaaagagcactggtagtacgtggagtatgtacaatatgaagtttgtgaatgaataatggtaatctgccactctagggttatatcactccttgagcagaaagggctaattaagaacatgattaaattttaaattatagctgaagaaattgcactgtagaaaagagataaattagaacacatcatggtgtggttagcacgtatatgttcttaa

SEQ ID NO: 36723 - DNA, 1026 bp, Homo sapiens
atcttctattccttctaccaagaatgctcttagcctccttatccacttagaaaacctgtattgaccattcaacagctgtctcagatactacttccctctccacatctctttgccaattgtccatctctccatttctaagctaccttcaggccttgtattggtcctttccttccacttagaatataccattatgacttgtttctttactatcttgtccaccaactacatagtgatctacttgaggcagaaaacatgtcttttctatctccatgtcccatatagcagcacagaacctagtacactgctgaaagtatggcaaatttttgacaaaggaagcagtgaactcaagaatatttgagctccaagaatcattggcttaaaaaaataatttatgaaaaggatatggaagtattaatgaaactaaagattggaaagggaagctggggctcaaatgagcagttgtcagtttcatgactgattctctccatctctcactgttaaaaattccttggtttctgtgacactggacacatctatttccttttttcctctcttcagcctgctgtctttgcatctcaagcaaaagaggcaagaagataggtaccccaaaatgaccaccttagtctcctctgtattatggttctctagaggtacagaactaataagatataaatatatgagtttattaagtattaactcacataaacagacagtcccacaataggccatctgtaagccaaggaacaaagagagccagtctgagacccaaaactgaaaaacttgggttccaatgttcaagggcaggaagcatcgagactgggagaaagatgtaggctgggaggctaggccagcctagtcttttcatgtttttctgcctgctttatattctagtcttgctggcagctgattaaatgatgcccacccagattaggggtgggtctgcctttcccagagcactgagtcaaatgttcatctcctttggcaacaccctcacagacacacccaggatcaatactttacatcctt

SEQ ID NO: 36724 - DNA, 1027 bp, Homo sapiens
aagcacggaccttgccccaacacattcctgagataacactcccccgcccgtctcagaagacactcagtccgttggtgtgagggaggctgctgacaccccccagattcatttccagtttgtttgacgttggcatgtatgtctgtgtaacatgactgaagaacgagtcattagtgagctgtccaaagtccctttgggaacattccaggaaaataaaccaatattccatcaaagccacaaataactttttttttttttttccattccttcaaagcaggctttctcagagtgtggtccacagacttcctgctttagactccccagaggagcttgtaaaatgcagattcctgggccgccaccctaagcctactgaatcagaatcccagtggggcttctgggaactgcatttttatatgctacccagatgattctaatacaccttaatctcgaaaacctctcactctctttgcccctttgcttgatcgttcctttgtgtcaacaccgtgtgcccgctgcgctctgatactacctccctgtgctgccccacctggtgaacttcagctgaagggccacctctccctgggagccttccttgccatctttgtcccatcttgtgtaggggcccactgtgttttctcctaatatgaatctaccacaaagtagtagtttctttctgcctgactgctcccctgaatggggaagcatcctgcccagtctctccaggcccagcagaaagttttgcctataattggtactaagaaaggaatcagtgcaagtgaagggtgctgagcggcaacggaagggctacagagtaggggtgacgaatggtcgcttcccgttaagaagctgtcaccttctgactcctctcctggtgagtctgaactcctaggtcaagtctggggccagagggcgagcatcagacccaagaagaggccaaggctctggctggcaggaggcacagcccacctgtttgggactgcggtgtccctggtgtaagctcagatccctgtctgtatttcagggagactcc

SEQ ID NO: 36725 - DNA, 1004 bp, Homo sapiens
gtaaccttgtatatataggcgtgtatgtgtaaacaaaaattcatgtataatcagaaggcagtatctgtgtgagactcaacaacagttacctctgggcaatgggattggagagatggaaactctcttatttcacaaacttgtcatggtggaattgtgggatttttcttttttgtacttttcattattttgtggtgaaaaatcagatcttctaaaagttgcaaactttaagaaacattgccagcctgctcaagataggctgagctgcttttttctgtgggctgtgccagctggaggtgtagggcagatccctcagggggacccacgattcctgaacgccaagggaatccacagctgctgatgggagatgggaacccacagcagctgttctgtagcccagttttacaaattccatctccgccttgtttttttgttttgtctttgtattatttttgcatttgttcctgcctcttgtttggtttgaagggatggaaagctttcctcatgaggggcagttttttgtagccactgtaagcagtcttcagaccttactttttttctcagaaaaaggaggaggaaaagcttgaagaattgctattcacagacgattcaaaaattggtcctaggctgggcacagtgcctcacgcctgtaatcccaccactttgggaggccgaggcaggtaggtcacctgaggtcaggagttcaagactagcctggttaacatggtaaaaccctgtctctactaaaaatacaaaaattagctgggcgtagtggcaggcgcctgtaatcccagctacttgggaggctgaggcagggataattactggaacccaggaggcagaggttgcagtgagccaagatcacgccactgcactccagcctgggagacagagcaagactccatctcaaaaacaaaaaaaaaaaaagaaaagaaaaaagaaaaagaaaacaacaacaatgaaaactgatcctaggcaatagtttgggttttactttcactatcatt

SEQ ID NO: 36726 - DNA, 1028 bp, Homo sapiens
gaaagacactgacattgaggattcctggatgaaaccaaatcaagtccagccaaatcatatgctgtggccaggcgctcatgcctgtaataccagcactttgagaggccgagatgggaggatcacttgaagccaagagtttaagaccagcctgggcaacatagtaagaccccaactctacaaaaaatttaaagaagaaaattatccgagtgtggtggcaagcacctgtagtcccagctattcagtaggctgaggcaggaggattccctgagtccaggagttcaaggttacagtgagctatgattgtgtacattgcacttcagcctgggcaacagacacctgtctcttaaataataaaataaattttaaagatagaaaacaaataacgtactgtgcaactcacagtccacaaaccacactctagtcagcattttgggctcccatccttaaatatgagcagaaaaccaagattccagatatccgaggaaagcctctaacagagaaaatagagactcaaaccaacacgtggtgaagggagggcttggaggaaacaaggagtatgcatgaagaagagaccgttaagagaagctatatggtcaggaaacaagaacacggtactacattgtttaaaaaggaaccttcagagaataaaaaagagctcatggaaattaaaatatgagagtagaaatgaaaactccaaaggaagactggaaaataaaatggaggaaaccttctaaaaatcagagcaaaaatacaagattgaaaataagaggaaaaaaaaatagactacaaggacaggaaatctactatctgaggaaaatatgttccagatagaacagaggaaacagaggagaaaagcatcgctgaaataattcagaaacatttcccagaactgaaggaggagaatttttagactgaaagggttcactgagtgtccaacacagtggatgaaagtcagctcacaccaagatatctcactgtggaacttcaaacactgggacaattcaagatcctaaaagctttcagagaga

SEQ ID NO: 36727 - DNA, 1026 bp, Homo sapiens
agagcaagctctggtctttactgcagggcgtgtgctgggggcttggatgtgtgggtagagggatggcatgacttggcttttccatggaaatgagccctttctcccaggccccaggctgggttagctgtatcctagtttcactccctagtccagggatcaactagtcagtcatcccctcttcagcaggttgacatgaggggatggaggccaacagtggaacacatctgtccatggaaggtataataatatgcaggtctttcagcagagctcataaactgtgcctggcttcatctggagaaaaagtcatccattcagcaaatattgagcatgtctacatggtgggcactgtgctgggtgctaggtgctgggtgagcaagacacagcctctgcctctctgccatccccatacagtgcagcaacttgcaaaccttggtgtgcctaaagatcacctgggaggcttaatgaaaagagagatttctgggccctacccctgggctttttgattcagcaggtcaaagtagggcccaggaatgtgcatttcaataagcactctccgctttctgatgcaggtagtctgtgggccacaggcggagaaagactagtctagtagacacatgagagcagcccaggtcacgagtttgtgagggcacaggcttgctcgatagggccctttattttgtagtgggcccactccaggggttggagagccattccaggggcaaagacacaccctggagtccacccaagctgccctccatgggaggtttcaggagaggtcagggctgagatatggtccaaaagccagaggtctcttccaaacacaaggatttgtctccagggagatagtttactgaattgggctttggtgtcaggcatgcctgggtgaaaatctttgcttccagttctgtgacattccgtcacatccactaacttctcccgactctctggtcccattctctccagctcctttgctgactgttgccagtccatccaacctcagaatgttgtgtgtactcagagcttggt

SEQ ID NO: 36728 - DNA, 1021 bp, Homo sapiens
gagaccatcctggctaacacagtgaaactccgtctctactgaaaatacaaaaaaacttaaccggctgtgttggggggggtccctgtattcctagctactcgggaggctgaggcaggagaatggcgtgaacccgggaggcggagcttgcagtgagcagagagcacaccactgcaccacagcctgggcgacagagtgagactccgtccccctacaaaaaaaaaaagtgaaagcggaacagttccattaccttttatgcccaggtggggagggatggtaggaagatagttcacagtactctgtcctgttacggctgtatacttaatcagcagtcacaaagtacaagttagtcaagtaaattggcaagctctttacatttctgagccatttatttatcggtatgtatttatctttgcctcacttggttgtgataatcatgaaggtaatttctgaaaagtgtttttagctcagctcctggaacataatgtatgctcatttttggcaatttggttttggctgtagctatctcccagtaagtattctgaaatttcaggtgaggaactccccctgagttttgcagtttaagttggaagctttatttctttctgaattgacatgtctttagttttagatgttaaactacaaagcctggtctggtctagtctaggacctaagacactggaaacaggaagaaatgggaaaattgtttagtcccagaaagggtgaaaggcagacccttgagctattttgaatgtgacaaaggacatttgggttttttaagagtcccaggtcataggatttgggaataaaagcaggttggtcaacctgaaacttaactactcttgctaaatcagagtgtttatcgagccaaagaaaagaactagggatatgagacatgaggcatatcccattatatacttactccgattcctgtctcccaaaacacatgtatgtgtggttaatatattctttttctttttctttttttttgaaacagagtctcgctctgtcaagcagactggag

SEQ ID NO: 36729 - DNA, 1032 bp, Homo sapiens
gcttatctgtgatgtctcccgccaaggtgagtttctgggctttgttccttcgtccagcaaatactatgtatatcatttcctggagtcttcattttgatttgactttgagtgatattttaaccttctaaggacaggcaaatagattttttcttaaatgtatttctgaaacaaccaataaattttgaacctgccataagacaggcaggttcaaatcttaactttcttagaagtcagcaaaaattaattagaaaataaagtggaaaataaaaagaaatcttattcacagtagcaacaaaacctataaaacacttaggaatgaatttattcagaaatgtgtaggaccaaaatgatgagaagtgtacaatgagatgtaatagaatgtttggatagagtgccagacccagttccctagttctccaaatttatttatgattttaaggcgatttcaagttttctaacttgacataatagttttaaagatttctttgaagagtaaatgggtaaagaacaaccagtagatctttgaaaaagacgattaatgatgactggcttgcagcactaggtaataaaatgttttataattacagtaagtaatactgtgtcattgatgtattgctacatagacaggtaagtggtttaaatcaggaaaaaccagaagaaaattcagtaaatattgatcactagataggaagagcttttttttcttctcatttacattttttaagaattaatttttttaaaagttatacaagaaggacatgttccttatataaaaaagtaaatgttgggaggccgaggcgggtggatcacctgagatcaggagttcgagaccagcctggccaacatggtgaaaccccatctctactaaaagtggaaaaattagccgggcgtggtggcacacgcctgtagtcccagctacttgggaggctgaggcaggagaatcgcttgaacccgggaggcggaggttgcagtgagctgagatcacgccactgtactccagcctggctgacagagcgagactccatctcaaaa

SEQ ID NO: 36730 - DNA, 1059 bp, Homo sapiens
aaaaaaaaaaaaaaagcagttgggaaccaagtttagtgtttaagtgtggaaaactgccagaacatctgacctgtgctctgatagcaccctgagtatccaggcaaccttgatggttaacattttccaaggtttctaatagatcatggtgaggaaaaaattatgtgctttctttagctctctaataaatatatttcaaaatattcttagaataactaaatatttacatagtagaatgagtaagcattcattttccttcagggttcttttaactttattaatgaagtgttttttaccccctaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaagtgagtttgtaaatttgtatgtgttttacattgactgattagaggtaagacagtatggtgaggttggtgacatctgacactggatgactgtaaattttccccaaagactaagattcaggacatcagtatagcatagaagaaagaagagggtttggacccagccaaactggacacttcctagttttccagcttgcctccacaaactggaacctctgaacttcagcaattgttcctatcagtagggttattgtgagacctaaaatgtaattgaagtttttgcatgtgaccctgcccttaattcagttgctttaaaaacgtttgaacatagtagaaaatgtaacagtgttgctcttagtgtttctcatatatagggaataaaagaagaggttttataatagcacttgtctcacaagatttatgagcgatttgaattttacagatctattcctaagcaaaagagccttaagtctttttttttttctttaaagaagactagcaagtaactttccgtttctgttgtagtctgtgcacttccagacaatatttgctgctgctcaaatgattggttggtatgacccta

SEQ ID NO: 36731 - DNA, 1001 bp, Homo sapiens
tctgaacggggccctagcatcctgaggtttttttctcttttttctttctttcttttttttttttttaaaggaactggcccaggtgcagtgtctccagcctgtaattccaacactttgggaggctgaggtgggaggatcacttgagaccaggagtttgataggagcctgggcaacatagtgagagacaccatctctataaaaattaaaaaattaaccaggtatggtggctcgcacctatagaattagctacttgggagggtaaggtagaagtattacttaagcccaggagttcaaggttacagtgagctgtggtcatactacttcactccagcctgggtgacagagcaagaccctgtctctaaaaataaataaatgagtgaatgaagcaagcaagcaactggctgctcaagcatctttcttaaaccttgccaggcgattctggtatgaatcaaggcttggttaccactgaacaagaggaattagtatacagagaaattcaagtgagattttgtcaaagaatttactgactttctcaacaattctagaaacatatattttgattagtaatttttctaaaaaggtgaaacatctaagccaaacttagtattccaagaaagcaaacaaattaacaaatatcttctttctctgttaggaaacttattaaaggtaaatatgtagagagtgcttttgagggctagagcataggatgctttgagttgagggctagagatgaaagacacttgaaagcacagtgtttcatgtagtactctccttgcttgatgactggcataaggcattgttaccattggcatcaaccctctcttaatagttctcaggggcaatatgtaccttagagatttaaaacatatgttgcagttttgtggtcaggtctctcaaaccttcattttcaaagatttctaagttgaaaagtctgtttcaaaatctgattgggggttttacattttttaggaaaaagtttaaaacacgttcgggtgaaacag

SEQ ID NO: 36732 - DNA, 1801 bp, Homo sapiens
ctctttaatttttgatcccaaatcagtaacagaattgtcagaacagttcttgctcttggaacaagaatgcaaatttgactacttattagtcaggaagaaaattttaatgtttttatacgacagtagtattgagtagatatgtttcttctgttattgatattattgcatggagttttttgtataagcttaagtagttttatttcctctatttacagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgaggtaggactctggactcctctgtctgcaagagtgtgcttagctattgaagatttgtcctgtttagcaattaatagtagtagtagtttattcttttctgaagattttagatctagttcccgccctgccccgtccctgttaaaaaagaatgaactaaatgaattcctgttattctttccaccctagtgtattcagagtttgaaagatcaagttatcattactctctttgccacatttactaccagattttgctttgtctgcacacttcctagaagacctcacttgttttagacctctaaacatctaagtgccccatgacactacaccaagcccttagttcccccatgaaatctaggtttgtgttcaactgcccactaatagacttctcaaacttaacacagacagaagagtggattccctgtccgttaaccaaatattcttttacgattttttttagcttatttagtaaatataatagcattcagtttcttgaacaccaaaaatctttatataccaaagatttttggtatatttttggtttctttatataccaaaaatctagaacttttagtcaatatcttccctttatttctcacatttcactcattaataagttctaagaactagactacaaagcatgtatctttgctactggcactgtagtccagatcaccatcatcactcctagacaagtattgtagccttctggccgggttgcctgcttccattgttgccattcatgccattcattcttcactcagcgtctaagtggtcgtggaataacacaccaaaggtcatgccacagccctgctaaaaaccatacaacagcttctgattttatttacaacaaaatctgagctccatccttgggtttgtagatccctatgtgacctgacccctgccaagcttctgacctcacctcaaactgctttgccttgttcttgactatactggtcctcccttatgggctttacaccagctattgccttttttttttttttgagttgtttacccctcactgctcttgggttgagtcctcagatttcagctttcatttaaatgtcacttcagcggagaggtcagcccttactatgtaatgtaaagttgccctgattcactttttttttcttttttcttttttttttttgaaacagggtctcactctgtcgcccaggctggagtgcagtggcgcaatcttggctcactgcatcctccacctcctgggttcaagagattctcctacctcagccttccgagtagctcggggttacagatgtgtgccaccacatccggctaatttttgtgtttttagtagagatggggtttcaccatgttgaccaggctggtcttgaactcctggcttcacgtaatctgcctgccgaagtgctgggattacaggcatgagcc

SEQ ID NO: 36733 - DNA, 1044 bp, Homo sapiens
tgtttgtcacatttttgggtgatttttttatatctttctagatttccaagagaaagaaatttgtacacaaatgtaaagatggtgaacagacagggctgaaagtatggactgccaggcatggtggtgtgtgcctgtagtcccagctacttaggaggctgaggtagggggatcacttgagcttaggggttctgggctgtattgtagtgtgctccaccgatcaagtgtctccactaagttcatcagtaatattgacctcccatcaatatgggaatgggggaccaccaggttgcttaaggaacgatgaactggcccaggtcagagacagagctggtcaaaactctagtgctgatctgtagtgggaccatgcccttgcatagctattgcacaccagcctgggcaacatggcaagaccctgtctcttgaagtatagactaggacatcatctccaggtcgatgatgatggaaataaagagtggcaatttgggcaggttgggggagacaacatgtatttggggtctgtagacttgtatttgactcagaatttgattatttatcattaatcttgaggaatttatgtatatttgatctcagctttagttttttaaatctgtagaataaatatactgaaaatacatacttcacaagagcctatttttcaggattggtttgaaaaaaaggtggaaatacttttgtaaactataaagcactaaaataaatattatctattttattttaagaaggaagaattccaagagatccagataaaagccttcagggatactcaggaaaaggtagtaagaggaagaaaaaaagagtttgtgggaaatgagtaacttcaaaatgaaggcagtttctgtttattgtaatcaagaagcttaattccagaaggcaggaaagatacaggaaagtaattgaaaagatctttaaattcaattgaagaggatttttgtggcttattaatgttttactattagggaacatttatttcctgaaacaaaaacatttattctcttttttcagctttactgaagtacaattgataat

SEQ ID NO: 36734 - DNA, 1029 bp, Homo sapiens
ccgttgattttgtattgtgagacttggctgaaattgcttatcagcttaaggagtttttgggctgagatgatggagttttctagattgtaggatcatgttgtctgcagagatgatttgacttcgtctcttcctatttgaataccctttatttctttcttttgccagattgccctggccagaacttcccatactgtgttgaataagagtggtgagagagggtatccttgtcttgtgccagttttcaaagggaatgcttctagcttttgcctattcagtatgacattggctgtgggtttgtcataaatagctcttattattttaagatatattccatcaatacctagtttattaagaatttttaacatgcagggttgttgaattttcttgaaggcattttctgcatcattctatttttctgcatcattctattgagataatcatgtgatttttgtcattggctctgtttatgtgatggattatgtttactgatttgcatatgttgaaccagctttgcatcccagggatgaagtcgacttgattgtagtagataagctttttttttctttttttctttttttaagacggagtcttactctgtcacccagactggagtgcagtggtgcaatcttggctcgctgcaacctccacctccagggttcatgagattcttctgccttagcttcccaagtagctgagactacaggcacgtgaaaccgtgcccggctgatttttgtattttagtagagatggggttttgccacgttggccagactggtcttgaactattgacctcaggtgatccacccaccttggcctctctaagggctgggattacaggcgtgagccatggcactgggcttggataagctttttgatgtgctgctggatttggtttgccagtattttattgaggattttcacatcgatgttcatcagggatactggcctgcagttttcttttcttgttgtgtctttgccaacttttggtatcaggttgatgctggcctcataaaatgagttagggaggag

SEQ ID NO: 36735 - DNA, 1022 bp, Homo sapiens
ccgcctactcaagcttcagtaatggtggacgcccctccccccaccaagctggagcatccaaggttgacttcagactgctgtgctggcagcaagagtttaaagccagttgatcttagcttgctgggctacgtgggggtgggatcctctgcgctagaccacttggctccctggcttagccccctttccaggggagtgaacgcttacgtcttgctggctggcgttccaggtgccactcggcacatttcttttaaaggtgcttgaagatgaattcccagaagtatgtagatttatgacctccatttatccttccggtgaggaggatgtcataacttgacctcataatggcatcttggcaatgaaggaacttaatgagcaagcagactgtgtgttgcccattgacagtctttatttgacatcattagcaaagtcgacctcatagtgaattctggaaagttgggtacaactgtagacgacttcaagtgctgtggctttaaaaagcagaataagccctttgttgcagtcaacaacattgtggcaaatttgctcaacctaacaagctccgcaagatttgaagggtcccttaataaggaccataatgaaatcagcatgaatttagttccttttcctcagcttcattatcttgtatcaagcctaacacctctatacacactggcggatgttaacattcctactaaaagattggatcagatgttttcaaatgcctttagtaaagatcaccagctgcttcaggcagaccctaaacatagtctttacctcacctgtgtgctcatggttagaggaaatgtacagattttacatctttgcagaaatattgaaagattaaaaccatctctacaatttgtctcctgaaatcaagaaggctagaccagcctgtccctcctgtggaccatttttattcattattagctttagcaaataacacatatgtgaagcccacattcatggaaatgaaagagagattcatgaggctctacaagaaaaaagctcaccttcatcactgt

SEQ ID NO: 36736 - DNA, 1047 bp, Homo sapiens
gttcagtatgaagggtcatcatgagaaagaaaaaagtttaatatgaagagttggcaagagatgtcaacatatctttcagggttataaagagaatgaattagattaagtgacctagaagaggagagttgcaacttgcttatagaaagggataccaagaaaaaggaagctaatttgttctcccatgttccagaaaaatggtggcacctaaggtacctctgaactcagaattgggaaatggggctgacggggtttgataaaaagtctgtactctgaacagttaaactctccaggatcttctctaccacctgtgcagctaggtgactgccttttcctcccttttctctacctgtgctacttctttactttccaagaccagagtttttttcctcaagaaataaaattggagaggcctcatattcatggataccagatataatagaggaacagtattaattttgtgaaaaacttctaatatggagatcagagactacaacaacaaagggggactttgtgttctgtatcttgactgtggtgatggaaacatgaaccaatacatgtaataaaaaatttcacagactgaaaacacacatctacacacacatgagtacatgtaaaactgggaaatctgaataagattgtggattttatcaatgtgagtttcctcgttgagatattatactgtagttttgcaagaaattaccattgtaggaaaatgggtaggagttcacggggtctttctgtattattttttgcaactgcatgtgaatctacaattatctcagaaagtttaattttaaaatggagggtagttaatagcaacagagacaaggtgaaagtagaaataaacttcagaaagatataaagaatatgcccagagagatgttgagataatgcatccctgaaacaaggacaggatattgttcagagaatgttccaaatttacaggacagttgtcaaaataaaacatccagtggaaaagttgtaagacaaagttaacccaatctcctagaatgtagaacaaaaaagcaaggagatgtttgataggag

SEQ ID NO: 36737 - DNA, 1025 bp, Homo sapiens
tttctttgcttgctcttaaactactgaagtgattaattcagtatgtccaccttatgaactagaagacataatataaatctgaatgttaatattggagcaagtggccttaaattatgaaattatgttttcttgccctcttgtggacaagtaagagtttgtagattttaaaattttttctgcattaactttagagcttcattgccaatattcatttcagagaattgcaaagctgctattgagtaatttgggtgcttacataaaatattttgttttactttttattttgattttggtttaaaatatctgtaaaatacagatttttaaaggttaaatgatttaaggaggtttacctaattctcttggttattaataaattttggggggtgacatatatcttcagtaagaatgttctacaaaaagcaattgtttttgcatattctcagaagtgttttatgggttatgcatttattttatcttttcaatgttagtatagttgtgaaattttctgttttgctgataaagaggattttaccaatatactttaaaatgtttagttgtttaactcactatcatcaaccaataggtggaagataatatgccgattcctgataatttctcttaaatgattttccaacatccttacgttaatgtttcatggctgtaaaagttggtatgaatattagattgttttagaatcacaaacatgttttaaagatgtatgattacaaaatttttttggttatttttctttaataggtactattttctatatatttcatggagctcctatgaatgaaattgcttagagactttcagttttacaaagatactttttgaattctgtttcatcccagctacagtgcatactaaaactgttttcaaggagcttacagacaactgggcagaccttttttgttacttccttttaatctatactcctccaaaatttacctgggtgaattttgtttttgctcaactttagttatttgctcaactttattccttacattgcagtaatttgtttg

SEQ ID NO: 36738 - DNA, 1298 bp, Homo sapiens
atggtaaatgtatgtttaatgttgtaagatactactaaacagttttatgaagtggatgtatcatttttcattcccattaacattgtataagagtttcacttactctgcatccctgccatcatttgccatctgtttaggcactctactgggtgtctagtgttatctcactgtggttataatttgcattccctaatgattaatgatgttaagcatcttttctattcttttttgccacttgtatttcttattttgtgaaaagtctgttgcccatttttaaattggattgttggctcttttgtatgtgttagggaattgcaagagtgctttatatgctctgtattctgtatacaatctctttttcacatatatgttttacaaatatttcctcccagtctgtggtttgtcttaactatttttcaaaggtgaaaagtttttaattttgatggtctactttttcacttttttctttatggcttgaggtttttgtatttatgaaatcttttctaacctaatgctatgaagagttctatgatttctgtaagtttaatagtttcagctattatattgaggcctgtgatccatttggtgttcatttttgtgaatgttgtgagttaagggtcaaggcttacagttatccagttgttctaacaccatttgtagaaaagaatatctttctcccccattgaatcactatgacaccttggtcaaaaatcagttgaccataaaatgctagagtctattagtggactttttgttctgtaccactgatctatatatgtttatccttatgctaatactatattgtcttgattactgtagcattaataattcttgaaatcaggtaatacaaattatttaaccttttttttttttcaaaaccgtttggctattctaggtcttttggctttactaattaattttagcatcagcatctcagtttcttcaaagtaggtgctagcattttgatagggtttgcctcaatctatacatcagtttgggccaggttaacaacattgaggcctgcagttcatgaacatttagttttctttgcaatattttattgttttcagtgtacagttagtgaaattgttcactgagtttattcctatgtatttttgatgctattgtaaatttcctgattattctctgctactctattaaaccagaattgaattttgtctttgtgtcttataactttgcttaatttattagttctaataactatttcatagattcttaggattgtctatgtgatcatgttgtctgcaaataaagatagttttatgtcatctttccag

SEQ ID NO: 36739 - DNA, 1006 bp, Homo sapiens
aatgactgctagtatccatgggagaacagaaagaatttgttctttttctaacttttatttgtcctttctgagtcttctaacaagcagatagcctcttttcttcattattcagttccataccttttaaaaaaacatttttacttgaaagcgtttcttaatcagaaacaattgatttcagtattatgaaatagccctctcatctttgaaaaatcagtctccaagaatagcataaaatttgtttttagcaagataattttatgttgttaattatttgtaaaggtctcaaaagtactgaaggatcacctagatcaatgaatccagagatataaaataatataccttaagcaaaaatcattgaataaatacctccatttctaaattagtcaatttcagctgcccccaaagtaagatttatgaaaactgtagatgttgccatttgtgccactgccttaaatctatttaatcctctactactatcagctgtgaagttaactctaccatcaaacaatgtgaaatcttggattttttaatacatcatgcataaaaatacagaaggaacaaatttattactatctattatgttccaagcaggggaaatatttaaaatgatcacactggtactatcatgacattgaccattcagaaaagatgctggtccttggatcatgagagtacatcctgactgaataacagatctggtcctagacagtttagtgttttgtactcaaatttattttcagtcatgtcttcatggtagacattgttttttccattttacaaatgaaaaccctaagacttaaagagataagtaacttatgcaagatcacatagcaaattagtagagctgggattcaaattagttttatttggctctaaattctatgccattttcagtgttctactgccttgataaacttaaaaccgatctgctttctatccagaactgagttcacaataatttatcactcatttggaagaacagatcattgtgctgattttggaattt

SEQ ID NO: 36740 - DNA, 1066 bp, Homo sapiens
ataaacgtatcacacatcctattaggaaaaaaacctcaaaacctgtttataataatctaattcttaaatctaattcctcagcaagttctccataaatcttagcagtactgagaatatttggtatgcaaagggtacttttaaataagtagctttatttataaatataggaaataatcactataaaaacgcttgtcaaaatattttttcttaacatgttggcaatacgtagcaagtttttaaaaattttcgtatgctgtgacctagacgttttgtttcgagaagtcattgagggtaaaggaggggaaagtagttatgttttacttagaaatatgaatttttatccaaaataagatgattaaattttgatgtagccttaattttatgcaaccattaaaaacagtgctttggaaaattatttaataacatggtaaaaataattggtcaagatatatttagtgtgatggattgtagaaaagaataaaaggttcagtaagtgttctgaatgcataagtgaatcctagtatatatgataaatacttcataatggtgaacaaaagatagtctgtacaggaaataaatggttttgaagcaactgggtaggcatctttaaaaaataatgttagctccttgtctcacactgtataatcaagatgaatctcagtgtatcatagaggtaaatgtagaaaacaagaatcacaaaaatacctgattcaggtaagaccttgctattatgcaaaatccatgaaagaaaaaattgaacaaattttctgcatgagaaaaacaataacaaaaacttctgcatggcattaaacattataaagcagtaggccccagggactggtttagtagaagatggtttttccatggaccggggcaggggatggtttcaggatgaaactgttccacctcagatcaccaggcattagattgtcataaagagcacacaacctagatccctcgcatgcacagttcacagtagggtttgcactcctgtgagaatctagtgctgcagctgatctgacaggaggcggagctcaggcgataatgcttgcttgctcattgccca

SEQ ID NO: 36741 - DNA, 1052 bp, Homo sapiens
gcctttttaataatcccagatgtgatacttgaagattgaatataaatcaaatgatgataaattttcttgtttaatatgtccagagagtatctttgcttttgcaaaagggttactctcaaaatattgctaatacagtatccatttggtgtaggtcttaaatcaaaacagtataatatggagtagaaaatccttctaagtgttgttttgaaggcacctggaaggaactatgtaaaatgagactagttgttttagggctatgggatttcggattttgtttcaaaacttttaatataaggtaattgtgaaaaaaagcgaattacagattagtttttcgtttttgaaaaagcttgcactttaggaaaaagtaaacacatcaccagaatggtattgactcctttattgtaactttaacattgttggtgtgtgtatcttaccctattaaaggaagttagtcctaaggtgacaaaatttctaaggcatttctattgcataaccccagagtgaaactaaatcttcctactttttggtttctctgacttacctgccaatctgtcttaatagaaatcattttcagaagtccttaattatgtgtcccgtcactctcctaggtactcttcatgctagctttattccttacagtaggcttgcaaggttggtattaatgtcctcattttactaatgaaagaacagactctctaagacatttcgtaagtactatatatacaatttttttagcaaccaactacgtaaggaagagtgagtggaacatatttcttggtgggtgtattgtctgattccaaattgtggcaaaaagtgggagaatactagataatagcaaatgaatgtttaacaattaatgcgtgcttattttgtaccaggaactgtgctaagcacttttgagcagtctcatttaattgtatcatgtagagtatgacttcaaggttcttcccaatctcttttcggcatatgtcaccagcttcatacttcagtacaccatacttgcactgcatactttatatgtggtaaacttatttcaggttcttcagcagtct

SEQ ID NO: 36742 - DNA, 1120 bp, Homo sapiens
tgcttatgatgaaactttgcctacctttgaaatcatttcttttcattccactttatgacatgattcatatgtgctgctgtcttttttcctttggtttattcctgttcattactcagtgactattgataagtaaccactatgtattaatgccagggatgcaaaagtgaataggatcatccatctcccctgtaagtttttagttaaagggaacatggacaagtaaggaaaaaaaattataaaattgattcatatatgcatttaaacagcatatgatgaaatgaagaccagacaaactattaaatacatactgctgggatttttggttatctgtatgtgaaaatttggattaagacttcatatcatgcaaaaatcaatttctagtagaagacagactctaaatatgaaaagcagaatactatgatttagggatagggaagaattttttaagacataaaaaagctaagctctaaactcagaagttggtaacttctacctatattaaaagtaaaaactcctgtgaatcagaaaacacaatagacaaagtaataaagaaaagctgtaggaatacattcataatacatgtaacttatagagaatcaacattcggttatataatttctgtgaataaataagagaaaagctacctactagtaaaatggccaaaatacatgaataaacacttcacagaagaagaaatcacaatggccagtaaacatggtcttagtcctctgggctgctgttaacaaataccataaacaacaaacatttgtttctcacagtttgagagcctgagaagttcaagatcaaggctagcagattttgtgtgtggtaggagcccttttctgttttcatagttggtgccgtctctctgtgtgttcacatagtggaaagggcacacaaactctctcagaccacttatgaggacactagtctcatccatgagagctctgccctcatgacctaattgtctccaaaggccctacctcttaatatcatcatgctgggaattagatttcaacatacgattttgtcagggacacaaacattcagaccatagcatttcacatttgccccacaaagtgcatgtccttctcatatgcaaaacacgccattccattct

SEQ ID NO: 36743 - DNA, 1034 bp, Homo sapiens
taacccatttttcatgataattatggaaaattattttttccaatgacatattttggaaactttcaaacccacagaaaacttaataatttaacaaatgccttcatactgtgcattttgccacatttgttttacctctctctttctacatctatatatacatttatgcatacatatgatatataacctttttttggtaaaccatttgaaaataagttacataacatcatgagagttaacccctagtattttttatatacctcctgagaacaagaatattctcatacacaaacgcaatactatgattacactcaaatgttgtaatgatataggaatattatttaatacatagttcctagttgtttctcgtttgtcccagtaatgtcctatataactttaaaaaaaatatctgaaccggacatgcattggatttaatgtctctttaatctaacatcgttttgctaccttttatgttttttcatgattttaacatttttgaaaagtccaagccactgttttgtagaaagtcgtactatttgagctattctggttattgcctcagtaatatatttgtttaaacaaataatatatttgtttaaacaaattatattatttgtttaaacgaatatattgtttgtttatttgtttaaacaaataatacatttgtttaaacaaataatataatttgtttaaacaaatatatttgccaagaatactgtgtggctgaggaaagataattcttaataaattgttttgcaaaaagagcacttcagagcaatgaactatggagcaaaaggcaaaatgacggaaacagcaaccttaagttcatatggttatcctggagatactgattctgcattgcattgtcgttgcttgcttttcatttagctggtcttacatgaaggaaatgaactgatatttagtatttatccaaggtaaaattctatagctgtttttgaattgccagtctttttggtttacataagcccttgctgaaaacgaaaaatctgctgcctggaatctatatattatagtta

SEQ ID NO: 36744 - DNA, 1026 bp, Homo sapiens
tcttagaaatgttgtctgtaccacttgtctccatgccctcatcaactgctcatttctcagcctgttctagatatttttttaacatactagtatcaggttgttgcagcactattagttgaaaaggctatcctttcttccatttaattatcttggccttttttgaggaaatcaattaactatatatgtgtagatctttttctgaactctctattttgtcccattgatctttaagcctatcctatcccaatatttggattactgtagcttctaataagtcttgaagtcagatagtgtttaaacctccaaattcgatattcttttttaaaaatggctttggctattttagttttgtgcctctccatgcaaattttagaattaacacatgcatttctacaaaaaatagaagagtatggtgtttattggaattgcactgaagttacagatcaatttgtcttaaaatttgacattttaagaatattgagggtttttgtattcttcctgattctctttgtacttggttctctcagttgttgagggagaagtcttaaagtgtctcttactatggatttatcttctcacacttctatacagtttcactttatatattttgaaactctgttgttaagtccacaaatttttatatccttgatgaattgacctctttattattttgaaaagaccctctttattcatgctaatattctttgctccaaaatctactttgtttgatattaatatagcaacttctattttcttttgattaatgttggcatggtatatctttttttcatttttttatctttaacctatctatgtctttatataaatagggtggtaggcagcatatgattcagccttctttctttctttatcctagatgaaaatctctaccttttaattgagctgtatagaccatttacatgtactgcaattattagtatgcttggatttaatctactgttttccctttttatctgttttattcaatggatttttgcctttctttggatcgaacatttagtattt

SEQ ID NO: 36745 - DNA, 1050 bp, Homo sapiens
agctatacagagggatgctgccttctcctgcccagggaacttagcgtgttaggcagttgtgagtcccagtgttgtttcatacgcctcccacaaggagctcaaatggcttagacagcaggcaaccgcagctatggtgctggttgcccctccccctgggagcttggtaggcttaagcagattccagctgagaggcggttgacaatctgtagggctctggggttgggatgctagccccagtggtgtggttttgtgagtgagatcatccaatccatgggttgcacagttctgtggaaaaagcacagtttcccttgctgggtagcatgctcattcactgcctcccttcactggtgggagggggctcccctgccccatgtggctcagatgggccactacaccacattgttcttccttcctctctggatcacactagtctcctagtcagttctgatgagagaacctggataccttggttgccagtgaaggattcacatgcctattatagttctttttaatgggaccctctgaacgccgctgttctgtttctagtcggccatcttggccctgcccccaatatgcatctttatctacttcctcaatggtattacagtacttcacttctaatgtaagacttttataacttttatatttctgtcctttgtactattgttcttatagattttacatctacatcaaacctgtcaaaacattattattttttaattgcctattaagaaattgaacagtgagaggaaaatttttgtcacatgtgtgctatttacacttcttttctttgtatagatctaaattttgatgtgatatcctttttattttctatttgaaaaactctttaacatatagtacagatttgatgaaaatggattctctcatctactttttttctaggtgaaaaatttattttctccttaattttgaaagacattttcactgggtataaaattccagtttggcattttgtttttctttcagctatttaaaagtgtattccactgtcatctggctttcatagtttctgacaagaagtctgtgaca

SEQ ID NO: 36746 - DNA, 1699 bp, Homo sapiens
taggttgcggactcctcatgagactctaatgcctatgatctgaggtgggacagttttatcctgaagctcccccactatccgtccagggaaaaatttggtcccttgtgccaaaaacactggggacctctgctttagaacatgcagtaaaacttgaatggattgtttaacagattgtttctttaatgaatttatcacataaaatcaggcattgctttgaaaaagtgcagtttatttcactctgttattactgcgtggttccagattgttaaagattcagctactttaaagcagtgtcttaaagaattaatttttgtcctttcagcattggcagattcatttttgtcatggaacatcttatctccttatgatgcttttgaagtattaatataggtggaattacctatgatagtttggtggaactaaactctttgtcactttttctatttgtgagatttgcatatagtattgtagcttttttctgaaattttttgttttgcaacgtgccttcataagaaactcatcgatttgtatatttaaaaagaggctgtaaagcatttgaactagccccagtaggatcatattataattaataataataataatattaatgtcaccagggcttgcataacaattcataataattgtctttacacttaagtttaactactaaactttgtagcctaatatagtgatttttatcacaatgataaacttttttatttacctcttgaactgtatgtaagaacagagaccagtagacctagtttttcctggttattttgtagaacgggaattgggaactggaattgaggaagtgatttcaatttcatgtaaatttttctgctattaattagttggcctattaaatttttagagtagctattgaacttttgcaaccagttttattttgagtactttattaaagtatcatctgttagcttttcatatcatctcaccatattatcttactgaggtaaaatggaattttttgcttactgattttttacataagaattaagtgatacccatacataccaataacattgaaattccaggctttcccatgaaggaaaacagttaaattaatgctagatttataaggcactacaaaaaaaagcactaaataaatttttaatttaaaaataaaaaattaatagtgttgatggggggtggaatagacattgtagaatcctaatactatttaatgttgttcatatgtgtaagaaagacacattatattttaaaatatagattctaatattgaaagaaaaaaatcatcagttttggagatgaaacgcatttttaggaatcttatatggaaacttcaataaggacatttttataccagtggaaaacctgattggaacaccttagagacatattaggcactgttgtttggaatgccagataagttaacctctgtaagatatatattcttataaatcactgctagcatagctgtaatatgtgaagataatttattaatttggactgatgctgaatgtagacatcttccatatctaaccttaagcatttaaaaaaatattttaggactaattattttgtccaaaaaagcaatcttttgattattgatcttcacagaattgatttgtaagatgtcatgatcaattgtggttagcatctttattattatatccattccaagataattttaggcttttgataccttgataccttt

SEQ ID NO: 36747 - DNA, 1024 bp, Homo sapiens
tgtttatgatcatcttcacatttagttttcaagacaacgcagtttagttttcattacagtttggaataaagaggacagggagtaattgattgcttcaagcagattaaaatcaatggttttcttttcaaagaaccagttcaatgcagtaattccaactttaaacattgatttagaggactcaacacaaaatgttttgtgctgtgtgaacttttatataggaagactaatattaattttattcccctgtatatctgtatagtgaaatatagaggttgttagtaacatgtgcatgacttaatagtgatctatattaagtcattttgatattattgcagtcatataatgaatcagtgagattcccgtcatcactgtaatactgtttgtaacccattagcacagagaaattacagcccatcatacatcattactgtgattgaggctttattaccatattctcaaattgcttgcttgctataaaactaaatagacacaagacaactataggtagagtagagactgcgcattattgtgctacagtaatgagggattattgtaccataatgggttgaaacttatgaggaaaataaacttggcagtaatagaaaactggagactctttttacatttgtttttattactttaaaggtcaaatatatttgttatgctcaggttattgtttatgtattacatgaatcatagccttttaatattttctaaagatttttttcacccccacccccacccccaattgtatcctttcaaagtctgtggcctgatgcactttgaatgcttaggactggacttggaatctgtgtttttcctgttgtgagatgagacgttttactgctactaagcctaccatttctgagggtaggtagaaagctttaaactttaggctattttcagcatactatacattttgtttacagtgtggataggccagtggtcttcacgctcttcagttgaaataaatgtattaatgcagcaatattctaagcaatgaatacagatttaaaatatggaa

SEQ ID NO: 36748 - DNA, 1026 bp, Homo sapiens
gcagtgcaaaagcagaaagccagaaataatagtgagaggcaaagttagagaaatgtgcatattaaatctttaaaatactctatgactttttcctgcccagcatcttttgggggaaaaagagagaagatgaataaattaaaggtttttttctttctttgtttttttgagacaaggtctcactctgtttcccaggctggagtgcagtgttgccatcatggctcacggctcctggcagcttcaacctccaggctcaagtgaccctcctgcctcagcctcctgagaactgggaccataggcatgagccaccacaggtttggtttttttttcttaataggttggacatatggctataaataaaaaataagaaaattaaaaaagagtaagtgctaagaagaaaaataaaatgaaattataagtataagaaatgctagatggggttgttatatatatgattttttgtagaaggcctttctgataagatggcatttaaggaaaaatctaaataaagtgcaggacaagccaagatatttatctatggtaaaaaaatatcccaggaacagtgaatgtaagtgttctgagagagaagcatatttgatatgtatgcagaacagcaagactgctatggctcagcagataaagggggaaacataagaaattaaacatgataccttagtaattttttaaatgaatttaataacattaaagtctttctgtgtagttaggtttttgctattagagaggtggttctaagtcaaatgatgcttctaatatctttcttaatatattggatatgaccttgttttttaagtatttaaatatgcttgaacatgttaacccgatcatgtatcttttgtggaggtctagagtttttttttgttttgttttttagggtttttttttttaatgatacaggctttattatcttccccattttgcagatgagaacactgaggcatttacccagtggcttataagctgataggtgctaaagccaggaatcaaattcagaaagtgtagcccagattc

SEQ ID NO: 36749 - DNA, 1049 bp, Homo sapiens
tgtctatttattctgttgatagtttcttttgctgtgcagaagctctatagtttcattaggttccatttgtcagttgttgtttctgttacaattgcttatgaggacataaacataaattctttcccatgactgatgtccagaatgatgtttcctaggttttcttctaggattcttatagtttgaggtcttatattaaaatctgttaatcggtcgagttaatttttgtatatggtatatacagctacatatagctagccaactatcccagaaccacttattcaataggaagtcctttcccgattgcttagttttgttgaccttgttgaagatcagatgtctgtaggtgtgtagctttacttctggctcctctattctgttccattggtctatgcatctgtttttgtaccattaacatgctgttttggttactgtagccttatagtgtagtttgaagttgggtaatgtgatgaatgcctccagatttgttctttttgttcaggattgctttggctattcaggctctttctgttctgtatgaattttagaatagtttttttttacttctgtgaaaaaatggcatggtagtttgataggaatagtgttgaatctatagattgctttggacagtgtggccattttaacaatattgattcctccaatccatgagcatgcaatgtttctccatttgtttgtgtcatctgatttctttcaacagtgttttggaattctccttgtagaaatctttacctttttgtttagatgtattcttaggtattgtgtgtgtgtgtgtgtgtgtgtgtgtgtgtgtgcacgtgcacagcaattataaatgtgattttattcttgatttgtctctcagcttcaatattattggtatatagaaatgctagtaactttttgtacattaatttttgtatcctgaaactttactgaagttgtttatcagttctaggagccttttgacagacttaagggtttttttcaggtatacaatcatattgttggccaagagagatagtttgacttcttttcctatttgcatgcctttt

SEQ ID NO: 36750 - DNA, 1050 bp, Homo sapiens
tgtatgtgtctttttagtaaaatgatttcttttcttttggttatatacccagtaatgggattgctaggtccaatggtagttctgatttaagttccttgagaaatctccagactgtggagacagtgcctgaactaatttatcttcctaccaacagtgtgtaagagttcctttttctctatagccttgctagcttctgttgttggttttttttttttttttttgctttttaataataactattctgactggtgtgacatggttttgatttgcttctctctgatgattagtgatgttgaacatttttttcatatccttgttgccacctgtatgtcttcttctgaaaagtgtctgttcatgtcttttgtctattttttttaatgagatgtatttgtttttgtttttttgcttattgaattaagttcctaatagattctggatattagacctttgttggatgcatagtttacaaatatttcctcccggtttatagattgtctgtttgttgatggttacttttgctgtgtagaaactctttaattagttcccatttgtcaatatttgttttgttgatttgatagactgctagctagactaagaaagaaaaaagagagaagatccaaataagtacaatcagaaatgacaaaggtgacattacatctgatcccggaaaaatacaaaggattctcagagactattatgaacacccctgttcacacaaacttagaaaatctagaggaaatggactaattcctggaaacaaaaccttccaagtttgaatcaggaagaaattgaagccccgaacagaccaatattgacatttgaaattgaatcagtaataaaaacctaccaaccaataaaagccgcagatcagatggattcacagccaaattctaccacatgtacatagaagagctggtacaaactctaccgaaactattccaaaaaatcgaggaggaagtgctcctccctaactcattccgtgaagccagcatcagcctggtaccaaaatctggcaaggacacgacaaaaaaaactacaggccagtatctc

SEQ ID NO: 36751 - DNA, 1034 bp, Homo sapiens
ctggctcttccaatgtagtatatgagtctgctaaagtttgtgaagtcttgttcgtttatttatttaggttgctgacaagtggaaataggtgagatatgaagttttggggattttaatcctgtagaaggggtccttgaattgaaaaaaagttttgagaaccagttgccttcttcccagggagaagatggagcagaggtcccaaacatggtaaaactgaggtagaaaagaagaccttaggagaagcttgaggttcaaagagagggaataagttaaaaatgtaaaaagttaacttttgaaacagagaagaggaaactagtgaagaaggaattcttcctcgctgcattctgcattagttatctattgccgcagaacaaattacccctaaacttagaagttttaggaaaaatcatattctatttcacagacttcctgaggcacaggaatttcggaatggcttagctgagtaattctcacttaaggtcttttatgaggtttcagtcgaaatgttgatccagggctgaaaattctgaaaacttgactggggttggaaggtcagcttgcagaatggcttgctcacgtaactgttaacagaaggcctcatcagttctagcctgttgttgacaggaggcctcacctccttgccacatgaagccctccatagggctgcttgattgtccccatgatatggcagctaatttccccaaagtgagtgatgcaagagagagggtgggaaagctactgtaaaaattgggggtcatgttattaattatttgttatttatttattattactattaagcagtaattgatagcactcattttcttcatttatattgtgattcctcattgtttttgatcatctcagggcacaaaataacaatctcccaaaacaaagaaaccaagctaccaccaccaacttgtgataaatacaaaatatacataatttatgtattttgaaggaagtcctgtaatatcctagttgaaattatttcttgaagtacagtcacacatcacttaacaacaagagtatgttct

SEQ ID NO: 36752 - DNA, 1175 bp, Homo sapiens
ccaggctggtctcaaaatcttaacctcaggtgatccacctgcctcagcatcccaaagtcctgggattacaggcgtgagccaccgtgcccggccatgtctttctatttagttaagccttctttaatttctttcaacaatgccttagaattttttttttttaattaggcaagttctcttttttctcaacttttattttaggttcaggtagtacatgtgcagattcgttacatgggtaaattgtgtgttgctgaggttcagtgtacgaatgatcccatcactcaggtactgaacataaaatctaagagatagcttttcaactcttgctcccttacttcccttctaatagtccccagtgtgtcttgttttcatttttctgcccatgtagaattttcattgtacaaatctttcacctcccttgttaaattcattcctagatattgtatccttttgaatgctattataaatggaatttttaaaattttccttttggattgttgattgctagtatataggaacttaacagaatttttgtttgttgatcatgttccctgcaactttgctgaattcatttattagctgtagtagattttttgtagacttttgtagattttctatatatagaattatgtcatctgtaaagaggtagttttgttttttttccccactctgcaatttgtaagccatttatttatttggcctaattgctctagccaggacttccagtacaatgttgaatagcagtggtgaaagtggtcatcctcttgttactcatcttgggggaaagctttcagtctttcaccattgaatgtgatgttagctttttttccttcaaatcctgtcagtgtttagttcatatatatatatatatatatatatatatatatatatatatatatataattgctgtatttgatgcatatatgcttatcattgttatatattcttactgaaatgactattttatcaatatgtctttctttgtctcatgataattctctacttaaaatctatgtattctgatatttgaatagccattctagctatcttttagttactgtttgcatagaatatccttttttatcctttcactttcaatttgtttgtgtctttggatctaaagtgagtctcctgtaagcagcatatagttgactggtgtggtttggttttgttttcgg

SEQ ID NO: 36753 - DNA, 1033 bp, Homo sapiens
ttactcagaaaacatccttcaatccatactgatataaacaaatgaattgatgaattcttcggagaaaacagacaaatcttccttaaggaataatttttaataattatataaatactatccccttctggaggtgagcttttctctctccttgtggactggacttagtgatttgtttccaaagaggacaatatggaaaagaaaaaaggaataactttatagttaggaaatcagtcagactccaccttagtcaagtgttaagtgttaaaatcaccagtgataactcatgtggtagcacatctgtggtattagtcccataacccacaatcccagcctgatcatgagaacatattaaaactcagattgaaggaaattttacaaaatatgaaatacctgattactactcttcacaagtgtcaaagccataaaaaacaaggaaaagtctgaaaagctatcagattggagagaccaaggaaacacgacgattaaatgcaaatggaatcctagattggatcttagaatcaaaaaaagatattagtgggaaaactggtgaaatacacataaagtctgtaattcagttaataatattattgtaccagtattaatcatttaattttgacaaatgtaccttgattatggaagatgctaacgttaggagaagctcaatagaggatatctgggaactctctgtactctctttgcaactttcccgtaactttaaaattgtttcaagacaaaatgtttatttaataaaggtacattctgtcaacaaatatttatgcaaatgaatgagcatctcttcgttgatcatccttttattaattgcctattataatctttgtccattttttaggttaagtgcactattacatgttattgctatctgtggcttgttttgggctctttataaattatatcaatacctgaaaaagcttgtttatattatttacacactatttttgagactttgtgttctaaaaggaaggcttattttaaaagttggttgttgtcttctctgctttagatgctgggagct

SEQ ID NO: 36754 - DNA, 1072 bp, Homo sapiens
ttcttttgagaagtgtctgttcatatcctttgcccattttttgatagcgttgttcatttttttcttgtaaatttgtttaagttctttgtagattctggatattagccctttgtcagatggatagattgcaaaaattttctcccattctgtaggttgcctgttcactctgatgatagtttcttttgctgtgcagaagctctttagtttaattaaatcccatttgtcaattttggcttttgttgcaattgcttttggtgttttagtcatgaagttatcacccatgcctgtgtcctgaatggtattgcctaggttttcttctagggtttttatgcttttaggtcttatgtttaaatctttaatccatcttgagttaatttttgtataaggtgtaaggaaggggtccagtttcagttttctgcaaccccgtttcttaaatagggaattctttccccattgcttgtttttggcaggtttgttaaaaatcagatggttgtagatgtgttatttctgagggctctgttctgttccatttggtctatatatctgttttggtaccagtaccatcctgttttggttacagtagccttgcagtatagtttgaagtcaggtagcatgatgcctccagctttgttctttttgcttaggattgtcatggctatacgggctcttttttggttccatatgaaatttaaagtagttgtttcctaattctgtgaagaaagtcaatggtagtttgatgggaataacattgaatctataaattactttgggcagtatggtcattttcacaatattggttcttcctatccatgagcatgggatgtttttccatttttttgtgttgtctcttatttccttgagcagtggtttgtagttctccttgaagaggtccttcacatcccttgtaagttgtattcctaggtattttattctctttggagcaattgtgaatgggagtttgctcatgatttggctgatattggtgtataggaatgctcgtgattttcgcacgttgattttatatcctgagactttgttgacgttgctttttggcttaaggagattttgggct

SEQ ID NO: 36755 - DNA, 1045 bp, Homo sapiens
gtgctataaatttccctctaaacactgcgttagctgtgtcccagagattctgggacgttgcgtctttgttctcactggtttcaaagaacttacttatttctgccttaatttcgttatttacccagtagtcattcaggagcaggttgttcagtttccatgtagttgtgcagttttgagtgagtttcttaatcctgagttttaatttgattgcactgtgttcagagagaccatttgttatgatttctgttcttttgcatttgctgaggagtgttttacttccaattatgtgatcaattttagaataagtgtgatgtgatgctgagaagaatgtatattctgttgatttggggtggagagttctgtagctatctattaggtctgcatggtccagagctgagttcaagtcctgaatatccttgctaattttctgtctcgatctgtctaatattgacagtggagtgttaaagtctcccattattattgtgtgggagtctaagtctctttttaggcctttcagaacttgctttatgaatctgggtgctcctgtattgggtgcatatatatttaagatagttagctctccttgttgcattgatgcctttattattatgtgatgcacttctttgtctttgttgatctttgttgatttaaagtctgttttatcaagggcgaagattgcaacccctgctctttttttgctttccatttgcttggtaaagcttctcccatccctttattttgagcctatgtgtgtctttgcatgtgagatgggtctcctgaatacagcacactgatgggtcttgactctatccagttttccgtctgtgacttttaatttgggcatttaacccatttacatttaaggttaatattgttatgtgtgaatatgatcctgtcattatgatgctagctggttattttgcccattagttgatgcagtttcttcaatgtcagtggtctttacattttgatttgtttttgcagtggctagtactggttgttcctttccatatttagtgtttccttcaggagttcttgtaaggca

SEQ ID NO: 36756 - DNA, 1050 bp, Homo sapiens
tcataaggtagttctatttgtagtattttgaggaacctccgtattttctccatagtggctatactgtcacattcccaccaacagtatataaacagtattttgtccacattcccaccagcattttttttgctctttttgataatagccatcctaatgggatgaaatgatgatatttcattgtggttttgatttgcatttccctgatgattagtgattaaatatgtttgttggccatttctatgtcttcttttgagaaatgtctgttcagattatttgctcattttctttttttattattattatttttggaggatggagtcttgctctgtcgcccaggctggagtgcaatggtttggcttactgcagcctccgcctcccaggttcaagcgattctcttgcctcagcctcccgagtagctaggattacagatgcacgccatgacgtccagctaatttttgtatttttagtagagatggggtttcaccatgttgaccatgctagtctcgaactcctgaccttgttgatccacccgcctcagcctcccagagtgctgggattacagacgtgagccactgcacctggcctctttgcccattttctaattggattatatgtggggttttgttgttgttgttgttgttgttgttgttgttgttttgctgttgtgacgttagagttccttgtatattctagatattaatcccttgccaattaatagtttgccagtattttctcccatcctgtaggttgttcactctgatgattgtttcctttgctgtgcagaaggtatttaatttgatataatcccatttatttacttttgtttctgttgcctgtgattttgaggtcttatgcataaaatattttccagaccaatgtcctgaagtgttttcttctggtagttttattgttttaggtcttacatttaggtctttgatctattttgagttgattgtcatataaagtgagagttggaggtctagtttcgtacttcagcattaatttggattaatttgggagttctctattcagttttattggtccatcttt

SEQ ID NO: 36757 - DNA, 1058 bp, Homo sapiens
gaaaatatatacatatatccttcataatcctttagggctaagaagtctactttttattttgttggagaagaggtatagtgtgctaggtgaatgtacagttgctagagttgaattgcttaaatttaaattctaactctaccacttattctcttacatcaaattgtactatcacagtttcctcatttataaaagtagaatagtaatagtactatcttatggtatatgtgagcgttaaattagtaaatatgtgtaaattacttagtgcagacagcagtttccaaaggacatttgatgatatttaaagatatttttggttgtcacaatttgggagaggggtgccactgtcatctagtgatagaatccaggtgcattttgcagtgcacaagacagccccacaacaaagaattatctgaccttcagtgtcagtagtattgaagttgagaagcccctggttagcacaatgagtggcatatacatttttataaacatttgctattattttgtgctgaagtctaaaaaaaaacatggaagaaaaagtagaattattatgtaatcatcttttcttggttgttttgtgtgtgtgtgtgtgtgtgtgtgtgtgtgtgtgtgtgtgtggttgtttgtttttttgtgtgttttttttttttttggttttgttttttgttttgagacagagtcttgctctgtcacccaggctggagtgcagtggcggtatctctgctcactgcaacctccacctcccaggttcaagcaattctcctgcctcagccttccgagtagctgggattacaggcacccgccaccaagcccagctaatttttgtatttttggtagagatggggtttcaccattttggccaggctagtcttgaactcctgacttcatgatccacccacttcagcctcccaaagtactgagattacaggcatgagccaccgcacctggccataatcatcttttctaagcagctaaagaaaggtaaaatttttaatctcaggtgggggggtcagccccccgcccggccagccgccccgtccgggacgtgaggggtgcctctg

SEQ ID NO: 36758 - DNA, 1036 bp, Homo sapiens
actcacgcctgtaatcccagcactttgggagtccgaggcaggaggatcacttgaggtcaggagttcgagaccagcctggccaacatggtgaaacttcatctctactaaaaaaaaaaaagtaaaaaattagccaggcatggtggcacatgcctgcaatcccagctactcgggaggctgaggtagagaatcgcttgaacccgggaggcggaggttgcagtgagctgagatcgctattgcactccagtctgggcgacagaacgagactctatctcaaaaaaaaaaaaaagggccccaaaaagatacaagctttacccctctgactctgaactatcatgcacaatgtagtcagacaaatcttaaacgtcactcttgtcctagggttcttcccacttagaaatctccctgttgctcatgacatcaagccagtactctggcttttaaggttctccataatctagctccatctactgtccagtttttggtttccacagctcccttctgtcatgctgactcccatttttaacttggatcatactgttctcttcctccttctgcccacactcatacaaactcatacctggatcatatttgctgttaaaacttaataatggcaatgctcgcactcatttattgtttattatacaccagtcactatgatgataaaccttctatgtgcattatatcttaataagtctcaaaataatcttatgacgaaggtgtcattaacctcatttctatagtagagtaactcaactaagagtacataggtaggaagtggcattcacaagatttgaccttaggtccttctaactctaaatccattaaatgatgaagtgtaattcctgatcttgctcctaaagcattttatgctctgtgtccttattttcttagcaaggtttgagattcttgaggaaaggggcagtgtctatacatatcttgtatctgtcatacaactaggacagtgctagattatcacctattttctcattgattgattggatattgattagagtgagatggtcagactttatggtga

SEQ ID NO: 36759 - DNA, 1109 bp, Homo sapiens
cctggctaacacggtgaatcctcgtctctactaaaaaaatacaaaaacttagctgggcgtggtggcagtcgcctgtggtcccagctactcgggaggctgaggcgggagaatgatgtgaacccgggaggcagagcttgcggtgagccaggatcatgccactccagcctgggcgacagagtgagactccatctcaaaaaaaaaaaaaaaaaaaaaaaagaaaaaagaagaaaatttggacaattggatggacctattgatctgaatggggaaaactttgataacttattggacacagtgatcatctacttactcagtgagttgaaaacttaccttggagataggaagcaggaacttgtattgactcaaaaaatgaggatgaaagctttgaatctggcaatataggtgatgcagataagttcttgagataaaataacaccaaataccacagatcattctgtttttctcctgactttttttctatcacttttcttactactttatttctttgcaagactcaaagactagacccattatttaatattagaagttatgttacctttcattaagaccctctcccctctaactactactaaagctactcacatacccacttagaacatatatctgttttctagtatctagtccagataaagcacaaagaaaagagacattccaataaaaataataggtaatacttatgaaaattttactgtataccaggactgttataggtccttcacataaattaaccattttaatctcaaaaattccacagattaggtactactctcatcctttttatatttgaggaaactaaggtttaaagggtaagcaacttgctcaaaattacttagtaagtggcagaatctcactagtcttgggcttcagaatctattcctaaccacttcactagattacctcctattttgtgatattatactttgtaaccctagttaaaagatgtacttttgccaatcagaaggttactttgcctgcttaagtcattagcctcagttgccacacttctataatgaaagtgcttcatgggaaacagtactaagagattctttttggttttttttttgagatgaagtctcactcttgtcgcc

SEQ ID NO: 36760 - DNA, 1035 bp, Homo sapiens
ctaagtagttacagttatatttatactcacccaggctaataaatggttatataagaaagtccacatgtattttagttcatgcttttttgtaattgtcagaaattcgtgtcctaaaagaaagtatgtaacttaattttaaggaggtcaaaatgttctaaaaatattaccttataaaaactgcattcctgtgagtaaatatatctctaatattcttcagttgaaaagaacatcattttcattagttgaaaggcacaatggagtaatacaaagaaaataagttttttgaccatttctttgattattgcccccaccaaatcaacatctaatctaatctaaaataagattccccattatacattaaatgtttagatttctctgtctagcagatttttaaaattctaaaaccaagaatcttcttactaaagtctagttgacagtattgtcatatttctaacaactagagagaatcatgtagattttcttttctacattagctatcaaatatataggacttgtgaaagataagtgttggattaatcactaagattagctgatcttttaatatgaggacaaattctgaaaatggtggcattgaatggaaacctttaatgtaggttcattccaggaatatgtttatgttagttaagtttaaaattgtattccttggtaaaccataaaagatttccaaagtattagacacccacttttgtgctggaatttaatatgcaactttttattggaaaataatcgtccttgtctggcaaaatccaccatgcaatatttctgttagtaggtataatgcaataaagccagggagggctatttatcactacaaattttgaggatttcaggattctttttattattttaatatatttctttgatattaaatcagaaaaatgataaattacacctgtctaggctgtttttcctttttactggaaagtgatgtacaacccaattccaatggtcatttggctttttaagatatgtattttttcttattaaaaaaaaaactcaacccatatttttttc

SEQ ID NO: 36761 - DNA, 1013 bp, Homo sapiens
tccaccttaagcaagacacttaacctttctctgcctgtttcttcagtagagtgcagctcgtagctccctgtgacttaggatgaatgagtgaattcaatctctcatttaaaagaaaccccttttgaaaaagaatactatataaattatcaattgtgcatatccatgtgtgaagtgaagattctgctttgacagaatccttgaggaaactgcagtctacctttaaagtaaaaagttaataggaaatgtctcttttccctcttctctatttaaaaaaaaagagaaaaaaaaggaagcttagtgtaagaagtgtacccatggagaatgtatttaaaatccaaatgacccataagggaccccatcctttttggcagataaaagtttccctgccatttatttgataaattaattaaaaagaacataaataaaagagaataataacttagagctatctgggcacctgagtctttgagccctttagggccttggcacccaaagagaagggggaaaaaaaaaacactgcgtctctgaggctttgaaagtggtcttccttgaggcattagagaagctctaggggccctaggagctaaaggactgagatgcctggggcatgagtctattagatccactaaagaaccaggaaaaaaaaaatggctggtaagtaattttgctatttcatttgatgcaaaagagaaggcacaacaccagaatattcagtgagcaaaagtacaaaatgtggcatggatgtgaatgcaggctgaccccttctcgggaatatttctaagcctaaatgaagcactcaatgctgaggacaatgtacaattctatgcattttaaaccgtagtgacccttttgtttctctgataggtgaagatgaggatgaatttgagaatttcatgctgcctcttacagttgcttttgaaacagtattacaaatattcaacaacaactttaaacaagaagatgtaaaggtgggtttgtttccaaatatgaggaatgacagttttgttttttct

SEQ ID NO: 36762 - DNA, 1034 bp, Homo sapiens
aaccatcttcctagagtcatttttaatggagttccagtgatatatccctaaaccagcaagttcttaacgaccctggaaagtgactgcttgattacactttaacggtatttgcaaataaaatcacaagtaattaaggggaaatctccaggcttttgagcaagtttgatgcatgataactgcctgattcagcttcatctagagtaatgctgtgtaggcaacagctactgagatcaatagcaacgtaatgatagtggcagaattaagtgagtaacctgagaactgtgcctcagaatgcatgcagctgccacgaaccaaggccacacagtgcactccgtgcttccgtcctaaatgttcatcaaaagacgccctgcaggaaaatggagttagatgctctttattgctgatcgtgtctcttgccacatttatcagggaaattggattagcagttggcagctgcaggtagacaagattctgcagtgattaaatatgcagcttggctgcatttgttgtgacagacctttagtaaattctactgtaagcaccatctgtctaatttgtataaagaaaacttggtgctttaagctaccgataaaaaactaaatctgttgctttatcataaacaaaacttttgcactaaatgcttttaaatgtaatttattaggttaaggctatttttctatcacgatgaataaataatacatgcaaaagtgctttcaggtacttcattttgcaagtactagagataaaaacatttctgttttgttcttcaataaagtatttagtattccaatccacaggaggtgatgctgttaaaatatctctatgaaaatgccgcaggactgccaaattcatttaatttgcacctcttaccagcattttctaactccctatttatagatagtttcaaatgcagatttcaggataaacttaaacattaaggacctgtgttgccaaattgaaatacagttgttagaggaggaaatgcagcaaaagtgttaaatttatagctttattttcttacttattcttaataa

SEQ ID NO: 36763 - DNA, 1015 bp, Homo sapiens
aaatgattgtttatgttggagttgaagggataatctggctaacatctttagggatcaatgaatcctaccatttgacatttttgaggggagatttgaatctccatctcaattagcaaggctgggaagatcattttatctcttcaaggcctaacccatcatgccacagtttttcattatcatgaagataatgaatggacatggaaagggaaaaataaataagtcaaggtttgtcatttggtgtaaaatttgaattgacctttgccaagggttagtacagacaggaaaaaaaaaaaaaaccccccacagaaatgccttatcatgtaagagttaaaagagcatagactttggtgatagacagacccggcttaaaatcccagctcttcatttactgtgttgtgaaccttggcaagtcatttcacctgtctgagtcttggttttctcatttgaaaacagatacaattcagtatcatggtatattgtaaccattaaaataggtaaagtgtactctgtataatgtctggcacatttttggtagttgtaaatggtcgttaatattgttctaatagtgttgtatgacttatgtttgatcccagcaggaagtgatattgtatgcaagtcatctaagtgttatataatgctttcatgtcttttatgcatgaaaccatcagagcatgtgaaaaaaattatataatctgaaagctaatttactttttaatctaaactatttctcagttactttttttaaaccctccttatccaaagtttcctgtaaattaaattgcaatagaaacttcttaaaggtaactgtcaactactatgccacagttatggccaaaaatataactaataggggatctaggcatgttttagggagaactctacatattataaaaatttttaaacattaatttgatactgacatatctttaattattattaaaatatacttcatcagatttatgtacccagagaagggttacagataaaatttttatgtcattgagtaatcatgcac

SEQ ID NO: 36764 - DNA, 1050 bp, Homo sapiens
gaaaggcttccagcagcagtccccttgtgaacaaaggtccagatgtttacatattcatggagtacctttaagctctgaactggcaagctatttctattctggaaccacatccccaaacccttgtctcctaacacttttaatgaaaattcttttgccttctggtattaacaactgatgaatagatggacggacggacagacggacggatggatggatggatagatattgtaaagaagcaaacttgatacttttcacattttcatatttggtatcctgtaaggcagtgtcacatcattaatgcctttgatttttaatttatctgatgtggaccttagaaattcatagagaagatctcagtgaaagcaattagatctgtgcttcttctacctaagggctcccattctcttcttcctactcatatgtacatagtcctcacaaggccattggaaaattaaactcctagagtgggttctggttctcaccctgtaattgagcctggcactctcactctgcagcccttttaacctctctattgtgctttccaataatccctcattttctctgtggcagtcacctctgtcagaagcatattagaattggcaccactctcattccacacagaaaaaggagcatccccttatatctccctgccttatcccgtagtgaatactgtgtgctctgaaaaatatcctggtcctaatgccattataggatgccttgcagaggcctatgtgtgcctctgatattcttaggttctgagatttgggttgaatccattttctcatgagccttccagatgcattcccactaatgagtttgtgctcaggaggtcccttggtggaatattttctcacctgtacccctgtggcattggttcagaatttctgtactcaaagcatccctattatatgttggtcaccctaatttgagcatgtgttccccaagattaaaagctatatcttcctggccgggcatggtggctcatgcttgtaatcccagcactttgggaggccaaggtgggtggatcatgaggtcaagagatcgagacca

SEQ ID NO: 36765 - DNA, 1094 bp, Homo sapiens
tcattctttccttaggtacctgatttaagaacgcaatatataaagattctaaactttaaaaatggatagtacaagctatgattattcactgtcataagaatttacatcaggatccttttaagcagtgtatgctctgggtgtatgtaaggtataacttaatatgcataaattgaatttgtaaagtgttatacaagccactgttattcgtcaccacctagataataggccattggttttcacccttggttttgcagagctgtagaggcctgtgaaagtgccacagcagccctccagaaaaagggggaaagaggaccactttgccaccttgaccagaaccacccagctatgtagttacactagacttgttcgtaaaagctatcacctgttaggactttttttaaaaaagaggctgaaaatcacttgcatgtactattagaagtgttgtaagaatggaagattaagattgtatacaggcatacttctttttgttgtactttgcagatactgtgttttttataaattgaaggtttggagcaaccctgcatggagcaagtatatcagtgccagcatatgatttctttgtgtctctgagtcatattaataaatgtgtattctgactgctctgctttggccattccccatctcttcccttctcctccccactccctattctctgacacagcaatattgaaatcaggccaatgaataaccctacaatggcctacaagtattcaagtgaaagtaagagttgtacatgtctcactttaaatcaaaagctagaaatgattaagcttagcgaagaaggcatgtcaaatgctgagacaggtcaaaagctaggcctcttgcaccaaacagccaagtggtgaatgcaaaggaaaagctcttgaaagaaattaaaaattctacactagcaaacacacaaatgataaaaaagtgaaacaaccttattgctgacatggagaaggttttagtagtctgagatcaaaccagtcataatattcccttaaggcaaagcctaatccagagcaaggctctaactctcttcacttctgtgaaggctaagagaggtgaggaggctacagaagaaaagttgg

SEQ ID NO: 36766 - DNA, 1026 bp, Homo sapiens
gaaaattgcttttgtatagtgctcttcatgacatgcatcccaaagtgaattacagcaaaagggaaatcatctgctcttttttcatttctgtgtttagactgaaatgatattgctcaacattttgacatactaaccaagacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagtcagattttctaatgttaataaagacatttccagtgatccttaaataaaaaatatgctctttatgtaacccattagctctctctggttgatttacaactttattctcaataatacagtagtatattgatatcaaaaacaaactgaaagaacattcacaactggatcaggtaataacggatttaaaaagtttaaaggaagccagggatatgtcattagacactgaaattggaaaataggaactcaaatttcataacagaatttttgcacatggtgctacaatcttggttttaacagcaatcaatgcatatattatgcatatacatagtgggaagaaaaataatattggcaaaatgtaagtgcttctattcacaatagcacatggaatcaacctaaatgcccatcagtggttgatgggatagaaaatgtggtacatatatacaccatggagtactacacagccatcaaaaagaaagagatcatgtcctttgcagcaacatggatggagctggaggctattatcctaagcgaactaacgcagaagcagaaaactaaatacagcatgttctcacttacaagtgggagctaaacattgagtacacatggacatgaagggaacaacagataccggggcctacttgagagtggagagttggaggagggtgaagatcaaacaactacctattgggggtactgtgcttattacctgcgtgacaa

SEQ ID NO: 36767 - DNA, 1033 bp, Homo sapiens
cccggccctttcctatgcttagatgcacaaatactgtgtttcggttgcttacagtattcagtacagtaacactgtacaggtttgtagcctaggtgtgtgtagtaggctataccatctaggtttgtataagcacattcttatgattgtacaaagatgaaattgtctaacaacacatttctcagaacctagccctgtggttaagtgacgcatggctgcatataacatttagtgggggggtgtaaaataggtggaactcaaaagttgaagtagtattttttttttgttcacaggtcagtttaggggctggtgcaaaggatgagttgcacattgttgaagcagaggcaatgaattacgaaggcagtccaattaaagtaacactggcaactttgaaaatgtctgtacagccaacggtaagggcacttacatactttggatgttgtgtcaaggtttaattctgttttaaggtaggtttggtgtcatttagttgtgccaaggagatagaaagtggttctttatcttctgtcactggagttcgatggtcaactcttgaacatgggggcttctgctgctacttttatcagaggtggaaaaacaggttcactggtttgttgatttggcttatgtgtttgcctgtaatgtttattgttcattttcttcacatgtttagtgatgaaaaatttctcccttctaggtttcccttgggggctttgaaataacaccaccagtggtcttaaggttgaagtgtggttcagggccagtgcatattagtggacagcacttagtaggtatgttatttttatatattatactacttagtttgtcctctttagtgcagttgcttggttcccagtttggacttaaagcatgggtatagtactactgtctttttaataggttccaatgtgagtctagaaattggagaggacaaataaatttttggggcgggggggagaggaaatcttgctgtcacccaggctagagtacagtggcacgatcttggctcactggaacctctccgggattcaagcgatcc

SEQ ID NO: 36768 - DNA, 1256 bp, Homo sapiens
tttttttttttttttaaatagaatagaagtctcagtttttagagtatttactatcagtgttctttttttttctgacttcttgctgcttgagttttataatgtctaataaattgtattttagctgtggaggaagatgcagagtcagaagatgaagaggaggaggatgtgaaactcttaagtatatctggaaagcggtctgcccctggaggtggtagcaaggttccacaggtagagatggcaattttattataggttttgtattatagcttttagtttggtgatagaacagctcttgttcatgagtacgtatcttttcttttaaaagaaaaaagtaaaacttgctgctgatgaagatgatgacgatgatgatgaagaggatgatgatgaagagtaagtatgattttagaaacttgatatacttccggaatcttgacaaaaaaaggaatttgacatagttatatgcatgagggttttataaaagtcatttacaaaaagccatcctatgtaatagtttataataaaagggcaggtggtcatctgttgtcagtttaagttaaatgagctgagttgaaaggatattgggtctgtgagcctttacaatgctgtgacttgtgactcttcagaagggtagactatagtgtttgtgaagtttgattatgtccctttgttctgaagatttagtggatgtgttatacccatcaagcctggtatgttttatggtgagcagttaatgagattgggttgaaagaaaatatgattaaatagctctatattcattttacaagttgttactcaaggtttgttattccctaaaaggattttgtcttatggttttatgtagatatttattgacaaaaataagattctaaaagggatattaagattttcttgggatttaaaatatggttggaaacaatatttgatgactttatattaaactagatcaaactattgttacaaacagttaatacgcacactggtataaagtactgtttataattggtcttatgtgtgccagtaccagtaatgcattgaatactttgatttggctctcagctttgtccttcagttctgaggttggtccatatgcatttattgaaaacaaatataagaacatgcactttaaaagagaacctgcatgaaagatcaaattgggagtttaggttttaagctggtggttcttcaaaatctttgagcatgacgatgaaggcagaaaacaggaaaaaggccgaaagagccgaaagcttaaaaattca

SEQ ID NO: 36769 - DNA, 1057 bp, Homo sapiens
ggcacttgccaccacgcctggctaagttttgtatttttagtagagacggggtttcaccatgttggccaagctggtctcgaactccaaagtgctgggattacaggcgtgagccaccatgcaccgccgcaagttttcatataagttgaagaaagtgtactaaggtctgcatagtagtaaaggatgccttgagggaaacaaatattaatagaaacttcagtggtgagatggcaagggcccagcatagatagatggcaatgaaaatgcaaagaggtgcatgaaggttcgttatagttacttagaaatctaaccttttgaacacagatcaaaggggaatttggttcctttttgaggatggaatgggtatatggtgtgggctcagatgactcttgatttaagcaagaaaggctatgtaatgtgcatagtgctgatgtatactatacatagatgtatgtaatacgttgatagtatgtggcccttaaatgtcttttttaatttttggggaatttcttaagtaaagctgaatttttttttttttttttggagacagtctctgttgccccggctgaagtgcattgttggctaggctggagtgcagtggtgcaatcatggctcactgtaacttctgcctcccgggttcaagtgattctcctgcctcagcctcccaagtagctgggattacaggcatgtgccagcatgccaggctaattttttgtatttttaatagagatggggtttcgccatgttggtcaggctagtcttgaactcctgacctcaggtgatctgcccaccccagcctcccagagtgctgagattacaggtgtgagccaccacaccctgccagtaaagctgttttgatagtagttttgatagctattttgatagtagtttaatagacttgttttaacaaataagaaaaaatgtttaaaaaaagcattctcatcttgtttctagcacaggggaggcacctgcagggattgggttctaatgccagaaacttgtactgacaaaatcactgttaaaaagccacttgaagggctatttgtgacagctttttaag

SEQ ID NO: 36770 - DNA, 1889 bp, Homo sapiens
taaattcaaagttgtgaaaatttgcccccttaattctgagttttgtcctttatatttagggctttgttccattttgagtaaacttatgtgtatggtgtgaatggaggggtctaaatatagactttggatgtagattagcagttgccccaacatgatttgttcaaaaactattttttccccattgaatgatcttggcaacctttaaaagagtcacttatggctgggtgtggtggctcacacctgtaatcccggcactttgagaggctgaggcaggcggatcatgaccaggagattgagactatcctggccaatttggtgaaaccctgtctctactaaaaatacaaattttagctgggcatggtagcgtgtgcctgtagtcccagctactcaggaggctgaggctggagaattcgcttgaacctgggaggcagaggttgcagtgatctgagattgcaccactgcactccagcctggcgacagagcgagactccgcctcaaaaaacaaaaaaatcactgtttctggactgttctgttgatgtgtctatccttaacatgtaagaacagtacaacactgttcctctgtggtttttatttatttatttttttgaaatgagtctcactgtcacccaggctgtagcacagtggcgtgatcttggctcactgcaacctccgcctcctggttcctcctgcttcagcttcctgagtagctgggattacaggcgcccgccaccatgcccggctaatttttgtatttttagtagagactgggtttccccattagccaggctggtctcaaactcctgacctcaggtgatctggccgtctcggcctcctaaaaagtgccgggattacaagcgtgagccacggtgccttggcccctttgtaggtcttatagctgattttttgaaatcaagtgtgagttttctagctttcttcctttccagattgcatttggcctctttgggtcccttaagtgtcttttttgtttttgttttttgagatagggtcttgctctgtcacccaggctggagtgcagtggcagaattacacagttacagttcactgtctcaagcagatcctcctgccttagcttttcaaatagctaggactacaggcgcacaccaccacgcctgctaattaaaaattttttttgtagagagggttctcattatgttgcctaggctggtcttgaactaaaacgatcctcccacctcagcctcccaaagtgttaggattataggtgtgagacactgtgccagttcttgggtttgtttataaattttaggatctgtttctacagagaaaccagcttggggagtcttctaacgattgtatttaacctgtatattcggggagtgtttccatcttggcaatatctgaacatggaatgtttctatttaggtctttaatttttttttttaacacaaattcactctgagtgtacagtttaatagaactatacattacttaaatatacatacattatacagtggtatagtgtgtatttatgcaaaactactcattgagcaacttcatttcccagcccctagcgatcacaattataccttctatttctttgagtttgactacttttagatacttaatgaatagaatcatacagtgtttgttcttttgtggctggcttatttcactttgttcaaggttcagtcatgtagcatgcaagaggattttcattgtgtgtacatatacattttcatttagtcatttaacacttgggttgctttcacctcttggctgttgtgaacaatgcttcgataaacatgggtgcacaaataatcacttcaaggtcctgctttcaattcttgtgtctactcccaaattttgaaagtgcttaatgtcttgacatttcatttgtagtgatgatgatg

SEQ ID NO: 36771 - DNA, 1077 bp, Homo sapiens
agatcacgccactgcactccagcctgggcaccattgagcactgagtgaacgagactctgtctgccctgatttccttttttgaactgacttagtactgtgcataaaagcaaactcccaagttactctttttttttttatttaaagagatgggtggcctactcttgcccaggttgaagtacagtggtatgatcatagctcactacagcctccagctgctgggcttaagcaatcctcctgccttagcctcctgagtagctgggattacaggcatgcaccaccatgcctagctaatcatcttattccttccttaaaggaaagattttaagaacaaaattatatggcgtgaatttattgatgataattccagttgtataattagctttataagggagttttgtgagaatatttgaggaaatccagatagaatgggttttaattaggaattgtatttattcttatgaccttttggaaattcatttctttttcagggacaagaatccttcaagaaacaggaaaaaactcctaaaacaccaaaaggacctagttctgtagaagacattaaagcaaaaatgcaagcaagtatagaaaaagtgagtaaagttatcttaaaaaaactttgtctcccccctcaaattgcacgtgtctggtttgcatagacttgaatgtttcttgtttttttgtttgttttggtttaatatacttgcctggttcgtggtatgaattttttcaaaaatttcttataaaacatttataatcgtgtctgtggtgatttttgcatatgcaaaattaaatatgccttattttccattatgcaaggaacgtagtgcactggttgcaagataacattctgaccttccatgttaaaatagatcagtgaaaaccctttgcctattctggttgtaagatatgctagagaaccaacagagggcgtatgagacttcattaaaattacaaacagctggaaaagtagatgctggctgttgcttggtattatagttaatattcatgattgaccctagtcagaagtgattttcagcagattgagacatttctctttgccctttacaccaagttgtc

SEQ ID NO: 36772 - DNA, 1060 bp, Homo sapiens
agcataagagatgcattcttcaactactgccaaggaaagtgatgataaatttaatgattaagttgcagtagtcttctgtactttataacaaaggcttgtagctacaaagtcttgtagctattaaattactgaaccagcacttctacaagaagtattttctttttataaaaagtatttttggccaggttggtcttgaactcctggcctcaagcagtcctcccatcttttcctcccaaagtgctaggattacaggcacgagccaccttgcccagcctaccagaagtatttttttgctctagaattgaaagtgttctcaagtgtcagaatgaaatttctggaataaatagtaaatgtttaataacttgaacttgaattgctgttacagagattatcaaaactaaatgcttcctgtttttgacatagagatgcatgatgcaagcaacgacaatgtatatttgtttgaacctgatgataagatctctggctgggcgtggtagttcatgcctataatcccagcactttgggaggcaacatggcaaaactctgtctctactaaaaatactaaatttagctgggcatggtggcatgtacctgtaatcccacctactcaagaggcggaggcaggaggatcgcttgaacctgggaggcagaggttgcagtgagcgccactgcactccagtctgggtggcagagtgagagtctatctcagaaagaaagatttctatgatatttaatattggcattcggtattcagttaccttgtacctgagaacccattggctgtgaaacagtgacagctgagagaatcctgagtcatctcatttctagttcttggtgaacttctggacttttcttcagaaccaccttgccatgttggccaggctggtcttgaactcctgacctctcaggtgatccaacaccttggcctcttaaagtgctgggattacaggcatgagccaccatgcctggccagctgttttttttgttggtttgttttttgttttggtacccatctgtagtgtgatcttggctcactgcaacctctgcctcttgggctcag

SEQ ID NO: 36773 - DNA, 1832 bp, Homo sapiens
gtgagccaccagcccggctaatttttgtatttttagtagagatggggtttcaccttgttggccaggctggtctcgaactcctgagctcaagtgatctgcccacctcggcttcctaaagtgctaggattataggtgtgagcaactgcacctgacctcaacctggattccttatctgaatcaaagcaattatttcagtgactatttgctcaagttgcctagtacttcttacagatgtataggagaaaatttatcacgtagataatgaggatattcagagactaattagcacctttatatgttctgccttaagctgattacatgatctgagtcagatatactgatttgatttctattgttttgttgtgctttatactccagtagtttgagtaggtgagggaatgttctccagttctgtgccgttttccttgggagattttcatctcccacttctatccattcttagtctggtttgattgtcttggatggtttttctcattcctttttgtttaaacttgggaaagagactttgattttgtctttaaatttttgtgttgattttaatataccaactgcttgctgctttgggcgtgtatctgaaatctaaaaaacattactcaacattttatttattccaacattttgaagtgatcgtgaattttttttctttcttgttttgagacctattctcgtctgtcacctaggctggagtgcagtggtgcgatctgagctcactgcagtctcctgtctcagcctccaaaatagttgggattacaagtgtgtgccaccacacctggctaagtttgtatatacatataaaaataaataaatatataaatatatagtatatagatatactaaaatatacatatattttagtatagatggtttcgccatgttggccagtctcgaactcttgacctcaagtgatctgcccgcctcagcctcccaaagtgctggcattaggcgtgagccagtgtgcccagacaggttttcatcctatgtgtttttgcctttaactttctagtagcctgtttcatttagcaggttggcatttgttaactaggctgatagttgtattttgaatcggatctgtagatgttaacccttctcacttctaggatagttctccactttggagagtggagaaaagtttgggtacagtactatcttgtctcataaccagtttctgggtgtcatatatgtgttctaattgtttactgtgggttgtggtttccttcattaattcagtatcctctatcctctatccatatctgtccatgtttttctatacctttattttaatgaagactcaagagaggatggtatgttgattgcctcactggaaagtacttttttttttttttttttggtgccaccatgcccaactaacttttttgtcaagacggtggttttgccatgttgcccagactggtcttggactcttgggctcaagtgatctcccacctcagcttcctaaagtgctaggattacaggtgtgagccatcacatctggctggaaatgatattaatgtgattttttttttggccaatttttagagtgatggattgatacctagcagcctgtgaaaaggaatcagtgaatttatccttaattcagattttcatgtatttgtatgtatatcaacccactgtgtttttttggtgctgatattttctttttgaccaagggaatccccttcaagcttgctcctaccatagcaggtctcaataatctgatcactcttcgatttcttgtgtgacggggtgtttcatcttgctcattttcttcctcagacctggaggggccatttcccccaaagaaccttggctcc

SEQ ID NO: 36774 - DNA, 1067 bp, Homo sapiens
cgcctcctgggttcaagccactctcctgcctcagcctcccaagtagctgggattacaggtgcatgccaccacgcccagctaatttttgtattttgagtagagacggggtttacaccatgttggccaggctggtcttgaactgctgacctcgtgatccacccacctcagccccccaaagtgctgggattacaggtgtgagccaccacgccctgctggacctcctgtaactattaagcaaactttgtgcggcgggccacaaccaccctctctcctgtgaggtctgaatctcagcctagggggtgtggggtgatccttccttgggcacttgctcagccctaaagttattggctattccctgtaactgctaattctgtattctttttttttttttttaaagacagggtcttaaaaaaaaaaaacacagggtcttgcaatgtcacccaggcgggagtgcagtggcacaatgatagctcactgcagccatgaactcctgagctcaagcagtcctctcaccacagcctcctgagtagctgggaccacaggcgcatgcctccacacacacctaattatttttttttttttagtttttgtagacacggaatcttgccaggttgccaagctggtcctgaactcctgacctcaagtgatcctcccgcctcagtctctcaaagtgctgggattacaggcatgagccactgtgccctgccctgtttctttacagttgtctttgcccctttgtacttaatgcctgtacatttttgagagggagttttgctcttattgtccaggctggagtgcagtggcatgatctcggctcactgcaacctctgccttccgggttcaagtgattctcctcccttagcctccccagtagctgggattacaggcccctaccaccacacccggctgattttttgtatttttagtagagatggggtttcaccatgttgggcatggctggtctcgaactcctgaccttaggtgatccacctgcctcagcctcccaaagtgctgggattatagattgagccacctctcctggctaaatagtcttattttaaactact

SEQ ID NO: 36775 - DNA, 1145 bp, Homo sapiens
aaaaccttatatgcgttggtgacatcagcattatgtgctatgtagaccaggagtcgtcacccagatttctcataaatccaggccttcactccttcacctgccagcctgtttccctcttccaggcaggcatgtggcccaggggtgagaagaattgttctactgccagactgtgccagttcaagtcctggccctgcatcttgggcaagtaaaacagaaagaatgctactgtctaccatacagggttatgaaagtgatccgagatactgaacgcaaagtgtaagccgaggcttcgtgcgcagtaagccctcgcaaggggggtagcagcagtcatagctgtgattgttactattatattattattattattcctccctcaaagttgctccatctgggctggagacagagatggaccttttttcctttggacagagggagagagtggtatgaactcatcttagtagtatgaatgtcaaggtcaggatttgaggggggcgatgagaatgattctagggctccctcccgcctgcctccacttggctctggtgtgttcatttgccttcgtgccccccaacacacatacacgcatgcacacacatacactagcacagcccccgggccagtggttctcagtaaggtggagggaatgagtaggtgaacaaacgagtgagtttttcgcctcactccctggcactcggcaccgagggctccgacaggctggtggccagggctgaccagccagagtttcatctaaaagcctcgatggctatttttgggacaaatgacccaccacttccaatgacttgctccgaaatggcatctaatttcattaagccttggaaacagtgacatcacaagtgcctgcccggtagccgcccacatatggcgaaccacagagtgatccgagattcgtctgcaagaacaggggagaactaaggtcccaagcagcaaaagttaaaatagcaaagctgaggcattctgctatgaaaagaaattacagatgaaatccattagtcagacatttccagcggcagtttccttgcttgggagcaggggaagacgtgtttattcggggttgggctctgcagccattcctcactctgtaggcaagatgtggcccggaaagtgggtttctgttaaggaaatcc

SEQ ID NO: 36776 - DNA, 1035 bp, Homo sapiens
ataagactcagtgaagaatcggatgtgggggtaagggcacatgtggaagcaaagaaacctttgacgtctttgtcttgacaaccgggtggtcctgtttctagacatggaagcttagaaaagcctggagtctgtgggaagtaggtagggctgggcactggtcattccactctggtttcctttggggttcccattaggtgtctacagggagaggtgaaattggaagttggaggtgtggagagttcaggagagggttctggaccacagatgttgaggtgggagtcattagtgaatagatgatgttggaagtcatgggtcctcagagtgggggctccttaagcctccaggccagcagcatcagcatcacctgggagattgttaggaatgcagattctcaggcccccctaagacccaccgactctgtgctagaacaagcgcccctcagagattctgatgccactgaagtttgaggagcattggtttaagcaagattacctacggagaggctgtagatccgtgttctaaacctggggtccacagacacccccaagaagagcggattgaatgcaagagatctatgaagttggatgggggaaaaattgacatctttatttttgctaaactcgatctaaagtttagcatttccatctgcgatgaatgtaggccacaaaccacagtagtattagcagtgcctgggacctcctcaacaacagaaattgccggtatttatagcacgttacagttgttgcagataatttccagagactgtttatatgcaccactgttttaaaattacggtgattggccaggtgcagtggctcacacctgtaatcccagcactttgggaggccaaagtgggtggatcacttgaggagttcaagaccagcctggtcaacatgtcaaaaccctgtacctacaaaaaaatacaaaagttaaccaagcctatgcttgtagtcacagctactcgggaggccgaggtgggagggtcttctgagcccagggaggtagaggcttcagtgagctgagatcgcaccacca

SEQ ID NO: 36777 - DNA, 1038 bp, Homo sapiens
tgtggtcatttaaatgccccttaaatgtggcatgggggaaagagtgagtgccacatgcactgtgtgacctcggacaagttacttccctctctgtaccccatgggtacctcagtgaagaggcatctccttcatgggctgtagggctcctgctgctccgaggcctatggctgctcctaggatgggaggtgttggttcttataaatgacataaagtagatgctcaagaggaaaatatgcttaaagttttcttgcaaggtctggaacagtggttcatgcctgtaatcctagcactttggggggctgagacagatggatcacttgagtccaggagttcgagaccagcctgggcaacatagcgagacctcacctctacaaattaaaaattaaaaaaaattagccaggcatggtggcatcacctgtaatcctggctaccccggaggctgaggcaggagaatcacttgaacctgggagttggggtctgtggtgagctatgatcacccactacactgcagcctgggtgacagagtgagaccctgtccctacaaataagtttccttgcaaaccttctgtgaacttcatttgtcttccatcatccatgctttgattctctgaagtcatcagaaggcaatttgtaggccataacattttgagtaaaacataacattagtttgattagtcccaaatggtgttctgacaactgcaaagctttgtgattcaatcaggtgggtgttttgtgcctgagaagcaacagggtgtcacattaagagcacagactccaaagttttgaacccctattcagccacttgctgtggcattggacgagggattcagggtctctgtgcctcagtttccttggctgtgaaatagtctaagaatagtacctactgcctagggttgagctggggattcactggggtggtaggcatggagcactgtaacccacctggcccagggaaggtgctgtgtaagtactgtgtattttgttgtggttagtatattatgatgtggcagacagttatgaagtacagacataacaggt

SEQ ID NO: 36778 - DNA, 1020 bp, Homo sapiens
cccagctactcaggaggctaaggcaaggagaatcgcttgaacctggaaggcagaggtttcagtgagctgagatcgcaccattgcactccagcctgggggacaaagcgagactccgtctcaaaaaaaaaaaaaagaaaagaagaaagaaagtcaagcccccttagattaagtcattcctttattgagtccctacagaatgttcttgggtctgtcaccttctagctgtgcagcttcagtccaggtccttaacctctcagtgcctcagatttgttgggtgaaaatgaggatagtaataaaactaccacatagggctgtttcagaaatagaatctataacgtgcacagaaattatattagaatgagattgtctatgtagaagagtgtttattgctggtacacagtaagttttcacaaatggtgattggaccattatgagcattcccaaataggatataatcttgagaaaagactaactttagagctttgagctaagggctccataaatgaaaggtgattcataaattcttcttgatttcaaaggacctggcactcctttttcaaccctaagctcagcaatgagagatcatcatcagctatgagcaatggacttccatggatctttcccatcttgctgccaagtcctacaagactttcatcagaacagccctaacacggataaacacaccagggatgaatgtgggagggaatcagtctgtgagaaattcttaactctccccatgctctcgctcttacatcctgatacttgagttatgtgtgttcccaaacgtgtttataccagttgtgcttttatactggtaggatgtgatttggggaactattagttaaaccaatgagctacaagaaatgaacctagtaaaactaagttgaatgctttagagagacttgattaaggtgagttgttacccctcccaactcaaaatgctgctgaatgagaagtgaacaagacaactgtaaaagatttgggaggccggacgcgatggttcacgcctataatcccagc

SEQ ID NO: 36779 - DNA, 1040 bp, Homo sapiens
ccttttacacccagggtccgcgcaaagtgtcggcctagccagtggttgggtggcgcccgggcctccaggcagtcttccaggggtcggcgaacgaaacgcggagctcgggagcgacccggcggggccaggcacgggcagaagggccaagagggccacaggtgggcgcggagcggccggagtgggcggggactggatgagaggggcggggtctaggagagaggggcggggcggcggccacaaacccgcaggcacgccgccggccgccgtttagtcccagagatagaaaaaagtagaggtaggagggcgcggcggctcacgcctgtaatcccagcactttggaaggccgaggcgggcggatcacgaggtcaggaaatcgagaccatcctggctaacagggtgaaaccccgtctctactaaaaatacaaaaaattagccgggcgtggtggggggcgcctgtagtcccagctactcgggaggctgaggcaggagaatggcgtgaacccgggaggcggagcttgcagtgagccgagctcgcgccactgcactccagtctgggcgacagagcgagactccgtctcaaaaaaaaaaaaaagaacaccagtaagcctctaccgcaggccctacacaagcaggcccttgtactcactggcatcgccctcccggggccgccaggaatgaggcactgagatcccaccccaagccgctgggggcgccattcgacttcgctcctacggaaatggggcttcgatgtctttctgcgcttgcgcggcacggaaactcacttccggccctgcgcactcagggtctgaggcagctagtagccgggtgagtggaggctggagttttctcggacagtgaactctaccgccccgtgagaccctgccctatgtgtcgcgggaacacatgtcaccccacagctctctttgagtgacctcccgaccacccattcctgcctaaccctagcattccttcctcagcctcaaggtcccagtgctaccctctcccccacgacccctttagacgggcatgcgacctccaca

SEQ ID NO: 36780 - DNA, 1093 bp, Homo sapiens
aaaaaaaaaaaacactaaatcaaccactttccaatttattcttggcaagggtggctagttctagaataggcttttaaaggtctcatcttatgcagcagatgatgtctgaatcttgtgaagttgtgtgtaatttaggattctctgtatgccgacttatttcttgaaatgggagaggctgtcagtcggcgccacatgtgggctggtggctctgtggcagtggtggcggctggactccggcaccatgagcggcttcagcactgaggagcgcgccacgcccttctccctgaagtaccgagtcttcctcaaaaatgagaaaggacaatatatgtctccatttcaagatattccaatttatgcagataaggatgtgttccacgtggtagttgaagtaccactgtggtctaatgcaaaaatggaggttgctacaaaggaccctttaaaccccattaaacaagatgtgaaaaaaagaaaacttcgctatgttgcgaatttgttcccgtataaaggatatgtctggaactatggtgccatccctcagacttgggaagacccagggcacaatgataaacatactggctgttgtggtgacaatgacccaattgatgtgtgtgaaattggaagcaaggtatgtgcaagaggtgaaataattggtgtgaaagttctaggcatattggctatgattgacgaaggggaaaccgactggaaagtcattgccattaatatggatgatcctgatgcaggcaattatactgatatcagtgatgtcaaacggctgaaacccggctacttagaggctactgtggactggtttagaaggtataaggttcctgatggaaaaccagaaaatgagtttgttttaatgcagaatttgaagataaggactttgcaattgatattattaaaagcactcatgaccattggaaagcattagtgactaagaaaatgaatggaaaaggaatcagctgcatgaacaaaactgtgtctgagagcctgttcaagtgtgatcctgatgctgccagagccattgtggatgctttaccaccaccctgtgaatctgcctgcacagtaccaacagacgtggatacgtggttcc

SEQ ID NO: 36781 - DNA, 1042 bp, Homo sapiens
ttctgggaatacaacttctgtttaattggcacaaatgttaaagcttataagtagctggaaattatgattatactactttatattttactatggtgaagtatttacttatttatttatcttttgagacaaggtcccgctctgtcgcccaggctgcagtgcagtggtgtgatctcagctcactgcaacctcggcctcctgggttcaagtgagtctcatgcctcagctacctaaatggctggggttacaggcacacgccgccatgcatggctaatttttgtatttttagtggagacgggtttgccatgttggccaggctggtctcaaactcctgacctcaagtgatccgcctgccttagcctcccaaagtgctgggattacaggcatgagccactgtgcccggtatactattgtgaagtatttagatctacttattttactgaaatatctcactaatggagctaataaagctattctttactgtgacttttgtttatctgatggacagaaattgagctagaattataaccaagtagactaaggataattttttaacaattcattgtaagctgtatcaaaatatatgtattgatcacataccataaaaataatcctaaggatttctttcaatttaggtttttgagacagggtcttgctctgtcacccaggctggaatggctcaatcatagctcactgcagcctcaaactcttaggctcaggcgatcctcctgcctctgcctcccaagtagttgggactatagtcatgcgccaccatgctcagctaacttttttatttttgtagagatggagtcttactgtgttacccaggctggtcttgaactcctggcctcagtgatccttccatcttaagcctcccaaagtgctaggattacaggcatgagtcactacacccagccaggatttctttctagagtttagaaccagtgattctctttttttgaagagaactttctagcttcctgagacttcagagacatggaaagtgttggtgttcacagaagtgctgtttagtgcccatgtaagg

SEQ ID NO: 36782 - DNA, 1133 bp, Homo sapiens
cttttgtttctttgaaatctgatcatacatcctatttagcatgatatctgagtgaaaaatgtggacggaattcaaaccccaaatattttacacaccttattccacaaaagagtgagattctattaaaaaaattgaaattcaaaggaaatttcactgtttggcactggtacattttcttgaaaatgccccttttcaagtaaggcacacccaaagagactttggctttcaaagtcatgttttgaaatgcattcatggacttttaaattgccttctgtttgttgcagttttttctggtgccagtttgttctagtttaaagtttgattccgtgaggctcaacttgtttgagctctgtataaattaggttctctgccagtagaatccagtttctgttaatagttcagcagaggaaaatctgaatgttatatctggttccctctttaaggcacaagatcacttttgtctcttaaacatacaatcttgttaagttactatactatatttctggtcttaggttaatttttaatgttgaattatattgttgtttactcagagtcaccaagctcacatgaaattagaaatgtaatgtattgtgaagacacagttgtttcttggaaaacatgctgtgtcttagcacctgactaactgtaaatcttactggcatcatgatataggaaaataaatactatctaagaatcacgagacctaggttcttttaggcaaaaggatacttggcacgattatgttgtagggtggttttgtgagttttaagtaagatgctgtgtgtgaaaacttagagtaaagcacaataaaaatcaaagtaatattatcagtgatttttttttttttttttgagatagagtctcactctgtcgaccaggctggagtgcagtggcgagatctcagctcactgcaacctccacctcccaggttcaagtgattctcctacctcagcctcctgagtaggtgggactacagatgtgcgccaccatgcctggctattttttgtattgttagtaaagacagggtgtcaccttgttggccaggctggtctcgaactcctgacctcaagtgatccacccaccttggcctcccaaagtgctgggattacaggtgtgagccaccgcccctggcc

SEQ ID NO: 36783 - DNA, 1059 bp, Homo sapiens
tcaaagtgatttcttttctttctgaacatatttagctctccagtttttgccattcatttggtacattgccttgaattgttaaatacatgcttaactccttgtatttaatctcctacaatatatagccttacatatcatagtaaagaaggaattattttgcaaatttatctaaaatttttaaacagataaaaattaagcctaatatatcgtttaagaagaatattcacttacttttccccgaacagatttcttggttctagacttaatatttttatgttatcttcattgtcagttttttgtttttttttttttttttgaaacagagtctcactctgttgcccaggctggagtacagtggcatgatcttggcttactgcaaactccgcctcctgggttcaagtgattctcgtgcctcagcctcccgagtagctgggattacaggaatgtgccaccatacccggctaatttttgtatttttagtagagacggggtttcaccatgtttgccaggctggtcttgaactcctgatctcaggtgatccgccccgcctcccagagtgctgagattacaggtgtgagccactgcacctggcccattggcaggtttttgtttgtttgtttgtttgagatggaatctcgctctgtcacccagactggagtgcagtggcgcaatcttggctcattgcaacattgacctcccaggttcaagtgattctcctgcctcagcctcccgtatagctgggactacaggcatgcaccaccatgcttggctaatttttgtatttatttatttatttatttatttatttatttatttatttgagacggagtcttgctctgtcgcccagactggagtgcagtggtgcgatctccgctcaccgcaatctctgcctcccgggttcatgccattctcctgcctcaggctcccaagtagctgggactacaggtgcccgccaccatacctggctaattttttgtatttttatttgagacggggtttcactgtgttagccaggatggtctcgatctcctgacctcatgatctgcccgcctcggcttc

SEQ ID NO: 36784 - DNA, 1051 bp, Homo sapiens
attcttatttttacaaatctaatgggtgtgtgatggtatctcattgtggtcttaacttttcatttctctgattaataacattgagcctctttcctgtgcttattggctgttcatatgttttcttttgtgaagtgtctgttcaaatattttgccatttaaaaaaattggtttctcttctaaaggttctttattctgggccggtcgcagtggctcatacctgtaatcttagcactttgggaggctgatatgggtcaatcacccgaggtcaggagttcgagaccagcctggccaacatagtgaaatcccatttctactaaaaatacaaaaaattagccaggcttggtggtgagcacctgtaatcctagctactcgtgaggctgagggaggagaatcacttaaacccgggaggtatgggtgcagtgagctgagattgtgccattgcactccagcctgggcaacaagagtgaaactctgtctcaaaaaaaaaaaaaaataagtaagtaaataaataaacgttctttattctggatataagttctttggcttggctttttgctttcctcattggcatcttttcctttccttttcctttttcctttcctttttgccttcccttccctcccctcccctctcctcttcccttcccctcccctcttcctccctccctccctccctccctccttccttccttccttccttccatccctccctccctccctcactccctccctccctccttctctcctctctctctctctctctctttctttttctctctctctctctctcctcctcttccctccctctccttccatctttctatctttcttgtctttcctcgctctgttgtccaggctggagtccagtggtgcgatctcagctcactgcaacctctgcctcccaggttcaagcgattctcgtgcctcagcctcccaagtagctgggattacaggtgtgcaccaccacacctgactgattttttttttttttgagacgaagtctcactctgttgcccaggctggagtgcagtggcgcaatcttggctcactgc

SEQ ID NO: 36785 - DNA, 1053 bp, Homo sapiens
gtctttctgagatttcttgttctgcttccctccctcattttatttggaccatctctgtttcatatctttagttcctttcttgctcaatgttaatttcaaccccagggttttttgttttgttttgagacagagtctcactctgtcgcccaggctggagtgcagtggcgtgatcttggctccctgcagcctctgcctcccaggttcaagcgattttcctgcctcagcctccccagtagctgggattacaggtgcacaccaccacgcccggctgatttttgtgtttttactggggatggggtttcaccatgttggccaggctagtatcaaactcctgacatcaagtgatctgcccgccttggcctcccaaagtattgggattacaggcctgagccactgcacctggccagttttttttgttttatcacggcttgctcctgtcctgcaagagtcctggctggtccattttcagagttcacagaggctcaactgtgggccccttcacttctgactgtgggctccttgtactcaccttgtattcaatattgggttggagaaaatccctcacagcgttagctgcagttctcaagttgactctgctgtacttgccagtgggtaacctattcgctatatggaaatttttttttgttctcatgtccattacttccttttggcccatccacataaatattgataaatattgataatgctgttgccatacatgtcttaaagcttttggtagtttgttcctaccttcttgaatgttcctagggataccttatcacttgtaaatgttttccatgggtttatggttttgccatttagttgctctgtttttatatggggaaatgaagattaaaaatctatgtggtggctgagcacagtggctcatgcctgtaatcccaacactttgggaggctgaggtgggaggatcgattgaggtcaggagctcaagaccagcctgaacctggaaggtcaaggcttcaatgagcagggtgattgcaccactgcactccagcctgggcaacagagtgagaccctttctcaaaaacaaca

SEQ ID NO: 36786 - DNA, 1054 bp, Homo sapiens
gagtgcaggtgtgatctctgctcactgcaacctccacctcctgggttcaagcgattctcctgcctcagcctcccaagtagctgggattacaggtgtgtgccaccacacacagctaatttttcgtatttttagtacagacggagtttcaccgtgttagccaggctggtctcgatctcctgactttgtgatcagcctgcctcagcctcccaaagtgctgggattacaggcgtgagccaccgcgcccggtcaaaacttatactgttaagtataattttattatacgtatattggaaatttttccatttcagtaatcagagactgtcctcatttttctttttttttctttttttgagacagggtcttgggctgtcacccaggccagagtgcagtggcacaatctcagctcaccacagccttgatttcccaggctcaagcgattttcctcctgcctcagtcccccaaatagttgggactacaggcgtgcgccaccacacccagcaaatttttgtagtttttatagagacagggttttgccatgttgctcaggctggacttgaactcctggactcaagtgattgcctgcctcagccttccaaagtgttgggattacaggcaggagccaccacacctggtctctcattcttttctaaataactgtcatttttttttttttttttagccagttctctatcaaagggcatttatttggactgcttccacatttttttttaagctaacttattccctgacagacttttcttcaactcagcatgacttcaactctccaactacacctgttaccttcagtgtgagtatttgtatgttctttttaaacatctgggtgcccacccagtgtttatttccttcactcattaaaatgacctcaccaatacgtgtacatttacatatttattatggcacctaggaaggacctaataagcacatggccagtaaatgaataaccccatcccagttttaatctgcgtttcttaagtatttacatactctttttgtatctggaaataaatacaagattcctgtttgtttgccattt

SEQ ID NO: 36787 - DNA, 1047 bp, Homo sapiens
ttgagggatctttaaatatcattaagtctttaagactcagagtcggccggcagctgcctgcgtgtctggctgaagccttcctgaactaggctggctctttcttgctcggtttggatgataccaagtaattcaaagtagcgtaacaggggagtgacttaagtctcctaagaattagaaagttgccttaattctcaaagcctcataagtaatggaggacgttaaatagcaaagagtataatttaaactgggctacaattaaatgtgtgtgtggctatgtaggaatgaagcgtgtttcttctcctcctgtactctccctctcttgactgcggaaatggaacatcctaaacagtctttctcttgccttggcttagctgtgctgtaggatgggacctgggcttctgtgttgaggtaacttctattgtgaggaagaagagggcgaaattgtgtggcatgatttttttgtatgaaaagtgaagggcctattcttaattttgaacaactgcctgctttctgatttacttttgatccggatttgttggattcctcactgtactgtgtaggttgagcttacaaaggtgtggattttgagcagtgcgattaccccctttcagatttggggttgctgttgtttttgtctttgggtttttataaggcggggagggtaaggggaaatgcctaggaaagaaaatcatgtgatgtatgtgaatgccgacatcgtcataggatcggactgaagcctttctccctctagcctctgaatggaaaccaactcagttcaaactaaatgcatcttgtgcatgggccagatcctcatctgccccgtttacttacataacacatactagtcaatcgaaaatagtgatcctctgccctctacctgccacacattcgtgattgaatatttaacccttgtttttatttggtctgaaaatcaaataagcagttgccacaaagggggaatttgtcttatgtcatccatgatgtgggtccgtaattacttaagcagcccctttatcttaatcctgaacattgaacacaaggaatcct

SEQ ID NO: 36788 - DNA, 1667 bp, Homo sapiens
aggtttttatggtgtaatgactgaaagtagcccatgaatatcatgtgattctgggtgtggcagtatttcatatggagtagtttgtataagggctataatcagagatcagatttagtcggttgagtgaaggctttgggtctaaactacatcttttctttttgagataggcctaaaaatattatgtttagaaaacagttgtttaaacttggcctcgtgaaatgtttttgttctccatttgtgaaccatgggcctcttcagccatgggaattatttgatagagcctgtgaacccattagtgaccaggcattccagttagatgatagatgtcacttgtgtatgcatgattatcttccaaaagcatgtggatgctgatgtaatgcaattaaaatacatttaaaggtgttgctgagttcatagtagccttctgatattaagatttttttttgtttttgttctgttttacttagggtagagacaggggtaggagtcttcagttattattatggaggaaagcctctctgaaatattttgatcaaagtaggtcttaatagttattacaacagattatgaaatactgctctagagaacttccctaatttttctgctttatactcttgccattagaatgctccttgttacaaaaaagaacataacataaaaaaggaatttaacagaggaaatggtgaggaggaggacagggaggagtgaggaggctactgacgctctcctaaattgtcctctccaccaagtagcattttggagcttcctgacatctgaagccatctttattcctttgtagcagggttaagaatatgggctgctgaggctacatcctgcatgatgccagggggtagagggagccatctgacgagatgggtgcactccgtgttgtataacatggcagttcttgttaggagggggaggcaagtgctactaaagcctctttaagccacatggtttggaagtgtcttatattttagcttctgcttatactccacctccacaaatatttgaacatattcaatgtgccaggtagattgaaggatagttttgatgctgtgctgcatttttccttttcgaggtagacctggacattctgtatgggaagcagcattaaccagtttcaagtgaaagggtgcttacctctgataccatttctcttttattcagtgccccttctgagaattatttgtaacccagatccttacggtaacctgttatgtgagttttgtggtcttcattttacagttgaaaagaattggagatcccaaagatgcaacagcttctgtaaagtcactcagattcctggtacctacaagggtcaatataggaggaacacacagcttctggctcctggttcaatggcctgagtatttattgtgtagcctctgagaaggaaacaaacataagaaaatggaaacatttttgtctagtatgctttgacagagggtaggcattcaatttttttttctctttctctttctttctttcttttttgagacagggtctagctctgttgtccatcctggagtgcagtggcacaatcttggctcactgcagcctccgcctcctgggctcaaacgctcctcccacttcagcctcccaagtagctggaactacaggtgcctgccagtgcacctggctaatttctgtattttttgcagaaa

SEQ ID NO: 36789 - DNA, 1023 bp, Homo sapiens
tgggcccagcttaagcaaataacatctgtggagcttctcctgaagtcttgtggttgtctaggtcagaaactttcgaagagttcctgtggtctggactctttctgcttgacttgtttatgttccctgccaatccccatccgtatttgaatttgggacctctgacctaggactctgttggtgtgcatatttgggaatacactgctgtcaacccatagcctttggtgtgggcatttgtgacagttagaaaatgtgaacagttttaaatgaggtacatgattcttgattgacttatctaatggatacactgaagtatttgtcataaaaaaaaatctattgcaaatatcatcagtatttttactttgaaaaccattttgaaataatgcatcagatttgatagtatcaggagtagtttgcatttcctagacatacactgattggacacacaattcttgtttacttagtattgtatattgattggcattggataccatgctaaaaatttaaattatgtagatattgaggcattggacagactaaaggcccaaataagctgaaaaacagtgaattaacttacaaataattgtggacatgttaagtaatttggcttataatagacaatcaaattgaactttccaccttggtttagtttacttctaaaaatgaaacgatgggttgggatacactgtttttaaatcttctagtttcccagctttattgacttgtaatcataggattattgcttttaaaaatactttgtaataattgttaacttttttgcccatgaattgtctgtattgagaatgagacattttggtttgtacattccctaggtccagattcggccttggaatctcagtgacagtgactttgtgatggatggttcacagccacttgacccacgaaaaactatatttgttggtggtgttcctcgaccattacgagctggtatgattaaacaaacgacaaactctctaccctatagcgcaagaaatatgaagatcttcaggataaatttttcctaag

SEQ ID NO: 36790 - DNA, 1040 bp, Homo sapiens
cataaatctagcaagtggcagagctggaatttgacgccgacagtctggttccagagactgtgtccttaattcccatactatactcacaattattaaggaagatgcttaaaaactcatggaaacaatgtcaaattaaaaatcgtaagtgaaaacaatgtgtatgatactatagtaaaaacatggaggatttaaaatagtctttataagttatttatagtgaaagccatctggcaatatcagataatgttcaaatgattaattatttctgtgtttcatccatgtcagtgccaatgcatagccttaaggatgtattattaggctaagggtaaggttataaagtttgcacttctcggcatggcgctgtgatagatatctgttgattgtagttctcaacacccctttctgctttttagaaatgcttccttccttccaagaaatgcttttgcccaattcaaccatggggtttgcattggggttgtcatcttataagtctcctttcccttgtcagatgtgagcactggactctacttgggccgatcagagcctttcctcagaagttttgaacttaggactggagagagcaaatctcatgttcttctttggtgtggtggagaagcttatcttagcaatacttctgctgaaaacaactaacatcttggtcaaaataaaaaaacaggtgtttgaaacaataagctaccactatgcacatattagaatggctaaaacctaaaacactgatactaatgtggggcaacagaaactctcattcattgctggtgggaatacaaaatggtacgaacactttggaatacagtttggcagtctcttacaaaactaaacatactcttagcatacaattcagcagttgtcctctctggtacttacccaaatgagttgaaaaattattttcaaataaaaacctgcacaaatatttaaagtagctttattcataattccccaaatttggaagcaaccaagatgtcttcaagagatgaacggataaacaaaatgtggtgcatccagacgatgggacagtattc

SEQ ID NO: 36791 - DNA, 1034 bp, Homo sapiens
gaagacttacgttgaagtcaggcatctgtatcctgttgtgtagcagtggtgagctgcattcagttagagtagaaccatgagtgtgaccaatttttcctttgtggttaaaggtaagaaatcaaaagtagtgaatccattttttaaaaaggggggaacaaagggctgttgtccagaaagtgaaaagtcattaaattagaccatgtgtcaaacctgcacttaattacacaaagttcaaagttactaagtttttctttagcagctgttaatttgtaaaatagttttatagactttggtatatggcatctccgagttgattcttatacatggatggtaaaacttcatccaaatatgtctaaaattctagtttagtgttgttcattttttgcaggctgatatcaccatctcaaatagaaatcagaagatttttttttaactgtaataacatcacccatcctaagatactgcttaagaaatccatgcccatagttgatcttgaggactggaatatgagcaatggttgtaatgttacatccgtgtttttgttttttgttgttgtttgtttggtttttgagatggagtctcgctctgttgcccaggctggagtgcagtggcacgatctcagctcactgcaacctctgcctcccgggttcaagtgattctcctgcctcaacctcccaagtagctgggattgcaggtgcgtgccaccatgcgcctgttgtatttttagtagagacggggtttcaccacgttagccaggatggtctcgatctcctgacctcatgatccgcccacctcagcctcccaaagtgctgggattacaggtgtgagccaccgcgcctggcacatgggtgttttaaagttagtagaatagtgggatctgcatgggaggggagaacatggcagtgggaaaggcaggaggccttgattctccatgtcttcctgatgctaggcaggcccaacgtctccatgcagaactatcctggaacagggaagcatatgcaacacaaatccattgctgagtggaaatagaatga

SEQ ID NO: 36792 - DNA, 1016 bp, Homo sapiens
caagggatcttccctcctcgacctcccaaagtgctgggaacataggtgtgagctgccgcacccatcctaaaacttttcgtacctttattttctccagagtaattctaggtatccaacaagtaaatattaaaatactatgtacttataaagagaaatatgtaggaaactattgaaatttagttaagatcaattgagatttatagacaaacttagctttgaatttagatggcctttttgccatttatagcaaaattatctttataaataggaagagtatgtacatatttactcaaaaatttaaggtgactgtaaagtttctaaatacgtagtgacattgtaagccttacacgaacttgcctttttgactctttgcagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggtaacattaattattgttttttggtttaatgtataaatagatcatcatgttaggctgctatctttaaaccttcacttagtgattttacaacttttttttttgcaatggaattcttttgaccaaaaaaaaaaaaaggaagaaaagagtaaaaagacctgttatatcccccattgctcgcccttaacacagatatctagggttcatattaacctgacaatgggagtcatccctcttagttgtagataccaatccctttctcctggcagcttgccttctgttctccgatagcaccaccacctccactacgacatccacaacccctccgtgcatttttctgtctctgaacagaaacagcattatgcaaaaacaaattgccaagaatcaggggtaggttggttccttctgagttataggcccagtaagtaaagtcctgtaggtaggagctcagatgggaagggtgctggtggc

SEQ ID NO: 36793 - DNA, 1025 bp, Homo sapiens
atcccagcactttgggaggccaaggtgggtggatcgcctgaggtcaggagctcgagaccagcctggccgacatggtaaaaccccgtctctacaaaaaaaagtacaaaaaattagctgggcgtggtggtgcatgtctgtaattccagctacttgtgtggcagagacaggagaaccgcttgaacctgggaggcagaggttgcagtgagccgagatcatgccactgcactccagcctgggcaacaagcacgaaactccacctaaaaaaaaaaaaaagaaaaaatatgtaaaatatgcaagtgcatcaaacataaactcttcataaacccttcttgggtggtcaaaagataataccaaatagagttaaaaaaaataagccataatataaggtgattcctcagacagtgaaacatgaatcaccgtgtgacccagcagttccacttctgggaatatacctgaaagaaatgaaagcaagaactcgaacagatccttgtacactcatgtacatagcagcattattcacagtagccaaaagttggaagcaacccaggtgtccgtcagcagatgagtggatgaacaaatgtgctcccgccatacagtggaatcccatacaatgaaatagcattcagccttcaaaaggaaggagattctgatgcatgctacaacatggttgatcatgaagacattatgttgagtaaaataagctagtcacaaaaggacaaatattgtgtgatttcatttatatgaggtacctagagtagtcaaattcagagacagaaagtagaggggaagttgccaggggctgggggaagagggaatggggagttagtgtttaatggggacaaagttttagttggggaagatgaaaatgttctagacatggatagtggtgatgaccacacaataatgtgaatgtacttaatgccacagaattgtatacttaaaaatggttaaaatggctgggggtggtggcacatgcctgtaatcccagcactttgggaggccaaggtgggaggatcacttgaggt

SEQ ID NO: 36794 - DNA, 1052 bp, Homo sapiens
agtaaagtgtttcattttctctctccctatcaagaaaacagtcttcttccagcctgccttctcagacattactcgtgcctttggaggtactggtaggatgttacctccttctcaccctggagctcatggccctgtagaacacatggcaggcagcaccggcctggcctctgataagtgacaggctgttccgccatctaccctgcctgagttgacagacaccaacgttaagagtagaggagacaaagtgtggtctctgcagaaatcaaggggagaccatggcggtgtgaactttatatctgatatgtttttaaaatagctcatctgtggagtccaaaagaaagcaatgagttttaattttttgtcacctgttaaaaaaaaaataggctcacaagattagttaaccaaaaacgttagttagcataattgtattacacttgaaagaaaagtgcttctcttttttatcacttaaaattgcttttgacaacacatattcttctactattgttatatggaacaaaggatcttgaaatctgcagccaagtggtgtttattgcaattaaaatttcttttaaaagaagagagaattgcttgggctttatagtttttggatgataagacttagtatttttatacagttaagatatcattttttaaatggcagcacttcatttttgctttcagtgtgtatattaatattttgagaaatatttttaagcaaatatgccccaaacatttagcccaatatgcattcccctgtattcatagcttcctacacacagctcccctccttctcacgaatacaaagtctgtatgtttatttatttattttaaccaactcacttcaaagaatacatgtctacttttttggagttatagtcaagatacgtgtgaagaatcccattgtttatggatctgcttgctttttctctagattcccctacttgtggagtgatagtgaatgttgttttgtagactcttcattctgaatcatgctcttttatatttcccttttatttcttcaaataatgttgcaccagagtttcctgacatgc

SEQ ID NO: 36795 - DNA, 1027 bp, Homo sapiens
ctctagtccaccctaaggctgcttagagctaccttcagaccaggggcctaaagaaagttctcagactgagaaatcagagggcctggcagttagagtgctcttcacagaaaaaaaacagaaattagtatgtttaattttcatcatctaaactgaatgcaaacagcgcttggcaattaaaatgaagctctccaatgaagtatacttcatcagctgctgtcaagtcatccattgatactgttttgcggtttttaaattccttttgtcactgtgactgctcatcagcaggcaaggaagagcaggcaacaaaagttgaaaagtgcatgaaggaaaactttgaggaatatgatattcacattccagcaaattgggggaaaactgctattatctggtttaacacaggagtgccttggtgccctgcctgaggctaatgtgttctgtaggggtggctgcacagccacagtcctgaaacatgggaaagcatctcctgagtccagggaccagcacgtttgtcactaacctaaaaggaggctatggagcccaccccggtgttcctactgagccctgatttccagatttgctgaaatcgaggttgcggctccagcttctgccctgggtttggtttgttgttgtcgtcgttgtttttgagacaggatattgccctgtccctcaggctggagtgcagttgctgtgatcatggctcactgcagcctcaacttccctgagctcaggtgatcctcctacctcagcttccccagtagctgggactacaggcgtgcgccaccacacccagctgatttttgtatattttgtagaaacagggttttggtatgttgcccaattagtctagaactcctgggctcaaatgatccacccaccccgaatgctaggtatacagttgtgaaccaccatgtccggccctgggtttgcttttgattgtggtcttttctgttttgaattgccttactcctcttagagttcagccagtccagacggacaaatccatttctagtgatttggttattttaaa

SEQ ID NO: 36796 - DNA, 1072 bp, Homo sapiens
aaaaaaaaaaaaaaaaaaatatatatatatatatatatatatatatatatatatatatatatatctccaataagttacatcttataggctcctcccaacctgtgtccctgcctcccctgcagatttaaccactatgctgaatttcatgctcttgcattttatatttgtgtatgtatctttagtttgtcttaggaactttttagacaagggtgtcacactgtcataagatgtatagtcttctagtacttgttctttttattcagtgtcagaactaagattcatctacattattgtgtgtacctatagtccattcattgttgttgttgtataatagtgcattgtatgaatgcaccacagtttcccgtctcctatgtgaacaagtgataatgaaaacattctttattaacatttttgagaagcagcaaatgtgttgctttgagagatatttatagctttaaatgtttatattatgaagaatagctgaaaatcaatgcactaaatgtcccaacttaaaaaaaaaaaagcacaaaagaataaacatcagaaaagaaggaaggaaggagatgaagatcagaaatcaataaaataaataacagaaagagtagaggatcaacaaagtgaaatcttggttctttgaaaatagaaacaaaatagacagttgtctggtgagattaatcaaaacaaaaagagaaagagaaaagtacaaataatatgaatgaaaaagaggtataactgtaggttcagcagtgattaaaaataataccaacattataccaacagatttgaaaacaagcaaaatagacaaatttctggaaaaaatattagcaaagctgaaaaattagaaagtcagaataggccagatagtcattaaggaagctgaagcagcatttaatcttcctcctacaaagaaaacacaagaaacaggtagttttacaggtaagtttctcccaactgtcaagaaacagattattccaatttcaaacaaactctcctggaagataaaaaagagaatactccccatcatccaccaaggtttgaataactttaattccaagatcagacttgggccttt

SEQ ID NO: 36797 - DNA, 1040 bp, Homo sapiens
caggcacggtggctcacccctacaatctcagcactttgggaggccgaggtgggcagatcacaaggtcaggagatcgagaccatcctgggcaacatggtgaaaccctgtctctactaaaaatacacaaattagctaggtgtgatggcacactcctgtagtcccagctactcgggaggctgaggcaggagaatggcttgaacgtgggaggcagagattacagcaagccaaggtcgtgccactgcactccagcctggcgacagagcaagcgagactccacctcaaaaacaaaacaaaacaaaaacaatttggtatgtttttgcagtggctggtaccggtttttcctttccatatttagtgcttccttcaggagctcttgtaaggcaggcctggtgatgacaaaatctctcagcatttgcctgtctgtaaaggattttatttctccttcacttatgaagcatagtctggctggatatgaaattctgggttgaaaattattttcttttcttttttttttttttattgatcattctggggtgtttctcgcagagggggatttggcagggtcataggacaatagtggagggaaggtcagcagataaacaagtgaacaaaggtctctggttctcctaggcagaggaccctgtggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtttcccatgtctacttctttctacacagacacggcaaccatccgatttctcaatcttttccccacctttccccgctttctattccacaaaaccaccattgtcatcatggcccgttctcaatgagctgttgggtacacctcccagatggggtggtggcc

SEQ ID NO: 36798 - DNA, 1012 bp, Homo sapiens
tcatggatagtttctgaattttagaggaatcaaatagggacaaaaaaatgtttccacctttgttcacaaagtataccaaattactgtaaactaataagtagcttaagagaaagaaaaggtttccttaaagctagaaaacaaaatatttaaataaagaacctggctaggcatggtggctcatgcctgtaatcccagcactttgggaggccgaggtgagcagatcacctgaggtcaggggttcgagaccagcctggccaacatggtgaaacactgtctttactaaaaatacaaaaattagccagcatggtggtgggcacctgtaatccctgctactccagaggctgaggttgcagtgagctgagattgtgccactgcactccagcctgagcaacagagcaagactccacctcaaaaaaaaaagaaccaataatgtttcaaataaaagtcataaaaacgttatcttcaagaccaggtgctgtggctcatgcctgtaatcccagcactttgggaggctgaggcgagctgatcacttgaggacaggaatttgagaccagcctggccaacatggtgaaaccctgtctctactaaaaatacaaaaaatgagctgggtgtagtggcgcacattcgtaaccccagctactatggaggctgagaaaggagaatcgcttgaacccggaggcagaagttgtagtgagccaagatcgtgccactgcactccagcctgggtgacagagtgagactgtcttttttttttttttttttttaaagaaaaagagctaacttgactttaaagagatgaaatgtacatgtaaaataaaattttgttttctgtgaaattttacttcagaaaatatcctgactaaaataaattaaaaaatgagtactcctaaaaaaaaaaaaagaaaagaaaagaaagaaagaaagtaagaaagccaagagcacagaatcaggatatactggaggaaaacaacttttctaggccttcaagatagaacatttcagtgtcaggccg

SEQ ID NO: 36799 - DNA, 1048 bp, Homo sapiens
ctaacccctctgaactctagtttccccatctgtatgatggattgataatgcctaccttatcaggtcattgtgaaaattaaagatatgtgaaaatactcaacatgttcttagcacatagattctttcacatttgcttcacttcttatttagtttttgttgtaggttatcctgtgtatttgaccttccaaacaaaggttgcttttgactttatgacttaaggttggaatatctcctactactcccctgtcctccttggaccagaaaaaaaaaaaatcccactgtgatcctagtcatgcgtatgtggcatttggagaatttaagaaggtatagaaattgacagctttggcaatactattgcttatgttacacaagatgtgtaacttatcagtgaggtgaaatggtaaagtaatgcttatccttaaaagctaagacttaagtcatctcagataaagctaatactcccatcttgacctcttttcttcacacaatccttcaacaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttg

SEQ ID NO: 36800 - DNA, 1134 bp, Homo sapiens
atagctcattgcagccatgacctcttgaactcaagtgatcctcctgcctcagcctcctaagtagctaggactacaggcacatgctatcacgcctggataatttttttatttttatttttgtagagatgggggtctcactatgtttccggggctggtcttgtttcctggcctcaaatgatcctcccacctcagcctcccagagttctgagatcacaggcatgaatgactatgcccagcccacattatttaaaaaaaaaaagagagaaagaattatttggggaaaataggtattctcaagattcagcactattcttgagttgaaagagatataattacaggtagttaaaggaggggagaaaaaaacaaaactctagaaaaacaaaaaaacttcacaagaaaggaatgattttcttagtatactatatggatttactaaaagtagttagtaaacgtattagtaaatacttttaacagaatcctgacactgtaaacactatgtagttataacatttagaatcaatttatatacaaagcataggagacaattttattagccttgacgatgtaaaacggaaagtatagaagataaagtttgggagatgaaaagggacaggacctctgaaaatagcagggctggtgtaacatccttatcttccaaaatggggagtcaagagatactgtctatagatgatggaaatacacttcttttaggaagagaagaggtgggggattggcctaagtaaattcttatctagcatagcagaaagcaatagataatgtctacagttgataaatcaagaaatcataataaaagcctatttctttagagatgtttatggtgacttctagaagaatgagttaaaaattattctaggatactggagaacacaagtagtggtggagagtggagtcagtagaagactttctttttatcaaaaatctagcacaaggccaggcgcagcggctcacgcctataatcccaacactttgggagaccgatgcaggtggatcacctgaggtcaggtgttcaagaccagcctcaccattatggtgcaaccctgtctctactaaaaatacaaaaattagccaggcctggtggcaggcacctataatcccagctacttgggaggctga

SEQ ID NO: 36801 - DNA, 1034 bp, Homo sapiens
tcatagtgacaatgtgtagtaattatttttaatgtgtcctaaacttgtctttgtcaaatgtgaaagactttttcctcattctagcagttgctaatccaacaaacccatttctaccctgtccacaggttttgtgattctgtgggcttccatggtattccttcttaactgtcttttttaggacaaatgttgtacattcagggtgaattgtggctcatgttctttgaagcatagttgtgatgattaactccctcttcctcttctccacacagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcaggtacattttttcctgcccaatttcaggcctagagcacctctctttgctctaggcccgaacccttcccataggattttagcttaaaacacaactgtttgagcattctgtaaaggtgaattgaaaactgtacaaaaattttaactggggaaggcatttattatcaatccattttactatctctgcagtcagataaaagccagtggcagacttgggacgaattggttgagcatctgcagtttctgctgtccagttatcaacatgttttaagaggtaaggagcatttgttcacaagtggagtagtggaaggtctcaatggacatttgtattagtcataactacacaggatattctgatttgttgacattgttccttggttgtatgtaacttattataagggataagaaatgacatagccggagtcaccactgtgaaaagaattcacatattcttgttatggccgacaatacatggtcctcatagttgtaagattgtgtaggtaagcagaagtcatcagaacctccagcctggccaacatggtgaaaccctgtctctactaaaaatacaaaaattagccaggcgtggtggtgtatgcctgtactcccagctac

SEQ ID NO: 36802 - DNA, 1026 bp, Homo sapiens
atttgtataatcctttagatgcctctgcataccgatttaaaatgcatcccgttgtttttgtggcgttttcgatcctttcttttctaatgtgtcccataaataaacagttttatttaaagtttcctcatcgtggccattttaattctaagttgttcctagtaaggttaacctgtttttctaaaaacaagttctgggtccataattttggtttttttttttttttttttttgagacagagtcttactctgtcaccacccaggctgtagcgcaatggcacgatctcagctcactgcaacctccgcctcccaggttcaagcaattctcctgcctcagcctctcagcctcccgagtagctgcgatcgatcacaggtgtgcaccaccgcccagctaatttttgtatttttagtagggaggggtttcgccacattggccaggcaggtgaggtgatttgcccgcctcggcctcccaaagtgttgggattacaggtgtgagccatcacacccggacttgttttgttttttgagatagagtgttgttttgtcgcccaggctggagtgcagtggcgtgatctcggcttactgcaacctctgcctccagggcacaagagattttgccacctcagcctcctgagtagctgggactacaggcatacaccaccacacgcccaactaacttctgtattttttgtagagatggggttttgccatgttgcccaggctggtctcaaacttgtgagctcaagagatcttcctgcctcagcctcccaaagtgctgggattacaggcatcagccaccacacccagccccataattcttacatataaaattagatggagtcccagactccttggattgaaacaaacccgttatcaaaaggataacctacccaatgcctctaactggatccatccagtttattatgggatgcagtccaatccaggacccagtccagtaaaaattgctcagataaacttggagagctcaaaacacaaatttatggagctcagaatcctaggaagaactcac

SEQ ID NO: 36803 - DNA, 1054 bp, Homo sapiens
gttttgttctctattaaatccccagggtgcttaggatgtgacatgttctcaataagtagttaacctaatgaatgggcttcgcgaatgaatttgttccattgccttaggcaagtttctttttattctttcatgccagaggaaaatggcactaccatttcttgaataaatgtgaggctacagccacacagttagatagtccctaaggcaaggagtgttatacccattttatagataggcaggcagagaaagatgaattgcttgcttttcttttgggaacctggattcttttaatagttgttgaagcctccagggggccaggcggatcacttgaggcccagcctggccaacatagcgaaaccctgcctctactaaaaccacaaaaatcagccgggtatggtggcacacgcttataatcccagctatttgggacgctgaggtgggatatagcttgaacccgggaaggagactgcagtcagggaagcctagggaagcctcagaccaaggatgattgaataacaaagaaaaggtgtaagtaaagatctccaactcttagggagtactaattaggaaagttaagggtagaaaaagataaattaaggaaaataccgttgagatgctaatgggttaatttcagagaaaaaagactgagtagagggggtatggggaatgtgtgctggggagggagtgtgacgaaggtcgtaaagagacccttgctcaacgtcagttgagcgttctgactgtggggaggtcgaaaactcggaagggcctgagggaaggaatgggcagtaccacgttctgacacctaggtcagtatggcgggggaagagtaaagaagacaaggaccgagaccctgccatgtcagtacctttctcttacggaggggcaccgccctgttggggtccacagccaaccccatctcggccaggttctgccgtaccgatttagcgtggtcccaggcatgtcggatgtgggagctaccggcaaagagagacatcgcggatccgtcatctcgcggaccgtcccggccgaggcccacggccacccggaaccccag

SEQ ID NO: 36804 - DNA, 1023 bp, Homo sapiens
cctcagattgggttcagatccttctcagaccagcaggccggccccctcccccccagactccaactgccctgattcccccggcccccaagcctctgttggaccctagccttccagccatcgctgcgggcagacccgcctcgtctgtgcctctgtgccctcagcgtgtcagcttccctggtttgccttagcggcgtcagtcctcagccatccttcccagcccggttatcggtcggaccctctccgcccaacgagtctatatctgccggagaagcttagtccccaccgcggagttggcgtcatttcgggtctctgacaggaaaacctcctgccagcatcccatgccatttccacatacactcccacaaactggggcctcttggataccaggtttcgtgttgggggttccggtcggggagggggcacctacacacagatctggtccccgccctagaggtgtgggaggacaccaagtgaggaaacaatgcaagatgataagtgtcatcagtggtctgtcgggatttattacttttggcttattcctggattcctgtgcttaactatgcttgaggagggtggtaacttgcagaaatgttatgttaatacaagatgttgtattaagaacatttgccactgatcacttacccctgagctggagaatggttggaggataccactagggtgggtaaccttggcactttgttaccagtttccttatctctgaaaggactgtcttaaaaatgtctacccccaggccaggagcggtggctcacgcctgtaatcccagcactttgggaggccaaggccagcgaatcacgaggtcaggagttcgagaccactctggccaatatggtgaaaccccgtctctactaaaaatacaaatattagccgggcgtggtggtgcacgcctgtggtcccagctactcgggaggctaaggcaggagactcgcttgaacccgggaggcggaggttgcagtgagccgagatcgtgccactgcactccagcctgggcaacaagagtgaaac

SEQ ID NO: 36805 - DNA, 1174 bp, Homo sapiens
tacctctcttccagaaatgctgatagccaaacattattttattgctgagcagagaattggtagcaaagctaatggaatgtctccagccaaaactgcaatattctttctctctgaacaaagctggcattgcaaaacttaggttggcactgaaatggcaatgaatattggcttgagacatacttagcatttgacttatgttgaatccagcccttccagtgtaaattggaatagtcctttcgaaatgcattttggcactgtgggtcaagaactttaaaaataatgtatattctttggctccaagttttacctagatccagaagaaatcctaaatagaggcaaactttataaatagtagtgttcatcatagtgctattttaatagtgaaaattggaagcagccgtaacatctatatgtaaattgttgtagccagttagagtattgtataaccatggttatgaagagtgtattaagtttatgaagagtttgaagggagtatttcgtaaaataatgtgcaaaattataaatatctgaaagagaggagtctcacacaggtaagagaaaatagagaaggctcctcaaaccttgacttgtatgtagtgatgtgagagggtggggtggaaaagttggttttccagccaggagagaaaacaccagaagattcctgtaaagatcaaaggcagagatgaatggattttcctcagcatgcatacagtctagaatggagaagaaaagaccattagacagtttcccctataataattttatttaattgtaaaagaggttgaatcaagccctaaacctttccttggagtgtggggaactagaaggaaatttgtaaatgtaaaccagttgtattactaatggttggaaccaccacagggtagcctctcacgctaccccatttctaatctttctctaatatttaaactttaccagccgggtgcggtgactcacgcctataatcccagcactttgggaggccgaggcgggcggatcacctgaggtcgggagttcgagaccagcctgaccaacatggagaaacccggtgtgcactaaaaatgcaaaattagcggggcgtggtggcgcatgcctgtaatgccagctacgcgggaggctgaggcaggagaatcacttgaacccgggaggtggaggttgtggtgagccaagatcgcgc

SEQ ID NO: 36806 - DNA, 1033 bp, Homo sapiens
aaaatcccaggaaaacagaaaggagaaggaggggcaagtaggacaaccagaaaatgacctctgttctagagcactgtccagtagaactctctgtgatgatagaaacgttctgtatctccgctgttcagtatgaaagccattaaacacgtggctgttgagcacttgaaatgtggctagcattactaaggaactgaattttaattgtatgtaatagatttaaattcagaatagccacatttgactagtggctacagtacttagacggtgccattctagagagtctgggtgcatagcctgacacatgatctttttggatactgtgtcttcccttccaaacccttctagccctaaattgttctacaaaaaatactcaggatttatgtaggccagtgttggaatttataatcccagtagtttgcattcttcctgaacaggcaatagaataacacttgctgctttatggcttttgaaccagactctactctcggatttgatggtccactcacagactgttcacctccctttgttgccgtgcctctggctctgttacaggaatctgtacaaattggcccactcgatatgcactgtagtaagctggattcatgtgatatttattccttcctccccaggtttgctcttcgttttatacggcctgaccctcgcagccgggtcactgaccccgttggggacattgtttcatttatgcactcttttgaagagaaatatgggagggcacaccctgtcttctaccagggaacgtacagccaggtcagtgccataaaccatatagatgccaacttaccgaaatgattctatcctcaaaggagagcacagcccagcactgatcatgtccttcttgtactcaaaaaccttaattagctcttcactgcttataggggtgggtaataaaaaagaccaaaccttttagctggcccctctttgatctaatgctgcccttcttttgaggtcttttctgcataacttattttaccataccctcagttccagctgactcattccctgaacatagtct

SEQ ID NO: 36807 - DNA, 1041 bp, Homo sapiens
attacaggtaaagaaatggcggctcagagggaaggagagacttgcctaacttcagggcaagctaacgcttgatttcaacttgataaatttctgagtatgcagtgggtgcacatagcagagacaggtaatgagaagttttcttttttccttttctttttttgtggggggtggggacagagtctcactctgtcacccaggcaggagtgtagtggtgcaatctcggctcactgcaatctccccccaccccacctccaggttcaagcgattcttgtgcctcagcctcctgagcagctggcactacaggtgcacgccaccacgctgggctaagttttgtatttttagtagagatggggtttcaccatgttctacgtttcaccatgttggccaggctggtcttggactcctggcctgaagtgatctgcctgcctcagtgtcccaaaagtgttgggattacaggcgtgagccaccgcactcggccgagaagtttttctgattaaaaaaaattttaaggcacacacttcagacagtggctgtgaaggaaccctgatgtgtatctaaactgtcgcctcgtgcacatcaccccattacttactctgtgctaagtgctgtcatgcattacatcattactccttagaacaggcctatgaggtggagtctgcattaggcccattttggacaaggacaccaatagtgtgggaggtggtgtaccttgcccaagcccccagcaggtaagtggtggtggggattaggacccaggtcacttgagtccatatcctgggctcttagtcccactctgcctggctgcctgctgctccgtgaagccaaccctggacctagacctggacctggatcgtcatagcccagatccctgtgtgcttcccaggctgccttgtggcaggtggatggtgcccctcgagatgggcagggcaccatctggccacacgtgcctcatcgtgatgggtccaaaggtctgggcaggccaggacacacctctgtcaaccagagcagtgactcagagctgtcggcctcagccgtaagggc

SEQ ID NO: 36808 - DNA, 1003 bp, Homo sapiens
ttatattaaatccccactcccacctcctgccctaggcaaccagtgacctgttttctgtcttgggtagtcttttgagtttggcttctctcagcatgtttttgaagttcagccaagtcatggtgtgtattagtacttcattcctttttattgctaaatagaattccattgaatgaatataacacattctattaatccattcattagttctagacatttggattgtttccagtttggagtttttgtgaatagtgctgctgcgaacattcatgcccaagtttttgtgtgaacatacatttcatttcttgagtatatccctaagagtggaattgctgggtcatatcgtaactctgacattttggagaactgccaaactgttttccaaaatggcttcaccttttatatttctgccatcagtgtatgagggtttcgctttttctataaccttgacaacacttgtcttttttgattataggcattctagtgggcatgtagtgatatctcattgtggtttcctaaagactgataatactgagcaacttttcaggggctgactacccatttgtagatctttggtgaaatatctattcacatcatttgcctattttgtaattgggctgtttgtcttctactgagttgtaagagttatctgtgtattctgggtacaagtcttttattatagatatgatttccaggtatttccccctgactgtgacttgttttttcattttctaaacagtgccttttgaagcacaaaagttttaagttttgatgagattaaatttatcattttttatcctatgtattgtgctttagtgtcatatctaagaactctttatcttaacccaagatttgagaaattttctcttgtagatcttccttattattattattatttttttttttgagatgcagtctcaccctgtcacccaggctggagtgcagtggcatgatctcagctcactgcaaccttcgtctccctggttctcctggaggaggtcaagcg

SEQ ID NO: 36809 - DNA, 1314 bp, Homo sapiens
gattgatgcctattctggacatttcatgtaaatagaattgtataaatatgtggcatttttgtgactggcttctttcgcttagtgtaattttttttttttttttttttggtttttttttgagacgacattttgctcttgttgcccaggctggagtgcaatggcatgatctaggctcactgcaccctctgcctgtagagttcaagcgattctcttttttctgttttattttgttttgagacagagtctcgctctgtcgcccaggctggagtgcagtggcgcgatctcggctcactgcatgctccgcctcctgggttcacgccattctcctgcctcagcctcccgagtagctgggattacaggcatgcgccccacagccagctaattttgtatttttagtagagacagggtttctccatgttggcaaggctagtctcaaactctcaacctcaggtgatctgccgccttggcctcccaaagtgctgggattacaggcatgagccactgcgcctggacacttagtgtaatgtttgcaggatcatttggctggatatagaattcttagttgacatttttattctttttcaccactttgaatatgtcattccagtgccttctggccttaattgttttcaaataagaagttgtcattaattgaattatttcactgtacatgatgagtcatttttctctctctctcaccgctttcaggattttctgtctttgcctttcaacagtttgtgatgtgtctaggtgtagctctcttcacatttttcctagtttgggttccttgagattttggaatgtgtagattaatgtttttcatcaaatatgggaggtttttggacattttcttcaaatatttttttctactctctctctcttctctcttcttctgaggctctccttacacatatgttagtatgcttgaagtttttccataatctctgaagctttgttcattattcttcaatgttatttctctttgttcttcagatcagctatttctattgctgtatcttcaagttcactgattcttctgccattttgaacttgctgttgagctcctccagcaaatttattgtattataatttcaactccagaatttccatttgtttgttttattagtagcagatcatcagtacccttacatttgctttcttcatgccttttcttttttcttttttttttttttttttttttttttgagatggattttcactcttgttgcccaggagtgcaatggcacaatctcagctcactgcaacctctgcctccagatccaagcaattctcctgcctcagcctcccgagtaa

SEQ ID NO: 36810 - DNA, 1071 bp, Homo sapiens
atgatctctgctcactgcaagctccgcctcctgggttcacgccgttctcctgcctcagcctcctgagtggctgggactacaggcacccgccaccacacatggctaattttttgtatttttagtagagatggggtttcaccatgttagccaggatggtctcgatctcctgacctcgtgatccacccacctcgaccttccaaagtgctaggattacaggcgtgagccaccgcacctggcccagttgatgaatttatacagagctcaattgtagattctaaggtcacatgtaggcctaaggaatagcaagtcatttttgagacagggtctcactccctcaccaaggctggagcatagcagtgcaatcctggctcattgtagcctcgagctcccaaactcaggtgatcctcccacgtcagccacttgagtagcagggataacaagtgtgcaccaccatacccagctaattttttgtagttttttatagagatggggtttcaccatgttgtctaagctggtctcgaactcctggctcaaatgatcctcccacctcagcctcctgaatagctgggactacaagtgcatgcaggctaccacacctggcttaaatttcctttctttcttttttttttttttaattttgagacaaggtcttgcagtgtcacccaggatggaggctgaagtgcagtggtgtgatcacagctcacttcactgcagccttgacctcctgggctcaagttcaaacgatcctcccacctcagcctaccaagtagctgggactgtaggtgtgcaccacgacactcagctaatcttttttggttttttgtaaagacagggtcccactatgttgcccaggctggttcttgaactcctgggctcaagcggtccttccacctcagcctcccaaagtgctgggattataggcatgaaccatcacacccaacccttaaatttgttaagtttattaattatcttgctgtcccacaaaagttctctgtgttcctacttcatcgaccctgtgaaaagcagccctgtgcttcatactctagatggcatctctcagcctctgcccca

SEQ ID NO: 36811 - DNA, 2010 bp, Homo sapiens
cctctgaccctcttttttttcttcttttttcttcttcttcttgtgtgtgtgtgtgtgtgtgtgtgtgtgtgtgtgtgtgtccgagttttgctgttgctcaggctggagtgcaatggcacaatctcggctcactgcaacctctgcctcccaggttcaagtgattgtcctgcctctgtctcccaagtagcagggattacaggcatgcttcaccacacccggctagttttgtatttttagtagagatggggttttaccatgttggccaggctggtctcaaactcctgacctcagatgatccacccaccttggcctcccaaagtgctaagattacaggcattaccaatcgtgcctggccacctctgaccctcttttaaaagttctgggccaattttgtttatagagtcatttctcttggtttttcagagcatagctaagacaggcaaggtctttcacaaaaatttaccatttaaaagaaaaatgcagaaataaaaagagatcattaggggcagaaatacagcccttctgcctaaaagggctgacataggtaagctttagattttgtggattaaggagagacatcttaaaagctccccaccaagaacctcttccagggcatcgacttttttttttttaagacaggggcttgctctgttatccaggctggagtacagtggcactaacatggcttgccatagccttgacctcctgagctcaagcaatccttctgtctctgtctcagccttagcctcccatgaagctggaaccacaggcatgtgccaccacccccggctagtttttggtttgttggtgtgtttgtttctatgtagagacagagtctcaccatcttgcccaggctggtctcaaactcctgggctcaacccatcctcccacctcagcctcccaaaatgctgggattacaggtgtgagccactgtgcctagccttgaccactttttggctgagaccaggagattaaaaatgtgggcctgccctcctctcccagttttagactctgcctctgcctctgcctcacattgccagcgccatgatagaactcatgccttggccgggcgcggtggctcacgcctgtaatcccagcactttggaaggccaaggtgggtggatcacgaggtcaggagatcgagaccatcctggctaacacgatgaaaccccgtctctactaaaaatacaaaaaaattagttgggcgtggtggtgggtgcctgtaatcccaactactcgggaggctgaggcaggagaatggtgtgaacttgggaggcggagcttgcagtgagccgacatcatgccactgcactccagcctgggtgacagagcgagactccctctcaaaaaaaaaaaaaacaaacaaaaatgaacttatgccttgggagagattttacctcctcttctcttctcaaaaaggtaagactgttctccaggcacaataatttaagcacaggttaataccatgtttcatatagtgtggcacttatataatacgttatgtgattttattttatttatttatttagagacagagtctagctctgtcacccaagttggagttagtggcacaacctcagctcactacaacctctgcctcctgggttcaaacaattctcctgcctcagcctcccgagtagctgggattataggtgcctgccaccacacctggctaatttttgtatttttagtagagacagggtttcaccatgttggccaggctggtctcgaactcctgatctcaggtgatctgcccacctcggcctcccaaagtgctaggattacaggcgtgagccaccacgccccaccctgttatgtgattttaaatgtttcaaagtcagatcaagaacaatgagaaaagtattcctttttcgagtctttcagtcctcctgattctatctgggaagaagtttcagttgggtgctaccatatcttaaaacctctcagcacagttgctgttctcttcttcctggggaatgctccaagcctcatttttatcatatttatttt

SEQ ID NO: 36812 - DNA, 1030 bp, Homo sapiens
ctgggattacaagtgtgagccactgcgcccagccgcctggctgattttttaaaaaatttttcgtagagacagggtctcgctttgttgcccaggctggtctcaaattcctggtctcaagtgatcctcccacctcaggctcccaaagtaccaggattacaggtatgagccaccacacctggcccttttctcacaatttataattcagaaaggcaagataaactctatgaccctgggcaagttattttacatatttgcaccctattcagagatcaggctttctgagagagatgctgggatccctttatgtagtcttgaaatacatggtttcctagcctaatcataatcaacaagtagaacgcaatgggaggctgggtgcggtggctcatacctgtaatcctagcaatttaggtggctgaggcaggcggattgcttgagcttgggaattcgagaccaccctaggcaatatggtgaaaccccgtctctataaaaaatacaaaaattagccgggtgtggtggcatattcctgtagtctggctacttgcaggggtgggtgggagaattgcttgagccctggaggtggaggttgcagtgagccgagatcgtgccactgcactccagcctgggcaacagagtgagaccctgtcttaaaaaaaaaaaacctaatggtccacttgttcagcaaactctgagcatctactgtgtgccagactccagctgggtgtgaaggataagaaacaaaaatgagtcaaatagtccgtgttccaatgtcacacttgagttcacagaaaagtctcctaagctatgacactgtcagtttagggtggcaagtggtatgacagaggtctatttaatgtactctgggagcacagaagaggagcagggttaattcttcctggaatacacaaagggacttgacagttgtttactgaatgatgtttttttttttttgagagaaagtcccccagaggaaaagcttatatttaaattgggtcttgaaggctaagcagacacgctgccaagcaggaaagga

SEQ ID NO: 36813 - DNA, 1034 bp, Homo sapiens
tttgctgtcgcctagactggagtgcagtggtgcaaccttgactcactgcaacctccaccctctgggttcaagcaattctcttgactcagcctcctgagtagctgggactaccggcacctgccaccacgcccagttaatttttgcatttttaatagagacagggtttcaacatattgctcaggctggtcttgaattcctgacctcaggtgatccacccacctcagcctcccaaagttctgggattacagacatgagccaccgtgccctgcctaatttttgtattactagcgatggggtttcggcatgttggccaggcagatctctaactcctgatctcaggtgattcacccgcttctgcctcccaaagtgctaggattacagacatgagccaccgcacctggccatacaattgccttctatatgttttttatttaatatgacatttgtatttccccatgttattaaaaaattctttataagcatttttagtgactgcatcgtactacatttaatattcgtctaatgctgaacatttaatctccccaccccccactttttggtgttacagataacactacagtgaacatctctgtagaacactttattacatttcaggttattttctgagaacagactctatatccctcattttattggatgcgcattaaatggttctagacttacttacactttcacttctgatgcttctgttcagtatctcaaagaatgaccgttctctcttaacaaccattatacctcttttctgatgttaaaaatctacattcattacagaaaagttggaaaatagtaggccgggtgctcacgcctgtaattccagcactttgggaggctgaggcgggtggatcacctgaggtcaggagtttgagaccagcctgaccaacatggagaaaccccatctctactaaaaatacaaaattagctgggcatggtggcgtatgcctgtaatcccatctacttcggagactgaagcaggagaatcgcttgaaccccagaggcagaggttgcagtgagtc

SEQ ID NO: 36814 - DNA, 1156 bp, Homo sapiens
attcattggccagaatcagggatgttttctgaaggcgtaagtaagagctatagccttcaggtcttcttgccacactggcagcctggcatagcaaagagagcacaggctttagggtcacagacctggcttcactcactggctgggtcaccttgggcaagccacttcactcatctgagcctcagtttttctgaataatgtggcaaagtgatacctacctcattggggtagttctgaggaccaaaggagaaaatatatgtagaaaacacatcactaatttttttttttttgaggtggagtttcgctcttgtcgcccaggctggagtgcagtggcgcaatctcggctcgctgcaacctccgcctcctgggttgaagtgattctcctacctcagcctcccaagtagctgggattacaggcacacgccaccatgcccagctaatttttgaatttttaggagagacagggtttcaccatgttggccaggatggcctcaatctcttgacctcgtgatccgcctgccttggcctcctgaagtgctaggattacagatgtgagcaaaacgcataactaaatgttaatggtcctcttttctctctactcagcctataatatgcaatgtagcctaaaaggcatccctagtatggttaccttttctgaatgaccttgtatgagctccaggaactcaagcctcaatttctgtatctgtgcatttgttcccagctctgcaactgtattactttaaggatgagaataaaactcccaaacttcgtgtcccacttgctgtgaagttctgggaagtactgaggtatccctgcaagagtgcaagtgtgcatctctagtctattgtaacttggcagcctgacaggagaagctcagggcctcctaagaatatgagaaccaccaggatttgtgggcttaaagtagttaaagccgctgaatgaaatagccagtctttgggctccctcaaatcttcccaggtttcccaattagagaatgcattcacctgtgtgactcacacaggcagtgccacatctgcagtaggattaactggtgtcacagccctttctattcagcatactcaaaagcctgacaccttctgggttttttcattgtttctgtttgaactctctcactgcagctctgtcaaaacgccttaca

SEQ ID NO: 36815 - DNA, 1050 bp, Homo sapiens
atagctatctctgaaattttgggcactaaaagaacttgagaaagttacttcataaatgtgtggaaactggaaattgactctatatctttggtaataaaggggtaatgtcagtattttcaacatcctggtgtccagtctagaaagacctagtaggagaaaaatattaggcttttccaaaggatctgtttctgatttcttaacataaatttggccttgttgagtcctttttaatttgaaccggcaaagtatctccccctgcctcagaaataacttattgattaaaatcgaaaactagggccaggcacagtggctcacgcctgtaatcccagcactttaggaggccaagataggtggatcacttgaggtcgggagttcgagaccagcctggccaagatggcaaaaccccatctctactaaaaatacaaaaattggccgggtgcagtggctcacacctctaatcccagcactttgggaggccgaggcaggcagatcacctgaggtcaggagctggagaccagtctgaccaacaaggagaaaccccgtctctattaaaaatacaaaaactagccaggcatggtggcatgcacccgtaatcccagctactctgaaggctgaggcacaagaatcacttgaacccaggaggaggaggttgcagtgagccaagatcgtgtcactgcactccagcctgggcaaaaaagccagactccgtctcaaaaaaaaaaaaaaaaaaagttagccgggcatggtggcatgcgcttgtagtcccagctactcaggaggctgagtcaggagaatctcttgaacctggttgcagtgagctgagatcacaccactgcactgggcgacagagcaaggctccatctcaaaaaaataaaaatctaaaaagaatctaaaaagccaggaaactacaggtgctggagaggttgtacagaaataggaacacttttacactgttggtgggactgtaaactagttcaaccattgtggaagacagtgtggcgattcctcaaggatctagaactagaaataccatttgacccagccatccca

SEQ ID NO: 36816 - DNA, 1132 bp, Homo sapiens
gccaggagttcaagcctggccaacaatggcaaaaccccgtctctaccaaaaatacaaaaattagctgggcgtggtggcacacacccgtaatcccagctactcaggtggctgaggcaggagaatcacttgaacccaggaggtggtggttgcagtgagcctagatcgtgccactgcattccagcctgagcgacagagtaagactctgtctccaaaaaaaacccagatctgtccgactctgacacccaacctttaatcactcactttctgtcaatgtcacctccgttttgaccagccaagctagacctccctggagcctgtggagaagccaaggtagaaaagggttggaaaagaatgataaaataggccaggtgcggtggctcaagcctgtactcccagcacttttggaggccgagacaggcagattgcttgagcccaggagttcaagaccagcctgggcaacataatgagaccctgtttcaacttaaaaaaaagaaatggtaatgaacaattgtcaattctgagcagctgggtatggtatgaccctgtgtactttttctgtattttaaaatgttctcaaaataaaacttgtttaaaaaaaaaaaagaagaggacaaagaagaggaggaggaaaaagaagaggaagagtaaggaaggaggaaagaagagggggagggagggaggaaggaaggaaggagaataaatgaagaaagaggccaggcagaatggctcatggctgtaatcccagcactttgggaggccaaggcaggtggatcacctgaggtcatgagttcgagaccagcctggccaacatgatgaaaccctgtctctactaaaaatacaaaaattagcgagtcatggtggtgcatgcccataatcccagctacttgggaggctgaggcaggagaatcgcttgaacccgggaggcggagtttgcagtgagccgcgattgcgccactgtactccagcctgggcaataagagcgaaacttcatcaccaaaaaaaaaaataatgtaaaataaaaaaatgaagaaagaacaagactgggtagggtgcagtggctcacgcctataatcccagcacattggcaggccgaagtgggcagatcacctgaggtcaggagttggagaccagt

SEQ ID NO: 36817 - DNA, 1010 bp, Homo sapiens
tgggaattttgacgggcagaggggttttaattttagttcatcccaagtgtccaccagtctacagaggaggaaaaagagacgggctgtttctatgtagcaggatcggcccagcttcgggaaaatggagttttcagaggctcatcgaggccattttttcatctccagtcgggggaactttttctgcccatggaagtgcagcagaaaggcatagaggccactaggccttgaagtggctgccattttaaagagtcgagtcagatggcctattaactcagattaattgctgtgcttttggattccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctc

SEQ ID NO: 36818 - DNA, 1026 bp, Homo sapiens
ataagtggattgtcagccttcatcattttcaatggaccaaattactaaaactttacaggttggttggttttttttcttttttcatttcctcatgtactcaatttctaaggctttttgaatttgagcttcctaatatctcatgcattaatttttttctccattctcaactttcactcttttaattaaggataataatttttttttttgagatggagtcttgctctgttgcacaggttcgagggcagtggtgcgatcttggctcactgcaatctccgtctgccgtgttcaagcaattctcctgcctcagcctcctgagtagctgggattacaggtgcatgccaccacgcctggctaatttttgtatttttagaagagatggggtttcaccacgttggttaagctggtcttgaactcctgaccttatggtccgcctgcctcagcctcccaaagtgctgggattacaggcatgagccactgagcctggccaaggataataaattataatggttttaggttggacatctctgactgcatactgcactgtgtttactggaagaagtcccttaatgtctctaaggcccatttcctcagttctaaattacggctagtaccttcattggagggttgttaagtctatgatacaagataactttttttttttttttttttttgagacagagtctctatcgcccaggctggagtgcaaaatggcacgatcttggctcactgcaacctccacctcatgggttcaagttgattctcctgcctcagcctcccaagtagcttggattataggcatgcgccaccatgcccgactaattttgtgtttttagtagagatggggttcaccacgttggccaggctggtcgaactcctgacctcaggtgatcgacccacctcggcctcccaaagttgctaggattacaggtgtgagccatctctcctggccatgatacaagataatttatatgaagtaatacactgctggttctgaagtaggtgtgcagtaagtgatgcctactgctg

SEQ ID NO: 36819 - DNA, 1059 bp, Homo sapiens
cattctggatgtccccagttttactggtagtctttcattgtgtgtatattaagttctttgtttttatcacctgtataggttagtatatccatgactcccgtcaactttctaaatgttcgctgggtgcagtggctcatgcctgtaatcccagcactttgggaggctgaggcggctggatcacctgaggtcagtagttcgagaccagtctggccaacatggtgaaaccccgtgtctactaaaaataaaaaaaaaattagctggatatggtgggtcatgcctgtaatcctagctactcgggaggctgaggttggagaatcgcttgaacccaggaggcggaagttgcagtgagctgagatcgcgccgctgcactctagcctgggtgacagagtatgtctctgtctcaaaaaaaaaaaaaaaagttgctaaacatttctaataccataaggatccctgctgttgccagccgttttaaaactacatccatcgtcttcttggcaaccttccatctctttttcgtatgtgacagcgtcttgctctgccgcccaggctggagtgcagtagttgcatctcagctcactgcaccctctgtgtcccaggcttaagcgatcctcccacctcagcctcctgattagctgcgactacaggcacttgccaccatgccccactaatttttgtatgtttttgtagagatggggttttaccatgttgctcaagctcgtcttgaactcgtgagctcaagcaatccgcctgccttggcctcccaaatggctgggattacaggcaggagccaccatgcctggcctagcccctccatctctagcctttgtcagttactaaactttttttcctgaagttttgtcatttcacaaatgttagataaacatgagtcatacagtatgcagccttttgggattgtctttttttcccttagcataatttccaggggattcatctaagttgttgactaaatcaatagttgttttttttgtttgttttttttttgagacggagtttcactcttgtggaccaggctggagtgcaatggcatgatcttggctc

SEQ ID NO: 36820 - DNA, 1018 bp, Homo sapiens
aatgatatatatatatatatatgaatgaatgaatgagatggagtctcactctgtcacccaggcaggagtgcagtggtgccattttggcttatggcagcctccgcctccggggttcaagtgattcttgtacctcagcctcccgagttgctgggattacaggcactcgccaccatgcccggattttttgtcttaattcatgaaggatgaattaagtctgcagttgttctttttccctttttctttccagtttttttttttgtttgtttgtttgtttttgagacacagtctcactcggttgtccaggctggagtgcggtggcagtatcttggctccctgtaacccatctccctggttcaagcgattccggtgcctcagcttcccaagtagctaggattacaggtgtgtgacaccacacctggttaatttttgtatttttagtagagacgaggtttcaccgcattggttaggttggtctcaaaactcctgacctcaggtgaaccgcccacctaagccttccaaagtgctgagattacatgcatgagccaccaagtctggcctaagtctgaatttttttttttttttttttgagacggagtttcgctcttgttgcccaggctggagtgcaatggtgcgatcttggctaaccgcaacctccgcctcccacgttcaagcaattctgcctcagcctcccgagtagctgggattgcaggcatataccaccacgcctggctaattttgtatttttgttagagatggggtttctccgtgttgagactggtctcgaactcctgacctcaggtgatccgcctgcctcggcctcccaaagtgctgggattacaggtgtgaaccactgcacccggccgaatatatttttttttttttaaatggagtctcgctctgtggcccaggctggaatgcagcggtgtgatcttagctcactgcaacctctgcctccctggctcaagcgattctcctgcttcagcctcctgagtacctgggaccacaggtgtgcaccacc

SEQ ID NO: 36821 - DNA, 1079 bp, Homo sapiens
tgatcagtgatactgagcaccttgtcatattcttgtttgccattcgtatgtctttttgagtaatttctattcagattttttgtccatttttaggaaaactttaatttgattgttatatttttcttttagatttgtttgatatcctcacatagtctagttacttgttttgggtttttttttctcttggagacagggtctcactctgtcacttaggctggtgtgcagtggggcagtcatggctcagtgcagccttgacctcccaagctcacgcatccctcccagtttaccctcccaagttgctgaaactacaggtgtgtgctaccatgtctgcctggtgtgggtgtgtgtgggtgtgtgtgtgcacgcaaggatgggatctcgccaaagttgatcttgaaatcctggcctcgagcgatcacccaccttggcctcccaaagtgctaggattgtgcaggcctgagccaccacgcctggccttttcttgtttataaatgagattatgtatttatacttgggttgatttgatgacgttattcttaaatatgggtagtttaagctgtggaaaagttttagtaggctttggatatcatataaatcaagcatctaaacggatgtgtttttgtcttatatattgctgtcgtctctttataacaacttaatattatgggagtttttggtaactaaaacaataactgagtccttagagttgcgataatttctatgataattgttatgtaaagcattagtacttcccccacttcccctcgtctttacctcaagttgtgtatcactatagattctcagcaagtttttctaaaaaactgtggctgggtgcagtggctcatgcctgtaatcccagtactttaggagggcgatttgggtggattgattgagctcaggagtttgggaccagcctgggcatcatggtgaaaccctgtctctacaaaaaatataaatgccaggtgctgtggctcacgtctgtaatcccagcacttgggaggcggaggctggtggatcacctgaggtcaggagttcgagaccagcctggccaacatggtgaaaccctgtctctcctaaaa

SEQ ID NO: 36822 - DNA, 1085 bp, Homo sapiens
taagatggaataatttagttgtacttattttgtaattctttttaggctagagtgttttcattctcaatttttcatacattgctttttcagaaggctaataggaatgacaataatgtttcaaaatattttgattcttattgatgccccatgttttgtctgtctaaagtgtcaacctaagaaaaagtctacgccactgaagtatgaagttggagatctcatctgggcaaaattcaagagacgcccatggtggccctgcaggatttgttctgatccgttgattaacacacattcaaaaatgaaaggtaatacttgcagtgattatacatgttaaaggcagttgcctttagaataactcaatttttgttatcttaataataatatatttttttccttggaacattttgtgaatgaattggtgttacatattttatcttttggggcttttaaaagttcgttttactctatgatttaaaccttctctcagttttttttttttgtttgtttgtttttgagacggagtctcgctcttgttgcccaggctggactgtagtggtgcaatctcagctcactgcaacctctgacttgtgagttcaagcgattctcctgccttagcctcccgagtagctgggattacaggcatccgccaccacgcttggctaatttttgttttttgtttttttttttaattttttatttgagatggagttttgctcttgttgcccaggctggagtgcagtggcgtgatctcagcttaccgcaacctctgcctcccgggttcaagcaattcttctggctcagcctcctcagtagctgggattgcaggcatgtgccactacgcccagctaattttgtatttttagtagaaacggggtttctccatgttggtcagactggtctcgagctcccgacctcaggcgatctgcctgccttggcctcccaaagtgctgagattacaggcatgagccctgcaccaggcctaatttttgtatttttagtagagacggggtttcaccatgttggccaggctggtcttgaactcctgagatgaggtgatccgcccgccttagactcccaaagtatgggga

SEQ ID NO: 36823 - DNA, 1024 bp, Homo sapiens
tcaagcagtcctcccacttctgcctcccaaagtattgggattacaggtgtgagcccctacacctggccagttcaatgtattgactcatgggagagtgatttaattctcaaattgactttaagaacctctgtataggtacacacatgtgtatattaaccagttccagttcctgtaggtgatttttattgaaggatttaattcagtaggtgggaaataaggagttcattttttttttcagtttgtttttaaaatgaaccagacaacacaaaatttaactaagttttagtttcattattaagctatgttttttaatagaaaaactaccatgtgtacacttttgaaaccagcatttacagagaagttaccgttgacagttcagtttataaatcccttctctcctttgtctttcttttttcatttttcattttgcattctgagggaagtaggcattccataattcttccaaaggttatttggattcttttctgtgttttgaaataagacatggttgttacaagggaactagatgtgagttaaaatgaattttcgtataaaatgatttttatttccttttattaaaagtgacaaattgttaaacatgtgttgtcctgactttcttttgtgacactttttagtgtaataaaagttgctaataaaattgtaaatgtgtggaagataacatatactagatgaattataatcttttctagatgggatttgtattttcatatttttaattgtatgtatagaactttagataaccaagaaattataggctaaactggatttatttttggttttattactggtaggctttcctttttcttttaaaatttccctaatttgaaatattgcatttcactttctttgcaaaaccagtgtttgaccatgcgcttgttctctctgaagttattgaacttactatatctaaaataccaaaaccatacattattttgggggtgtggttgtggggaggaatccatgcaaagcaccttgtgtggtgctcgtctatgagtagctacac

SEQ ID NO: 36824 - DNA, 1030 bp, Homo sapiens
atgttagccaggatggtctcgatctcctgaccttgtgatctgcccacctcagcctcccaaagcactgggattgcaggcgtgagccaccgtgcctggcctatttatttaaatttttttttttttttttttttttttttttagagaaggggtgggtctccctgtgtttcccaggctgggctaaaggcatcctcctgcctcagcctcgcaaagtgctgggattaaaggtgtgagccactccacgcagccttttattcatttattttattttttaaaatttgagacaggatcgtgctctgtcatccaggctggagtgcagtggcacggtttcggcacactgcaactttcacctcctgggcacaaatgatcctcctacctcagcctactgagtagctgggaccatatgcatgcagcatgtccagctagtgtgtgtgtgtgtgtgcgtgtgtgtgtgtgtgtttttagtagagacagggtctggttgtgttacccaggttggtcttgaactccagagctcatgtaatccacctgcctcagcctctcaaagtcctgggagtacagccatgagccaccatccccagcaatgatctgaatgtttacttgctctgcagaacatccccttcacaaatattaaactatttgtgaacactatgtggtagttagaatcttgactaatacctattgtatggaggtaaggaagaaaataagagtctgaaaaattagctgtatttcagagtctcaatgttttcatgctgtgaggtatccagaaaagataatgtaatacccatggtgtcatcagtataatagctctggattacatgatgaagcctaggagatggcttggttataatccaggttatatttaacatttatagtcgattcttgattagccaggtggctagtgataactagaatttcaaatttcaagttccctagggaggtagatcaaacctgctgattcctcttatcctgttttttctatattcatcatctttaacctttttttctttttcttttttttttcttggttttt

SEQ ID NO: 36825 - DNA, 1025 bp, Homo sapiens
caatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtaaggacatctaaatgtgataaaaaaaaaaaaattggagaaagtgctgataaacattgtccttctgaaattggtctgttgtaatggtaaagtgaagtataaactagcggggaagaatcatcacttcaatgaagaaggagttttatgtagaaaggtctgaattttgaagatgagatttccatatatattcaaaagttaaactttaccagaagcccttttccccaaccttttcaagtaaatctctataacatctttctttctcactttctctctctctctttctctctctctcttttttttttttttctaattttttttttcttttgagacagggtctcactgtgttgcccaggctggtctcaaactcctgagttcacgccatctgccagcctttgcctcctaaagtgctgggattactcttgcctgacctgttccccgtttcttaccttttaaaatccccaagctttttgggactcaatatgtaactgcaagtaattgagaggctccgatcctaggatttaaatccagttgttaggttatagaaagcaaatagattctattggatggtagtttc

SEQ ID NO: 36826 - DNA, 1021 bp, Homo sapiens
gtttttttttttgagagggagtctcgctctgtcgccaggctggagtgagctggcacgatctcagctcactgcaagctccacctcccgggttcaagcgattgtcctgcctcagcctcccaagtagctgggattacaggtgcctgccaccacgcccggctaattttttgtatttttagtagagacggggtttcactgtgttagccaggatggtctcgatttcctgaccttgttatcctcctgtctccgcctcccaaagtgctgggattacaggcgtgagccaccgcgcccggccctgtcaaaagatattttcaaatttcccttgtgatttcttctttcttccattgattgttcaagagtttgttgtttaatttccacctattggtggatttttcagtttttgtactgatactgatttctagtttcacttgattgtgactggaacagatacttggtatgatttcagtcttcataaatttgttaagacttgtgtggctgggcatggcagcttacgcctgtaatctcagcactttgggaggccaaggcgagatcacctgaggtcaggagttcaagaccagcatggccaacatggcaaaaccccatctccactaaaaatacaaaaactagctgggcatggttgctcatgcctgtagtcccagctactcaggaggctgaggcacgagaactgcttgaacccaggaggtagatgttgcagcgagctgagatcacgccactgcactccagcctgggcgacagagtaagatcctgtgtcaaaaaaaaaagactctgtgtgaccatattggagaatattctatgtgcttttgacaagaatgtgtattctgctgctgtttggtattggtgttttatatatgtttgttatatgcaattgttcaagtcctctgtttctttattgatcttcattgtggttctctccattattttaacgtggagtattaaaatctccttgtgttactctatttctcctttcaattctgtcattatttgctttttatatttgggtggt

SEQ ID NO: 36827 - DNA, 1046 bp, Homo sapiens
ccaaagtgctgggattacaggcgcgagtcaccagccccggcctaggctgaatgatctagattgccactattaggaatggttttggggtttttgcctttttttttgtttctttaaacttttttctctgaggctccagaactaggaaagtcgaggtataaatagggtctaataatctgtattggaagagtgatgttgctactagtattctagtcctttggaaaaattcaccattttaatgaaaaggagaaaactgtatgtagttcagtcttgatgaaagagattttactttttaaaattaactttatccaaggtataatttacatactgtgaaattcgtacattttatgtatacaatcgaatactatttgcaaatttaatgtgttatgcaaccatctctgtaaatccatttcggagcatttctaccatcccagtaaagatccttctaatctgtatatagttaatccctcttcctaccactagtcctagagaaccaatagttgactgtctctgtagatttgccttttccctggacatttaatattaatggaatcatgcaatatgtgatcttttgtgtcttgttcttctcatttggtatatttttctgatttaaaaaaaaaaacttaccatctgtaatttgtccccttttttgctaaatagtattccaccatagatgtatgcctaattttatttattcattcattcattgattaacatttgggctgtttcaactttttggctgttttatcattttagttggtagtgtatactctgaggtctacggctattgctatactcatccagtatttgtcatttatctctttcttcacaatacagtgacattttgtagttgtatagtaggcatgacgtactggttgtgtggtaggaattagggcatatttgctgagaaccttaggggtagtgtgatttggctcttgctttgtttgatatttgctacatatcctgtattaaggtttgcataattactcctctttccattgacttgtgcagttttatggattttgatattttcttccagtatccaaaag

SEQ ID NO: 36828 - DNA, 1033 bp, Homo sapiens
ctaagaaaaaacaaaagaaggtacaggagcaggtgcacaaggtatgttgcaaaatttcagcaaactttcactggtccttaggaaactgcaattttatcttcaatgtcatactttatcttcatgaaacaataatttccttaactgagatcttgttttttattctcagcttctagcacagtacttaggatttagtggttattcaggaaatatataaatgaatctacatattgtatttatttatgtatatatttttccctctttgccttcaaagagtaatgacttaggaatattgttatgatttaatcttaagtaaaaatataggctataaagtgaaatatatatagtctgaccctaatttcaaaagtaaatatatcttatttgtcttatttttcaactcagttttttaaaatgaaatagagacatcttgacattctacccctacatagtttaatatgtagttaaaaaatggaacattttcctttataatcaatttaacatatttacatcttatataagatctgtttatctgacatcaactgtctttcaaatttcatcaattatcccctaacctttacctttggattattcataccaggactcaatctaggactgctcattgtaactggttgttatggttctcaaatcactttgaattcagaacaatcccttttttcatgatcatgatcatgtctataagagagtgacatataaagtcatctactttctgtatttgtgtaattgcttcctcataggtgtcacttagattgttttctctatctcctgttctctgtcaaatggaagatagaacctatcagtttgatagattgaaagttgaacatttttagctagactatatcagagatgataatgtggaatatattgtacattagagggttaaaaaatgttttattcccatcagccattccctgacagtttgttctttcttttttaaaattgagacagtgtcttgcccaagctggagtgcagagatgcacgaacacggttcactgcagccttgacctcctgggtttaa

SEQ ID NO: 36829 - DNA, 1063 bp, Homo sapiens
tagttattatttcagtacctactatgtgccaaaactctattaagtcagctcttttatattattcttgagtgatcctatgaattatcttttacctattgaattttatttacttaggggcagagcagaaactataatctttgtccatttatgaccatgatccaagttctatttcactccacttctccttattttatcctcaccaacaatcagttgttataaaggcagttccgtccttctgacttctcccttagtgattttgtgagttaaagtcaccacacacacatccctcacattagttggtgcttgcattgaaaactgtttacttgttttgtttactaatattttataataagcaaattaccatcctgcctcttcccataagatgacggggaaaacatcaaaaacattgagattcattttgtgtggtatacagattttttaaaaattaacttgtgcccagtttctaaatcatctaatgtaaagatacatgcatttcaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttttgttttgtttttttgagacagggtctgattctgtcacccaggctggagtgcagtggcataattttggctcactgtaatctctgcctc

SEQ ID NO: 36830 - DNA, 1028 bp, Homo sapiens
aagaatgttttctctcccttagtgaaaccttaaaatggaacagctcagaaagttccagtggaacaaacagcctcagagcagttagtggcagggcatgaggcgcccactacccgcccaatcacagcagggttagaactaacattgcatgcagtccgcccgagtgattggctgaacatctgtaagtgcttaatggctagacaaatagcagcccagagggagggggtcaaatggaagagacatcaataatacagatgtgggacattattttttctttgcaagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcaggtagagaaatgtttgcccacttgtgttttcattgcatgttcatctttaaagggaaacccactccatctctttatgatggtttcttggtagaataacaatgcttttggatgattccagtggagtcactttctttaaggatttgacccctttttttctccccacaaagaaagatacttggagaaatagtttagtgttggtgaaccacgtgcccttaaggcccatgaaggaatatatgccgcgaaacaagtctgagatggaatatgtgaatctctggttgcttattcaaatataattctccagtacttctcatggtgtcacaatctttgggtttgtaagaaacttttcaagggtaattttagctttgagatgtttttcctttaatgtggtgactttagaaagcctaccacctatattgttttatttatttaataaatatttgtagagtatttactatgtatgaagtattgttccaagcactttataaatattacattatttagtcatcctaataatctcataagtagagttctatgattattcccattttgcagatgaggaaactaaattacagagaggataaatagcttgtttatattcatgagaga

SEQ ID NO: 36831 - DNA, 1028 bp, Homo sapiens
aaaatatttgggctgggtgcggtggctcacacctgtaatcccagcactttgggaggccaaggtgggtggatcatgaggtgaggagtttgagaccagcctggccaacgtggtgaaaccccatctctactagaaatacaaaaattagctgggcatggtggcgcatgcctgtaatcccagctactcgggaggctgaggcaggagaatcacttgaacccgggtggcagaggtggcagtgagccaagattgcgccattgtactccatcctgggcgacagagcaagacttcctctcaaaaaaaaaaaaaaattgataaatcttacaatgttttatagtgacagatgcccattgttatttcctaagcgcctgtcttaagtgaggccctatcttagctgagattatttcagaaaagtgatctctctctgggatggttgtaggtatgtcccaaaagggctgtttagaccttggtgggagctcttttggaactttatgatccaactctagctagccagtgtctgttgcttgaaccattcagtagctttctggtttatctctatgctcttttctgacctttctactcttgaactcgttttccatgtagcagtcagaacagtctttttaaaaatgaatacctgattttagctttcctttgttaaagctctccaatggtacacctttgtaactagactaaaatctacaactacgggcccttgcctctttctcacctccttttctgccacttttaacctttgtttactttaacccactgacactggttttactcttgattctcaaacatggaaaaacagatagatgttttctttctcttaacagaattgtgaaaaattgggtgagctgctgttatgtgaggctcagtgctgtggggctttccacctggagtgccttggattgactgagatgccaagaggaaaatttatctgcaatgaatgtcgcacaggtaaagtagatatcgaacggtcttcctccaaagaaagtttgaattttaagtttttcaggaaagacatttattgg

SEQ ID NO: 36832 - DNA, 1049 bp, Homo sapiens
aatggaaaccgatagcttatcttcacaggtgtgggacagaaagtcatccctatgctcatctgagacaaatgcgtacctcattgcttcctctgccctatttatgtaaaaatgcagtttcactgagccagattaaattgtgtattcagtgaaaggctgatgaaggattcaaaagaatgcaaccttttgtcttttacctacttatgacctggaaccccaaccccctatcagaaccaatgacaatgttacacatactgatgtctcttatctccctaaaatatataaaagcaagctgtacccccaccaccttaggcacatgttgccaggatctcctgaggttgtgtcatggacgtgatcgtcaccttggcaaaataaactttctaaattggttgagacttgtctgacatattttgaattcacatcactaaggagatttgtattatcaggtgtatgtatatgccaataattctgtaaaagaagaattttccttacttgagatatattgtttctgtagccaaagactggagtttagttaattctggaagctttttttacttagttgaaatctgacagctagtacacagtcaatggattggtaaaactgctgccaccttagtataaaccaaggcactacctccaaaccaatacaagtaagcagtcatcgtgttctgtatcatcacctactcgcagtaaaagcatggcagtttcaccttagaagtttcttgaagtaaaacaccttagttttattatatcttgtccatgaagtcaacattgtttttctattctctgtgatgaagtgggaagtacacgtaaagcagtttctttgcatactgatggttatcttgagttaaagcactcatgcaactgagtttcaagctgaactatccacattgttcatggaacaccgtttttaattgtaagagttactgataaactatggttattcatgcttggatatttggcagacatttacttgaaaatgaacaactgtgagcctatcaattcaagaaaaagaactgcaaaataatggcgaatgataaaatttgagcttt

SEQ ID NO: 36833 - DNA, 1035 bp, Homo sapiens
tgctgtttatactctggtcattatgtgtcactgataatgtttttatttagtatatcttttagtgaagagaaagaaaatatatatatatatgtgtatggatgtacacatacatgacttgcagtcttgtgatctgaatgccacatttttttattcccacaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtaagcctgaagaatagcactcatctcttttaccatcctctgtttcttgagacctctcagatacaatgcttaacgtatttctaatgatctacttaattactcatggtactcctcccctcttcttcttgatttttttccttataggaagagaaacctaactttatgatttacaattataggaataatacatgttctctgtcgaaatttttttttcttttgtgtattttgtgaaaagtttttttttttttttttaaatgaaaagacagtaataatctcacaaggcaggcgcattgttaacatttcggcatatgtactcccagacgtaccaatacgcagttatgccccccaccatccaaaataactgtttttacagattatactctgttatgtgtcttgggttgtttgttttgagacagggtatcctctgtcacccagtctggagtgcagtggtgtgatcattgctcactgcaacttcaaactcctgggcttaagggatcctgccgcctcagcctcctgagtagctgagactacaggtacatgccactgcacccggccactttttcttttttaaaatattttgattgaacatcacacaccgggaactgttgtggggtggggggtggggggagggatagcattaggagatatacctaatgctaaatgacgagttaatgggtgcagcacaccaacatggcacatgtatacatatgtaacaaacc

SEQ ID NO: 36834 - DNA, 1055 bp, Homo sapiens
actgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcaca

SEQ ID NO: 36835 - DNA, 1025 bp, Homo sapiens
caattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcct

SEQ ID NO: 36836 - DNA, 1046 bp, Homo sapiens
agctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctataggtacgtggtatttggaagagcaaaaccgcgccatctcgctatctggagatcgaattatgggtaacccccaagtactgggaccaggaaggactcgatatcgaatcctaggtagaccttatcggggaagcggccaggccaggcctgcaaggtcctgaagggaggttgggcctgggtggtggtttacttgagaccttagtgtaagattcttttctcagtgtggtgagacaagaagaggcggcagtatgggagttgggagggatcttggagttggaaatcctatttctctgcccgtggcgctttcctggggtgcaataaatcatgaggtccattcctgctagaaggcaggaatccaggtcagtcagatggcgggagtgggaatttgccctgggatgggcccttaactctggtttgaaccatagcacataccaccctgcaaggttacgggaaggcgtggcctctctaggcccggagcctccaaatgggaatcccctcgggcagtctcttaggggcaagcttctgagggtcaccttcaccctgacacctgcagcaaacatgtcttgacggaagacatagtacaccgggaggtgacccctgaccagaaactgctgtcccggcgactcctgaccaagaccaacaggatgccacgctgggccgagcgactatttcctgccaatgttgctcactcggtgtacgtcctggaggactctattgtggacccacagaatcagaccatgactaccttcacctggaacatcaaccacgcccggctgatggtgagacacctcctgttgtgattctgcacctccc

SEQ ID NO: 36837 - DNA, 1032 bp, Homo sapiens
atggccagactggggactggtacctccactagagaacccttacgacaacctggctctgcccctcccacctgcatggcttttttttgagacagagtctcactgtgtcacccaggctggagtgcagggctcactgcaacctccgcctcctgggttcaagtgactctcctccctcagcctcccaagtagctgggactacaggtgcatgccaccacacccagctaatttttgtatttatagcacagatgggtttcaccatgttggcctggctggtcttgaactcctgacctcaagtgatccgcctgcctctggcctccctaattgctgggattataggcatgagccaccgcgcctggccgacctgcatgactttaaacatgtctcttctttctcaacttcagtacccctttttgtggaacggttgggggtgggacataaagactaaaggaaaccctgattgtcactgagtcctgagcccaggcgcctggacgggctgcatcagaaccacctcatgaactggcttttcatgagcttgaggctggggcccctgacggcttctcaagtgatctgaggccccaggtggggtttgggaacccttggtgtgtgtatacagttggcacctaatagatgccagccatgtttggggtgggaaaggagcttgggttgtggccatagggagctgggtacgaatcctgtacccaggattggtctctgggcttggtcatcttgggtatactctgggcttggtcatcttgggtgaattgattcctcacttcagaatctcagttttcatataaaattgggcctgctctggcagagttgctgtgaggatggagtgggacaacgctggggcttgagacctccctcagtaccccttctcttcccaggcactcagaggcatggggagggggcccagggacactgaaaggggacagggagggtggggaagagctccactgactgggcagcccaggacaggatatttgcatgtgactctttgctgctgccttgatgtggctgggaggggggaggagg

SEQ ID NO: 36838 - DNA, 1054 bp, Homo sapiens
ctatggctgagcctgcaggtggctaccgggggatggaggagagagacccaaacctgtttccgtggccccagtccctgccctccctgtgcccatctgtgagggaggccagtggaggggccaacatgaggccccacattccacctggagaccgagagacgcaggaggcagagtcctggctctgcaggctccgcctcttgccggttgcgtggccttgaaccagacactccgctgctcccggcctcactctgctccactggaaaacactcatcatacctgcctcccagggctgcctggaagatgaaaagggagagttcagggaaaactccccacagggctgccctggcaggtaggaggtattcagaaaataggagtttccttcttctcgctgatattaaatccagaagttgcaaaatggtagccacatgggcccaatttggcctacatttgtgtttaagtcaaactgtttttagtaagccagatggtttcacatacaaaatacagatttctgacttcttgtgtaaaatctgaagacccggggaccctgggcgcggcctcctgcagggccgtattcaccccgcttgatggggcctgtgctctcctactggccaaggtcccccctggccagcgggtgtgagtgtatcccagacctaacgtgcactggcgttcctggggcctgagggtccactgcccgcctcctgcccagccctaactcccatgccgcccgcccagctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacaggtacggcagctcacagaagcctggccagccagggctggggtggatgcacctttccctccctcccacccactcacctgcctggcctgcctggccgactcacccctgccacagctcct

SEQ ID NO: 36839 - DNA, 1008 bp, Homo sapiens
atggcctcttttctctttccagaggtgagcagtgtgggctccccgtgggttggccttgctgcctggcctcggggagccacgggcagcccttccatggcaaaggcaagatgtgggagaaagaagtctggtgcccgccccactccccctgcccactgctttgatcccctgcaccctggccccttcgagctgccagctttgcttcgcttgtctccccgtgccctgtctctgccagccccaggggagagggctgggcagaggccttgccctggcagaccgtgggatctacccagcccccttacttcagtctgttgccggcagcctctgcaatgacgcccacccacgtgtggcctgagctgctgctccaggctccttgtggagaggcccctccccagagtgcacccctcaggcagctcctggcctgccctggcagggtcggccccatgtgacgtccctcgtggttaatggcacctgctctgcctctctccctccctccgtgtcttccccgtccctccaggattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagcctt

SEQ ID NO: 36840 - DNA, 1047 bp, Homo sapiens
caacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaagggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgcaagtgactcagtcatcagtgggcacacactgcagggtgcctcagggaatgccagttcttccaaagagcaaagcacttcacattccaaagtgaattcccaccagtcagcttcattctttccttcttctccaggccttcctgtggcagggaatagtgggtttgtccaagattatacaacaagtaaattgggctggggctcaaatttacaccctttcctctgtgccagctccctggtgaagttccctctttctagagtcagtaagcaggattgtcatggatgctgccaggaagtgcctggtaaggaggtgcattgagcaggggagtgctacaggacagccaccctgggctggcagg

SEQ ID NO: 36841 - DNA, 1027 bp, Homo sapiens
gaggcagtaggaggggaaggggcacagcctctttggagggcactgtggcaatgtctgtgaaatgtaaacagtgtacaagccatttgccctccagttgagaatgtattctacaaagaaactccaacaaatacgcagagatgcaagtaaaagactgtccagtagagaattatttttaatagccaaaaccaaaactgaaagaaaacaaaacaaaactggaaacaaatgtccaccaaaatgggtctacacgaaccccagtacatccaagacatggaaaacattttagctgcaaaaaagaatgaggtagccccagatgtgtgggggtggaaaggtgcccagggtataccatgtcgttaggggagaaccggatgtgtgatatgatgctatttatgctgaaaatgaaatcttaccagagttaagatgaagataagttgtgaagtagaattagggggtcaggggacttcgttttcaatgaattaatctttacaatttgattttttaaaattatgaaaataagcaccttactatttgtttactcatttgaatacccaataatgcacaaaaattcagaaggtacaaggtggagatgtataattctgcagttctctcaactatctgatacagaattaatttattcccggcatgcatttagtgtatttagaagaaggaggagaagtgagtgagaaagggtgggggacacaggcagcggctgctctgcggtcggcagctgtggtcaggtgtggaggtgggctgccctttttggggtcactctatccttggtttcctggcatcaggccttcctaaccccgctggagcagtagtgaaggactttggtgatgccctgcccatggctcctggctgtggttcttcttggtctgggtcccacatctcagggctacaggcagtgaggcgctggaatcccccaggactgtcctgcttcttgccagctcccctccagccaggcctgcctggcggatgcccaaacactcatcaggcaagacaggtctgtaggcaaatattgatccctgtg

SEQ ID NO: 36842 - DNA, 1105 bp, Homo sapiens
cacagtgagaaatcaatattacacctaccagaatggctaaaattaaaaacactgttgataccaagtttgggcaagaatgtggagtaactgaaacttcatatactattgggaatgtaaaatagcacaactactttggaaaacccctgggtaatacctactaaaggagaccacacctgtgatccccacattccactcctgtgcatagacccaaaagaactgtgcactgtgcacgtgttcaccaaatgacgtgcgacgtgcactagaatgtttataccagcacccttcacaatagccccaacttccaacaggagaatggataagtacctctcaatatatttatagagtaaagttcttacagcactgaaaatggattaacagccgccatgcacagttggtgaatctcagcaacataatgttgagcagaagcagccagacacaaatgaatgcgtacggcacgattgtgtttctgcgaagccctaaaacaggccaaagaaacatctggtgagaagtcaggatagcgatgatcttagtgctctgggggagggtggctctggtattattctatttcttgatctgagggctggtgtcccagacgtattcactctatgataatttaccaagctgccctctggggactggtggcttctctgtatgaatattacacttcaattaaaataacaaaaacctaacagtcaaattcagaaatgagtaaggccgggcacggtggctcatgcctgtaatcccagcactttgggaggccgaggcaggcagatcacctgaggtcaggagtttgagaccagcctggccaacacggtgaaacccgtctctagtaaaactacaaaaattagccgggtgtggtggcacgtgcccgtaatctcagctatttgggaggctgaggcaggagacttgcttaaacttgggaggtggaagttgcagtgagccgagatcacgccactgcactccagcctgggtgacagagtgagattctgtcttaaaaaaaaaaaagcaaacgagcaaaggacttgaatggacatttttccatactcagcatcactaatcattaggcagatggaaatgacaacgagattccatttcactcctacta

SEQ ID NO: 36843 - DNA, 1058 bp, Homo sapiens
agtgtacagctggaagggaatgtcgtcagctcctccctctcacctgaaggctctcgactatgagccgtgccttgttgacagcctctgagtccacagagcacagggagaatctgaggacacaggacaaggcaggagaccttgtgtcctccacgtggttgcacatagagtagaagagctgggtgagtaactctctggaatcacctttctgctgatgtttgtgtctctacagatgggctcaaggacagcttgcctgactgcagccataaggatgaagcctcttcaggtagagaaggactccaggtggggcctgtgcagagggttcttacgggcgcagtaggattggggctataaaatcagtaaatggaaaaggagccaggtgcagaagtctgatttattccttttttttttctttttctttttggagacagggtcttactctgtcacccaggctagagtgcagtcagtgtgccactgtggctcaacctccgtctcctgggctcaatcaatcgttccacctcagcctccagaaagtagctgagaatacaggtgcatgccaccatgcttggctaagttttgtactttttgtagagacagggtttcgccatgttgcccaggctagtcttgaaatcctggactcgagatctgttcacctcggcctcccaaagtgctgggattataggcaagagccaccgagcccggcctccttttgtattttaattaagacagagtcctaagaggttgtgtttgcatggatgttgtgtgtgctctgcttgtcatattcatttcttgctctggtgtttaaagatgaccttttgcagaaaaccagatctttcctgcctgtgccacagaaagcactaaatccttgggttttgatgggatggcatcctttgtgaatggagaacacgggattagtatgtgggtgtggcatttggtgctatgcggggagtgatgtgggacacagcccctcacagcccctaagtctccctggagacaaagtctcccacgtgtgtgccaggaggtgggaggagtccaccctctccctctgcacccttgggacc

SEQ ID NO: 36844 - DNA, 1026 bp, Homo sapiens
tattataggttttttgttttgctttacttttagtcaaatcgttgaagaaatattatggggcatttttctaggctttattattaactattattattcgatgagacaacatcctaaactacactttttggcaagctactcaggcagtatctcttaccattttaaataaacataacgtttaacacagcaatcctaacttgggacagctatcccacaaaaacaaaagcacctggataagaggaaactgtaggggaaagtgttttgatggaaaccggcatgagggccctcctttccggttttgattctatcgggtctctgaggccttccgggcttttgggctattttacaacattgtagctgattgcaatgcaaaaatagcccggcccctagacaggtacgtgaattctgttccgtggagattcggttgactacgctccccaactgtggaagaggccagctgtgtgtccatttacacgttcactttgctattcatctataaatgtgtctgttctttggattgtccttggtttaaacatcttcattattgcctccataatgaattaagatatttagtacacaattattttgcatctctgagtcatgattttacctttaataaaaaaaaaatcctttagcaatataactgcagaggcacaaaacaaaacaccaaacaatgaactgccagttagcaatgaaaacaataaaatctgtatgagccactcgcaagatgtccataggttgttagttttaaaaggacattataacatatatggcaggatcccatttttgtttttattttttaagatggagtctcgctctgtcgccaggctggagtgcagcggtgagatctcagctcactgcaacctccacctcctgggttcaagtgattctcctgcctcagcctcccgagtagctgggactacaggtgtgcgccaccacgcccagtatctttagtagacacggggtttcaccgtgttggccagggtctcaagctcctgatctcatgatctgcctgcctccgcctcgcaa

SEQ ID NO: 36845 - DNA, 1038 bp, Homo sapiens
gataatccagtcagtcagccaggaggggcacagtggggacggtggggggcctaaggagagacaaagggaaggggctgtctgctgctccttcactagcctgggggctgggaaggacactaggtcatcatgccactgggctgctcctgctttgtcagtgtgtcctgtgggtgaccttgtgcacagctgtatgattgtgtttgctgctggacgtgaccgtctgcaccgtgtcctctaacatgggctctctgtgctgctgggtggggctgacatgtggcacaccgtggcgtgtgtggttgtatgcgctgttgcggccggtggctacctctagctcagggactttccctggacctgcgatgcctcgtggggaacctgggggtcggttatctcctcgagacaggaagtgagcatctgcccaccggaagctgaggcggtgtgcatttggggtgaggtgggcgtatttggcactgctgccaacgtccccgcccccagggccacacagggcttacatttcataagccctttcccctccatctctgactgtcagtaatcctttgaggaaagccgggcaggcggggtctttcccacttcatttttttttcctttttaaaaataaatagagatggggtctcgctatgttgctaagggtggtttcaaactcctggggtcaagtgatcctcctgcctcagcctcccaaagtgctgggattacaggtgtgagccaccatgcctggccctttcccgcttcagagatgcagaaactgaggcatggcaaaaggcggagcatttgtgtctggggtcccctggagagagtgagggcaggctggagagcaggtctctgctgtcccctccccaagaagcagcaacaggagttgagcgtgcttgtggacaaaccacatctctggctggatgggcttgtcgtggcaaggaggtatcagatgaggaggcaggatgcttccattctaatacttttggctgtagggaccaatcctaggtcccactagacattgggcagccatgaccagctacgaccttgggcaag

SEQ ID NO: 36846 - DNA, 1045 bp, Homo sapiens
tctcaaaataaataaatacatacatacatagatgaaaatttaaaaaataaagtccaactcagcggttttcagcatatttacagagttgtacaatcttcaccactatctaatttcagaacattttcatcacccccaaaagaaacctaacccattgactgtctctccatttcctccctctccctagcctctggcaaccactaatctcttttttgtctctatagatttgcctattttggacagttcatatacaaggaatcataccacatgtagccttttgtgtccggcttctttgattaatagaatgttttcaaggctcatctatgctgtagcctgtatcagcacttcattcctttctatggctgaataatagtccactgtagggatgtgccatgtttttccactagctgatggacatttgggttgtttccaccttctggctattataaatattgctgctataaatattcacttacaagtttttgtgtggacatatgtttttatttcttctggtatatccttcggagtggaactgctggatcaggtggtaactctaggtctaacctggcagttaaacagaatcctatgcatgctgtagtccatgagttgaaataaacacttgacccatagtaagtgccagatcatcttcatttcacagcaaccagtaatttcacagatgaggaaatgaaggctcccagaggtgaactggcttttcccatttgagcagttccaagtcagacagttaaaaagtggcaggacctggaagagaagctagttctttcaccctggcattcagggctgcctcctgggctacggggctggcatttagaatagagctaaggtctgctgccaaggcaggtgccccagtctgcctcctctgtgtccttattccactttctctgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgac

SEQ ID NO: 36847 - DNA, 1062 bp, Homo sapiens
gccagtcgtcctgctgccagcccaatagcttccagcggcaggtgcccaggtgctaccggagcccctcataggggtaggggcagggactgcacctcctccaggcactcatcgtaagcctcctggtactcctcatggggcttgaccattatcacacaggtggggcgcttggagcctgcggctgcacccaggtcctacagaggggaaagaagtgctgtttggaaaaaagctgtacaacctgtatgccaggaagtcaccaactgatgacccaccagcctaatctggcccacaaccatgttctgttcggtccatgttctatttaaaagcatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgttacgtaagataaggacagctacaggtccctctgagcctaaacccacctaaccggactaacatgggtgaagcatcttagcttacaaagctctttcacatacatctatctctttattctcatagtccacagataactgactatttggttcttaccatcaggccaaacggtaagttccttcagaacagggcctcctgctttatcccaagaagtgatactgtaggtacccaagatccacccccagcctctattttttttttttgagacagggcctcactctgtcatgcagtctggagtgtggtggtgtatgatcatggctcactgcagccttgaactcctgggttcaagtgatctcctgctttagcctcccaagtggctgggactacaggcatgtgccaccacacccagctaattaaaaaaattttttttgtagagatggagtctcactttgttgcgcaggttattcctgaactcctgtcctcaactgatcctcctgtcttggcctcccaaagcactaggattacaggtgtgagccacagcgcctgggctgggattcccactttacaagatgggaa

SEQ ID NO: 36848 - DNA, 1021 bp, Homo sapiens
acatatctgtagtcccaaaactaagaagatgtggagctgagaatccatccaggcctgtcttagctccaacactcctggctctttcccacactctcctgctatggcagactatcccagacaccccagtgctgagcaaggtcagggggccacgtgctccttaccgtcttagaggggatatagacatagggcaaatttcggtcctcacacatgactgggagatggcagtatacctcaatgggcagtgtgtctcctgccaaaaccatgatcctgaaatgagagaaaacactgtcatctctggcttgctccttccttctttcagttttaagtgctgccctgggctgggtcttagggatagagacaaaattgtgtttggtgagcacactatttgggggtgatctctacctcttggcaacatacaggtgccaccaaagtgatgtagtgctcggacaggtgaagtacaggatgggtgccaaggtgtatgagctcagctctctttggagagtcaaaaaagggttcaaccaggaggtgacacttgaacagcacgctgatggatgactgtgtggcaggcagcccacggaggggctggggcgggggagagcatgtggtgtgagaatcagaacggcaccagacacagccgagagactggcaggggacacccccaagaccttgagtaccaggctaagaagcatgggctctgtcccaagagtgacagtgaggcaatgaaagcttgccagagactcagccagggttcctagctggccaggtgtcaaggctggggggcaagggcctcaggagcctaagacacagaaggaaaagtctgctctcccatgctggataacaggcggacacacaaggacagagccctcggctgaaagaatgcttccgcactcctagtgctcctctgggccctctgctggctccccttctgttaagcgcctttcactgtgagtgttcctcacagccttgtcctcggctgccctctcctctcaggaccttcttcctggctgaccggagccactgc

SEQ ID NO: 36849 - DNA, 1159 bp, Homo sapiens
ccgtagcggccggactcgcgcgcgttctaaaatgaggacaaagcccgcccaggtctagagcgcgcgcgccgtggcggccaatgggacgctgaagctaggttgagtgacggacttgagcagccaatgagtgtgcagtttgttgcgatgtggcacccggctccggcattataaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcggggtaggtgcggccgcgggcggacgggggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccggaagagggaaagcgctcggacccggggcccggcggcgtcttgggccgcgccggcggctgcgtgggcggagttggcgcgagccggggcccggacctccctcctccgcctctcccgggggcggagtcacggtctgaaccctgggcgggcttggtccccggaaacatcgagt

SEQ ID NO: 36850 - DNA, 1061 bp, Homo sapiens
ttttttttttttttgctttgagacagagtcttgctttgttgtccaggctggggtgcggtaacacaatcatggctcactgcaaccttgacctcatgggcggaccggatcctcccatctcagcctctcgagtagctgggaccacaggcatgtaccaccatgcctggctcatatgtttttttaaagcctggtctcaccatgttgcctgggctcaagccatcctctgccttggccttgtaaagtgttgggattacaggcatgaactgcctcacttggtcttctgggcacctctttaagttaaccctaaacccaggcaaaaatccttccaaagatctcccagggtcctggccagcttaaatccagggtcagttgtgctttcaaatgagtggattcatgtgcagggaggtgtagctcttcccctcctgaactctggtcagggaaagggtagttcaggcttcaagttggcagttgggagttgagggtgcggcctgcagtggcagggtgtggcaggttctgtttctgagcaggagttggcagccagataaggtgggacaggtggaactcctggaagtctctatcctggctgggagtttggaaagagtggattaggatagtcttaaattttctataaaatgacagtctttgaggcagttaggggaagcagtggttattactccagtggacagtgatagaggcctttttctctatgtgccataatgggaaatgggtgggaagagcctctaaggcagagtttaagtgaaactactggtagtgagtcttaggagtaagtatatttagttggttatattcagtatttttaatttagtaggatagaatatatcagattgcattattttaatttgccaattaaaagtatgactgggacactgtaaaatgtactatttttaatgggtgtgcatgtcaggattttctttagaaatacactggtctggtctaatttatttaagcaggagcactttaaagtatcccaccctaccccattccacccccagtggacagaaaggaaattgactgacttgaggggatgcagacatctgggttat

SEQ ID NO: 36851 - DNA, 1042 bp, Homo sapiens
gctctatgcagatacacagtggttcaaattatttcatgcattttctagtccgccagtcagattatacattctttgagaacaaagatcatgtcttgtactcttccccaatatgcagataatttgatgctctttttcaccataaaaatattgcagggttatggtgtaaattttagagaataaaacatttatatatatacatatgtatatgtgtgtgtatatatatgtatgtttatggatacgtgtgtatatatatgtgcatatgtatgtgtatgtttatatagttgtgcattgcataatgacattttggtcaataaaagaccataaatgtgatagtggtcccataagattaaaacctagctgaaagattcctgtctcctaatgactaagtagctattgtaacattatagtgcagggctttgctcctgttttgtggtgatgctggtataaacagacctaccatgcagcctgccagtcctataaaagtatacagcatatgcgattgtacagttcataatagttgatgatatctgactgtgttgctgggttatatatttattgtactattcttgttattttacagtgtcttccttttgcttgttttttaaaaagttaactgtaacagcctcaggcaggttctttgagaggtatgcagaagaaagctttgttctcataggagatgacagctgcatgtgtgtcattgcccctgaagaccttccagtggggcagggtggagaggtggaagacagtggtgttgatgctgacccgtgtaggcctagactaatgtgcatatttatgtcctagtttttaacaaaaaaatttttaaagtaaaaataaaattaaaagcttttgaaataggagaaagcttataaaataaggatataaagaaagaaaatatttttgtacagctagacaatgtgtttaagataagtgttactacaaaagagtcaaagtttgaaaaaattaaaaagtttagaaagtaaaagttacagtaagctaaggacaatttgttaaagaaaactttaaaaaaataaatttagtgtag

SEQ ID NO: 36852 - DNA, 1027 bp, Homo sapiens
attgcaatgtctgactcctgggttcaagcaattctcatacctcagcctcccgagtagctgggattacaggtgcatgccaccacacccagctaatttttggcatttttagtagagacagggtttcaccttattggccaggctggtctcaaactcctgacctcaagtgattcgcctacctcggcctcccagagtgctgggcttacaggcgtgagtcaccacacctggcctgtgtttcttatttaataaaatgtctgggtattttgttcattttctagttgagttattttggagttttttactgttgagttttgaaagatctttatatatgctggatagtagttgccggatatgtggttcacaaatgctttctcttactctgtagtttgtctttttatcgtttttactggttcttttgaagaacacaatttttaattttactgaggtccagttgatcagtgtttccttttatggattgtgcttttggtgtcaaatgtaagaattctgcctgtacttagatcatgaagattttctgccatgttcttctagaagtgctgtagttttacattttacatttatattcatgacactttttgagttaatttttgtgttagatgcgaggttcatttttttgcatgcgaatcttcagttgctccatcattatttgttgaagtcgtctttcctctgcggagttctttggtgcctttgtcaaaagtcacttgggcgtgttgggttgtttctgggttttcttttctgttccattgttctgtgtttctgttcctctgccaataccacacagtgttgattgctgtatatatacaggctttaatgttgggtaaagtgattacttcttgttgttttttagaaagttttatctactgtagttctttgtatgaattttagaataatcatcaatctctacaaaaagaatcttgctgagattttgataggaattgcagtaaacctgtatatcaattttctgtgtttagtcttccaatctgtgaacatgatatgtcgttctatttattga

SEQ ID NO: 36853 - DNA, 1057 bp, Homo sapiens
agtaggtctttgggcgagtctgtgagaagagttcttaatgagaactaaaaaggttatttctgttcttggtgtcccaaactgctctggtattttgccaaatactacagatagtaaaattcttaattaaagctgacatggttatatttttaaaaatttaggtgcaattagtctttcaagatcagaagatatttagttagtatcatagttcagtctgttccaagctgtaaagtcagttatttcagtaatgtaatttctaagatctataaaaaatgaaaatattttattttcttatataactttctgtgagagcattgaacagtcaagaaacttgtatgttttccagcccccattctgcttcaagttacatggtgtctagccttttcagctctagaaattctacattattatgtaatatcctgctttatgggtcttggtggtatatggtatagatcaactcaaaatttaaaattttcatcgtatgaatttttgtgtagagatttcaagatgagttgatctgagaacaaaaagaactccaaagaaatcttactattttcctgttggtatatattgttcaataaaacactatattggtatatattgttcaataaaacactatattggtatatattgttcaataaaataattatgtattacgaattaaattttcaacctaaaaatcagattattccaggaagatggaatagacagatgtacctttccttatttatcccatacatctgaaaccttgtatattataaataaacataagactctggtgagtcttttttttttttttccttcaagacggtcttgttcgttcccaggctggaatgcaatgatgtgatcacggctcactgcagtcttgacctccgaggcccaagtgatcctcccaccccagcctccaaaatagctggtaccacagtcctgtaccatgcaccactgtgcctggctatttttttttgtaggggtgggtttccctatgtttcccaggctccaactcctgggttcaagtgatccttctgccttggcctcccaaagtgctgggatacaggtgtga

SEQ ID NO: 36854 - DNA, 1029 bp, Homo sapiens
gtatcagagagtgccaagagctaggttattcatccacactggctggtaatgagcacctgccccatgccagcaataatagcggggaccatgtgcagaaagggctgctatccccacccagtaggaagaaggcatcattccccttttctggtaggttggtgttaagtggaggcctagtgcagagtaagaccatttacccctgcccagcagtaatcagaccacattccaaccccacagtgtcattggaggctacatagggagcaggaataagtcacacttaatacctcccaaccatagttatatcagtgtaggcctagtaagctcccagaaatttcacccacacaagtaaaatggagacccttatgtggtatctagatacgtcaaatgaggaacatgagcttctagtccacctggtcaaataagattcagagtttcataacataatactaaaaatgttcaagtttcaacaaaaaatcatgtcaagatccaggaagatcacttgaatgaaaaatgacaatcagtagatactaacaagttaatgatagacatgttagaattatctgacaaagatttttaagtagccatcataaacgtttcaaagagcaattatgaaaatatttgaaataaaaactctcagcaaagaagtgagaaagaaaaaatggaaattttaggctgggcgtggtggatcatgcttgtaatctagcactttgggaggctgaggcgggcagaccatggggtcaggagttcgagaccagcctggccaatatggtggaactctgtctctactaaaaatacaaaaattagctgggcatggtggtgcgcacctgtagtcccagctactcgggaggctgatgcagaagaatcacttgaacccgggaggcagaggttgcagtgggccaagatcgtgccactgtactccagcctgggcaacagagcaagactctgtctcaaaaaaaaaaaaaaaaacaaaaaaaaaacggaaattttagaactaaaatacagtaaccaaaaattttaaaattcactgcatag

SEQ ID NO: 36855 - DNA, 1026 bp, Homo sapiens
caacctggtgcaggtttcgacctcggggaatcttttctttttttccttaagcgatttcactgtagcacaactggaaaattgagattaaaacaatcattcaaaatctatctccatctgcatggcagcgtggatatgtgtataagcatagaaacactttgtactttgtttttaaacagaaatatgaatattagcagctttttctccatctatcttttaaaactgagtcatgagatgcatttggtaaggggtttgaagtgcacaaatcttaagccttgtaattttttactggcctaaacacccaatgaagatagagaatacatctgaaaaaaacattggaatatgttgacaccatctacttataccagattttaaatagagctacgtcattttaatgagtgtgagggaaagtatggatgtgtcgtattgaatcctctccttaggtttttgtgttagggttttcttttttctttttttttttcagtattataaacagtataggccatctggctacatacatctttgcattttgtcttattctataaatctcttaaagtgaaatttctaggtccagggtacagtaaggattttgatacctcctgtcttattccctccagaaaagttgcagtttatataaacacttgcagtgtaagagtgccagatttacccacaccaactgtgaatgttagtattctcttgaacttctgagaggtgcaaaagataggattgtttacatttgcattttgaacactaatgaatattttcacgcagtttgcattttgtattttaattttgtatctgatacataagcatgtttcctgactgtgcagaaacgtcacaggttcttatggtcacacatgaaaaccttttcttcacgtttgggtgtttgacatcactggcagagaagctgtctgtcccacgagattacaaaaatgtttgtagtttctcttagtactttcattttttgtgtacatttttatttttttccaaatggtaagcctttgttacaagttacttagtaattttttc

SEQ ID NO: 36856 - DNA, 1031 bp, Homo sapiens
cagcactttgagaggctgaggcaggtggatggcctgaggtcaggagttcgagaccagcctggccaacatagtaaaaccccgtctctactaaaaatacaaaaaattacctgggcatggtggcgggcacctgtaatcccagctactggggaggctgaggcaggagaatctcttgaacccaggaggcggaggttgcagtgagccaagatcgtgccattgcactccagcctggacaacaagagcaaaactccatctcaaaagaaaaaaagacttatcaagggataatttcacttcttattctttcacttaggcactttgtttaacccagaatactcagaatggttggagacatctgagtattgcttatttcattcacctttgccaatacagtactttttgacaaaaatacttttagtttatcatgtatttcaaatccattttcatcaaatacttagctgcagtttgggctcatttaatttacggaaaatggccatcaagctaatggcacatcttagggttgtgaatattgactggttgaacataattacatagatttgtagggagaaaaatttaattttctaaatttaggacacccaagcagagggttagagaccacccctctgccccaagaccaagcttaactgaataccataaagcagtaaaaggctggtcttcatgtttttgattacttaatcatcaagggcgacaccacctccatttggtgtatggaacctagggcaccccaggtcaccgtatcaagaggaagacaggttatggagtgagttgcccttctttagagggaggagaaagagtgcctgtgaaacttgaaaatctggaaattgagttccttaaaacatctgggcatacctagctttggcaagactgctgtatatgtattccaatttcaagaccactagatgatagaactgggcttggtgtcttctttaaagataaatctttacaaattgcttttatggttattgctgtcttcagagtttctcccttctcttgatgaagttttacaagttttattt

SEQ ID NO: 36857 - DNA, 1034 bp, Homo sapiens
tgttgttttttttgagacggagtctcgttgtgtctcccaggctggagtgcagtggcgcgatctcggctccctgcaacctccgcctcccgggttcacaccattctcctgcctcagcctcccgagtagctgggaccacaggtgcccgccaccacgcccagctaattttttgtatttttaatagagacggggtttcaccgtgttagccaggatggtttcgatctcctgacctcgtgatccgcccacctcggcctcccaaagtgctgggattacaggcgtgagccactgcgcccggcctgtattttttttttttagtagagatggtgtttcaccatgttagccaggatggtctcaatctcctgacctcgtgatccacccgcctcggcctcccaaagtgctgggattacaggtgtgagccactgtgccttgcctgaagggtatagcttttatccccttttatcctgagctttggggagctgttggaggtttttaaaaagtacactgaaatgatcatgcctggatttgagaaagctcaatctagcagccattcaggttatgagttggaagtggccaagaatagatacagcaaaagccttgaggagactagtctagaagtcctgcaagcctggatggggagtaggaagatagagtcaggagagatttgggaagtcaggttgataaaatggcacaaaggagagtaaccagtaaggtgtagagtgctctgtgggaaggacagccctcttgggatgggctttcttcctgcataggagctggtgaccagagccaaggcctaaactcctggtggcagggactgtaaatgtgtgaggggaataggtaccctaacccattcctcacttccaccccctcttcggggcatccgcagctgtagctgggccactgcccagaaaaaagagattattttacactacctagcaaaattcccagcctttttcctgcattgtgtttggtgaatctaaagattccctgatccctccatgtgcaggtcagtgtttttttataacctctcctccctttaa

SEQ ID NO: 36858 - DNA, 1036 bp, Homo sapiens
cccagctctttgggaggccaaggtggaagacttgcttcagcccaggagtttgagaccagcctgggcaacatggcaacaccctgtctctacaaaaaatttaaaagttagctgtggtgacacacacctgtactcccagctactcgggaggctgaggtgagaggatcacttgagcctaggagttggaggctgcagtgagacagagtaacaccctgtctcaattaaaaaaacaaagaaatgtgcttaatgaaaagcgtagccctcttcagggtgtgctctctgcatctccagagagtggaatgggaattagcttatggtttttgcctgcttcttcccttcgggcaagtaacacgccctttcaagccttggtgtttctttttttgggcacagcagttaatgtgtagaaaccccaggcctgggttctgagtctaagtggagaggaattctcagggggtgtagacactgttgacagagaaagtgaggagttcagtgcttcgaggtccctccactagtgaatgatgccgagagccagccaagcaccaaggacagagatcttgcttctttctccccagctgcaccttcctctctgcaagctgtgtgatgaggctggaatgaggagggatgggttggtgtgtttactcatctgccttgcctcttgtgacagcctctccttaggcaggtcctggacagcgtcctgcttctctatgcttttccctcagccatgagaagtccttccaggggaataagaggtcctcttgggcatatcttcaatgatttgttttttattcctccctgcaaattctttaattctccctctagtgatttaaatatacttttaccgatcattagctggaaaaactggaaagaaagaagagtcaggaaaaaagcccataacccctttactaagtgacaactattcttgtcattttattatttgatttgtattgttcccaacttttcttttttcttttttgagacaggctgtggctttgtcacccaggctggagtgcggtggcatgatctcagctcactgcaacct

SEQ ID NO: 36859 - DNA, 1027 bp, Homo sapiens
tcaccatgttgcccaggctggtctcgaactcctgggctcaagcagtccacccacctcagcctcccaaagtgctggaattacaggtgtgagccactgtacccagccactccatcttttcttaagcatttttaacctagttgatttttttttaatacaggtgagagcataccatataaccttttttccttattagtattatatcttaagtatgttctcaagtgattaaaagtttttgtaaacattttattgagtacatgtttgttttatgcttccactatgatgtaactatttccctaatagtgaacattcaggctgtttctaattttttgtgtctataaatctttgtccacattcagcaatatgctatcatttttgtagagggagaaaatctggagagggcagagatggctaggggcaagggcggaggagagattttactacatacattttcatgtctttggaatttggaaccatgtattattacctattgaaaacaaggaaataaaatatcaaacctgtgaacatacattgtcaactgtgaagatgccaaattaatgtttttaatttgaacaataagattaattttgatgttaagaactgtaaaaattttccttaatcagctttcagctgcaacagaccgaatttgctcacttcaagaagaacagcagcagttaagagaacaaaatgaattaattcgagaaagaagtgaaaagagtgtagaggtgagaaattgacctacatttgggcagcatgtttctcactcagacacacctattgtcaatctcaagctcatggcttaacaacaacccagtcttcagaatgcaaaggtgccttgcttatgtcagaaagggcctctcactgcggtccctgcccacatcactctcagaccacctggatcccttggacggggactcccttcatggcctgtgggcctttgcatgccaaagttcctactcgttcttcagcatccactcacctgccatgtcctccatgatgtcatcccaggagccgtgggcgggcctgggcc

SEQ ID NO: 36860 - DNA, 1024 bp, Homo sapiens
ttgtatttttgtagagatggggtttctccatattgatcaggctggtctcgaactcccgacctcaggtgatctgcccacctaggcctcccaaagtgctgggattataggcatgagccaccacacctggccagctaccgtttctttaatgacaataccaagtgctgatgaggacacggagctaatggatctctcatactttattggtaggaatgcaaaatggtgcaaccactcaggaaaacagtttctcaagaagctaaacgtcctcttaccatatgatccaaatagaaatgaaacttatgtctacaccaaaactagtacatatgtttatagcagctccgttcataactgccaaaagctagaagcaatcccaatgttctgcattgggtgatggataaacaaagtggtacgtctgtgcggtgaagtatgactcagccgtagaaaggaatgaaccactgccctttcaggacgttcagagaggaaacaaaaggcatgaaccattgatacacatggaaacttggattgatctccaagacattattctgagaaaaagtcagtctcaaggttatataatgtataattacattgagattacattctcaaaaagccaaagccatattgttgcaggacagatgagtggttgccaggggctgaggtggggagttttgggagtggtgggaccgtcctgtattctgattgtggtggagctgaatctccacgtgttaaaactcacaagagttaattttactgtatggtaattttaaaaatgaatttcagccagcaaaagtcatcctttccttacaaagatttgcttcatttgcactcttgctggtgtcgcatccaggttgcagcactcggagcgggcgaggcagggggctgaggagcggagccacaagctgcagcaggagctgggcgggaggatcggcgccctgcagctgcagctctcccagctgcacgagcaatggtaggggccctgcagggagcctgggctggggtgtggctcaggagggactgggaagaactgggg

SEQ ID NO: 36861 - DNA, 1033 bp, Homo sapiens
agggctttggcccgcatggagaagggcttcctcaggcctgtgggacgcagtgcccgctgtccatcaccttctgtctctccacaaggatcagcgtcaacaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcagatgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaaggtacgtgggggctccacccaccctcccagtgccctgagtcgttgcccgctggattcccctttctctggttccagaagcccatatcagagcaggctcactgcccggtgactgtgctgactgtggcagatgggcagccccgcctctcctgtttgcctgtgcagatggctttccatcctggcaccctctttctgggaggccttggccagtcataggcccctggtctccagcacatcctttcagtgattgacaatgatttttggggagatggggctccttgtgtgcagagctgctctaggggagtgtcattgaaaattctctgtatgcggcaggaacaaaatctggcccaacttaggcaaaaacaatctatggggaacctacagggcagcaggtcaccaaaaatcactagtgatctaggcagcgtgctt

SEQ ID NO: 36862 - DNA, 1072 bp, Homo sapiens
ctgtggctggtatagctcactccacattctcaaacggttttaaaatgtttttcttttggctgggcgcagtggctcacatctgtgatcccagcactttgggaggccgaggcaggtggatcatgagatcaggagatcgagaccatcctggccaacacagtgaaatgccgtctctactaaaaatacaaaaaattagccaggcgtggtggcgggtgcctgtaatctcagctacttgggaggctgaggcaggagaatcacttgaatctgggaggcggaggttgcagtgagctgagatcacagcactgcacttcagcctgggtgacagagcgagactctctcaaaaacaaaacaaaatttctttttctttgattttctttttgtagagatgggagtctcattatattgcccaggctggtcttgaacttcttgcttcaagcgatcttcctgccttaacctcccaaagggctgggattacaggcgtgagccactgcacctggcctaaaatatctttctgtaattcaatctgtaggtcaaacctgccactctaatgtagtggtagaaactgaatttcagttaatttggaggttttcctgtctttcccacaggggtatggcactgtcagcggaagactgtcagatctctgcagcatgaccctcatccttgttcccaaccttttctgtcagtcactgtctgcctccctttctttggttggctgcccatcaatgacctattatcatcattgccatagatccctgagaagcactccccctcccacagttgccattccaatcttgctacacagtataagagccctcttggcttctgagggttaaatgttgccatccagaatggttaaatgccattccagaatcgtgtcatccccaagacactaaggagccaagttccatggcagcatctcctagccacagagcacagccaccaccagctttctatgacaccagtgccccctcacgtccacattctgcattgccttagtgaagagcgcctcctctgggcagctccatgaaacaccttctggtctcatgtaataaatccgttctaacattcccacttc

SEQ ID NO: 36863 - DNA, 1050 bp, Homo sapiens
ttttaacgggtaccccctgtaaattagtgtatgaaagggcttttgtctgttgtaaagcactttacaaatgcaaaagtttgttggaaattgtatttgaatgccccacatctgtgtaaccaatcctctctatatgaggatgttgtgtatgtttcagttttattttgaaattttccagaaatggaatcttttaactgattttagggaaaccctttaatctctctaggctgcctttctttatctatgaaatgaaatagtaagttctttttagctctgcgatttaaaagctttaattttaaatgagagagtggttagtgatcttcatgaagtttgataggtggcaatacatttaactgattttgctctttatgtgtagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggtttgaaatggtctttgaatctattccttttacgtcttgagatgataaaattatgaagatacccgggtgcagggaaatgtagtctcaactactcaggaggcctaggacaggagtgtgagtccagccttggcaacacagggagatatcatctctaataaaatataaaagaaaaacatggtgaagataaatttggaacgttttcaaagggaaagcaaaattcgtgaaaatacttattgatctctctggcagcctttgtcttgctagaggccaattatatgggttgaatttgaaggccagctatgaaatttttgtgacagttgaaagcaaaccaggagaatagattctagataaaaaggcatgttgctgaaaatttaaatttttaattcatttatgtatttaacacaggttacttacaaagctccagttccaacaggggaagtatattttgctgattcttttgacagaggaactctgtcagggtaagtgttttccagagaaatata

SEQ ID NO: 36864 - DNA, 1765 bp, Homo sapiens
tatctgaataatatttgccaaataaagtgtgtttatttattatttatttacttttttgagacggagtctcattcttgccacccaggcttctggaatagagtggcgtgatcttggctcaccgcaacctctgtttcttgggttcaagcgattctcctgcctcagcctaccgagtagttgggattacaggtgcccatcaccacgcccggctaatttttgtgtttttattagagatggggtttcaccatgttggccaggctggtctcgaactcctgaccttgagtgatccgcctgccctcagcctccctaagtgctgggattataggtgtgagcgaccacggctgccccagtataatatatttatgcaactaggaggtgttttttttggcatttaaaggaccttcagaggtagagttaagcagtggaacttttttgtgttgtcttgtaggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtaagtgaaatgcttgttggataaaagctttctgcaaagggtaatcttagaagacattatgtaacttttactctatgttaaaaaattatgagattatataagtggtggtagggatttttgggtgaatttaaacaccttgtaattaatagtttttcctggctaatgcattattttgaaagaaactggttacttattttcctgactctaaataacttgtagattttgcagaacaaatttaccggaaatctgcattaatagtttttgtaattaattaattacaaaactagtaattaatagtttttcctgcctaatgcattattttgaaagaaactggttactcattttcctgactctaaataacttgtagattttgcagaacaaatttactggaaatctgcattaatgttcaatttaattttatttatttttgtggcatttgataactattcaaaaacaatagaagatggaatcctttgtaagggtaaacatttgacctatgataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgcagtggctcacgcctgtaatcctagctcccagcactttgggaagccaaggcaggcggatcacgaggtcaggagattgagactatctggctaacatggtgaaaccccatctctactaaaaatacaaaaaattagccaggcgtggtggcaggcgcctgtagtcccagccacttgggaggctgaggcaggagaatggcatgaacctgggaggcggaacttgcagtgagccgagattgcgccactgcactccagcctgggcgacagagcgagactccatctcaaaaaaaaaaaaaagagaattttgtaataattgtgaaaataaaggcttcctcccctgctgtttaactcttttgatgagttgggaaaattgactttgacgctaacgtgctttttatttgaagtgtaaattacaaagttgttaccaa

SEQ ID NO: 36865 - DNA, 1032 bp, Homo sapiens
gttttaataaattggaggtttgtgtaatttcagtaacgtaataataccagctctattaaaaatgaagaaatggaccttttgtactgggaagtagttgtaagtccacgtatttgtcttctcactggtgtatatgtgtaagcccaataattgtgttagtttatgtagtttcttgttttttttgttttttttttttagtgtctataagtcaagtctttggtgttaaagattttaactatcatttgctgtaattcttagaaagccgagggactaatcatttatgtttcgtgcataaggaaatgggcgttagcttccccaagaccccaggagccaggcattgttcttaccccaaagcctcaggtcagacttctgctgcttcacgttagaagtcatgatcttttgtattatggtaaagggagcttggaaaattaagtacttttaattccatttaatgtttctttcagtcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactggtgagtcttggggaactgtcttcaagtgtaagggagcatttcatatattccatgtggcttgaacaacgaaatgttggttgagtaagctctgataatttcagtaatccatgatgcagtctaatctgtagggaaaatatagagtactatagctggaaaggggccatagtgtaatcatctggattgactcaccattttacaagccacagaatgccacacttgataagagtttgtctgtggtgacactgttggtttgtggcagaatctcaggtcctttaacctggctactccagggcttctgtgaactcacatttaaagccaaagttctgaaatgctaaattttaatttgaaaaataacctttttcctatttaaacaacagtcaa

SEQ ID NO: 36866 - DNA, 1053 bp, Homo sapiens
tctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcaccta

SEQ ID NO: 36867 - DNA, 1718 bp, Homo sapiens
gctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatt

SEQ ID NO: 36868 - DNA, 2209 bp, Homo sapiens
gaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgc

SEQ ID NO: 36869 - DNA, 1035 bp, Homo sapiens
attccatattcttctttccctttgcccttcccacttgaacttctcatttactcattagcctatggtaatatgccttctacctcttctattactctgaagttgcctccgtaaaggacaccaaggatggacttgccaaatttattggcatcttttttttttttttggagacagggtctcactgtgttgcctaggctggagtgcagtggcaccattatggctcactacagcctcaacctcccaggctcaagtgatcctcccaccacagcctcctcagtagctgggactacaggcgtgagccaccacacccagcctcattggcatcttagtcatcattcttcgtgacttcttccttttcttagcttctcctctcttctgatttccttttcagctttctgactttttttctcagtctccttactattttcccttattaattcatgcagcaaatatttgagcacctgctgtgggccagagtacaatcagccctccgtatctgcgcattctgcatctgcggattcaaccaactgtagatagaaaatattttttggaaaaaaaagtaaaaaaataacagtacaacaattaacacaaattataatatgcagctcagcatggtggctcatgcctgtaatctcagaacttttgggaagctgtggtgggaggatagcttgagctcaggagttttagaccaggcttagcaatataacaagactccatctctcaaatagaatagaatagaacggaacggaacggaatagaatagaatagaaaaataaaaataaaaatatagctgggtatggtggctcacacctgtaattccagcacttcaggaggccaaagctggtggatttcttgagcccaggagttcaagaccagcctgagcagcatagtgagatgtcatctctataaaagcatggtggcatgcatctgtattctcagctcctcgggagaccgaagtaggaggattgcgtgggaccgggaggtaaaggctgcagcgagctatgattgcgccactgcaccttagcccctgggtgacat

SEQ ID NO: 36870 - DNA, 1079 bp, Homo sapiens
cggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggtaagtatgagcctttgctttctgttcctctgctgcagacacttcagtgaggttactcactactttggatgttaattggatccgaggtagttgtgggaagagggaggagggaatagctgctgtcatccttgctcctcttgggagtggaaatttataaaataaaccagggttgattgttaataaaaaatagggtaaagttccctggcatagcttgattattaactgcacgaaggtttcaggaatcacctgcatttagtccactgtctctttcgtgccgtaggatttaaattaagtaatttgcgactgtgttttgcagataaacattacgtttcacgtgcttcttagaggcttggctttttttttttttttttttttttactacctttcagatctccatgtacaaaattccctaat

SEQ ID NO: 36871 - DNA, 1060 bp, Homo sapiens
agtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttag

SEQ ID NO: 36872 - DNA, 1034 bp, Homo sapiens
cctggctaacacagtgaaaccccgtctctactaaaaataccaaaaaattagccaggcgtggtggcgggcgcctgtagtcccagctactcgggaggctgaggcaggagaatggcgtgaacctgggaggcggagcttgcagtgagccgagatggcgccactgcactccagcctgggcgacagagctagactctgtctcaaaaaaaaaaaaaaagaaagaaagaaagaaagaaaagaagaagaacagagaagcagagagaagccaggccagctgccccagtaaagactcaggttctcacgatcccaggccacttccagactgaatcagttctcagctgtacagcaggtgatctctgccctacagggatctgcacccatttactcaggaaactgtcttcttactatccagttttgagagtttttatatattttgaattcaaagtatttttttaatcatatatatgattcacaaatgttttctctaagtctatggtttaatttttctatttttttatttttgagacggagtctagctctgttgcccaggctggagtgcagtggcgcgatctcggctgactgcaagctccgcctccctggttcacgtcattctcctgcctcagcctccagagtagctgggactacaggcgtccaccgccacccccggctaattttttgtattttttagtatagacggcgtttcaccgtgttagccaggatggtctcgatctcctgacctcgtgacctgcccacctcgtgctgggagtacaggcgtgagccaccgcgcctggccctctctgtgcctttttttttttttcttttcttttcttttttttttttgttggagacggagtttcgctcttgttgcccaggctggagtgcaatggcgcgatcttggctcactgcaacctctgtctcctgggttcaagcaattctcctgcctcagcctccggagtagctgggattacaggcatgcaccaccatgcccggctaattttgtatttttagtagagacagggtttctccatgttggtcaggct

SEQ ID NO: 36873 - DNA, 1077 bp, Homo sapiens
cccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaac

SEQ ID NO: 36874 - DNA, 1034 bp, Homo sapiens
ggccgctggggccgcaaggcgtgcggggaagggccagagccgggtgtccaccccagcttcccaaagactccctcttctgtgcttccttctcccctccccgccccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagacctt

SEQ ID NO: 36875 - DNA, 1121 bp, Homo sapiens
tggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcc

SEQ ID NO: 36876 - DNA, 1079 bp, Homo sapiens
gttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggca

SEQ ID NO: 36877 - DNA, 1034 bp, Homo sapiens
caggaggagactgcgcttggtggcgggatcacttagttgacaacatctaaaaattaggaggtgcggcagggcgcggtggctcacgcctgtaatcctagaactttgggaggtcgtggcgggtggactacctgaggtgaggagttcgagaccagcctggctaacctggtgaaaccccgtctctattaaaaatacgaagcaatgagctgggcgtggtggcgggcgcctgtaatcccagctactcgggaggctgaggcaggagaatcacttaaacctgggaggcggaggttgcagtgagccgggattgcgccattgcactccagcctgggtgacagagtgagactctctcaaaaaaaaaaaaaaaaaaaaaaaaaaaaaaaaaaaaaaaaagggaggtgctcagtcaagcctctgagaggagtggggggcggggcgaggagtctcttgctcagagccccctagggactgggacccgttgactctgagctgcttttgaggctggatcaggtaccagcggcctgggggtcgtacaggatgggagaggccggggcttgggatgttgccagatctacgttgaaaagtgaagcaggaagagaggcactgaggctgggcacatggggaaaaccgtggagagccggcctttggggactagaagagtgggaacaatggttgacaaatggtgagtgtggtgtagaacagcagtaacacaataccaggatccacagagtggccagggccagagtggggagaaggaacaggactctgcagatggggagggtaaggggctgggtggcgtgaagggtggttgcagaatttggggagggcagctagcctgtgacccaggttccaagggcactgaggtctgggccaggccgcttggaggcaccagagcctcagaggaggggtggggtagaggaacggatccagcatggtgtcccccttggccaccagagggagttttctaaatttgagcatggctcatcgctgcttgaaattctacgtcacagtgtggcctgcattgaggagggcccacacct

SEQ ID NO: 36878 - DNA, 1030 bp, Homo sapiens
atgcctggcctggatctatttttaacttggatatggtgtcttctgagtctgtggtcccttaagggactttagggctatgcccagttgctctataatacagggtcatttaaaatcaaagtgtcagtatgttttggaagaagttaaaagcagtcaaaacaatgaaagttataaaatgttactcatgaaagttcaggtgttgagaatacttgtcttctgagttaggcttaggcaggctatagaccttaagctggaaaattcaaccctatgtccacttgaaatcaaagccaccaagcttaaaaagttaccagtatcctgatggtttgctaggatatgggttgtaaacattttgtgaaattttggggggaaggcagttttctctctagtaaattattggaattggaatagtgagactagcttaaggtctaagaagttctcatacaactgttaatttatacagtcagttctgctgtaaagcaacatacaggttcctaaaaatcactgctttgcagaatcgtgcagtagaaatgacttacaaatggggttggggtacagcactctaaagctttatcagtgacacatttaaaaaaggaacctggtaaaaatgatagaacagttttacacgttgaatggttaagaaatatatagatactgtaataaatgtggcattttctttgaaaaagccctggtttgcttgtggaaagggatgtcagaaaggttgctgctggtgagttactgtgaagtggtagaagaattacttataatcagatggaaggttgtaacacgagaagcaaataggtgtggctcttaacccataataaactgacttagctggtgggtgtttgaagtgtgtttcatgtatttctacacagttcagttcggctgggtgcaagctttctcccttcatctagtgtttatgtgacagaatagcacataaataaacaggaaatatggattgtgctcaaattgttctctaatttgtgtatcaatcacagtggaacaaattcaccttttcttttctttttttttcccc

SEQ ID NO: 36879 - DNA, 1034 bp, Homo sapiens
gacagagcaagactttgtctcaaaaaaaaagctgggtgtggtggcctgcacctgtagttcagctacttgggaggctgagatgggaggaccgcttgagcctggggaggttgaggctgcagtgagccatgattgtgctactacactccagcctgggcaacagagtgagaccctgtatctgaaaaaaaaaataattttaaaaataaaaaatttttttgagcgacaggttctctctctgttgcccaggctggccttgaactcctgggctcaagcaatcctcccacctcagcctgctgagtaactaggattaccggcatatgccactgctcctggctccatttttaacatatcactgttttccttcttccctttccatcaaaagcatggcttggaactcatttctcttaatctgttttgaaatttgtagtttcattcagctgtcttctcttgtaatgtgtgaaaattatgaactgcaataaagacaggatctttggaaagatgagttgtattgtattttagtctacttgtgaaagctgtggatttcagaatggtctttgaagaatactcagcaaaacttcattattgttttgtttagtcttgctttgtgtaaggcattcatggttctggttttgtgagaaaacagcttgtgagcagacccactgtggaggctaggtgggaaggaggtgggtaacatttaacttaaccttgaattatagatagaatttcagtgtgaaaatggtatcactaaatgcttggagatagggaagagtggagcgtatctgaaggatggcagtttgtctgccagttgcatcaaaagatatagaaggaaatattgggacagaagtctggaaaggtggaatattttgaattctcaactgcggagtttgaattcttctcagcagtagagatcttaaaggggaagagaagggatgatatagaatcatcattttaagtgggtataggaccagaaatcattacagctaaacattcaaattttattactatttttattcttatttatttatttttgagacaga

SEQ ID NO: 36880 - DNA, 1044 bp, Homo sapiens
cattttttcatgtttgttggctgcttgtatgtcttgttttttgagacagggtctcactcttgcccacgctggagtgcagtggtgttatctctgctcactgtggcctggacctcctgggctcaagtgatccttctgccttagctcccaaagtaggctgaggtgggagagggcatggaagctctgcacccctgcgctgttcctcaccctgtatacaacttcatctgtctgttcatctgtatactttaccatatccttataacgaaccagtgaatgtgtttgcccgcattctgtgagccgttctaacaaattaatccaactccaggagggagtgttgggaacccagctttatagccggtcatcagaagtgtgggtgatgaccttacttgtgtctgaagaagagaggggcagtattgtgggactcagcccataatctcagtgggatctaactccaggtagatactgtcaggattgaattgagctataggacactcaggtgtgtggtatatgctggagaattgcttggtgtgtggggaaaaaccttcacacatctggtcacaagcgtttgtgttaagtgtgagcatagaggaaaaacagtttgtcttttacagttgcttctcaggtaccccttttcttttccccttagatgttcattttgaaggttaagtagagatggcttttcttttgcttactggggtggggcagggggttgtggcatatctgctggttaggggctgttaggatgggtggatttcagttctggtttttactattttgtaactacaaatccttttcccaggggcacactcaaatgtttgattgtccctaatttcactgaacatgtttgattcctgactgaaaaatagaccagaggctctccccctttcttagggttctcttttcaacaactatttcttttcacctctctcctaaccagaggaggttcaaatatatttaagtgctttaaatgtaactttttctgcttggtctttgtgggtatcttcattccagttggttttcttcactttcatttcttttcactttact

SEQ ID NO: 36881 - DNA, 1053 bp, Homo sapiens
gagggagtcacaagtacggttttcttaccggatatattgtgtagtggcaaagtctggccttttagtgtactcattgccctaatagtgaacattgtacccaaaaggtaactttttcacctttttcgccctcccgtgttttggaatcttcagtgtctgtttttccattctgtatgtgcatgtgtacccattgtttagctcccacttgtaagtgagaacatcggtatttgactgtttctgagttgttttgcttaggataacggcctccagttctgtccaggttgctgcacaagatatgctttcattcttttttataactcagtagtatttcttggtgtatatatacactgcattttctttatccagtcatccattgttggacacttaggttgaggccgtatctttgctattgtgaatagtgctacaatacacgagtgcaggttatctttttgacatgatgatttctttccctttggggatacccagtagtgggactgctggatagaatggtagttgtatttgtagttctgtgagaaatctccatactgatttccatacaagttgtactaatttacattcccaccaacagtgttcaagcgttcctttttcttcacatccttgccagcatctgttgtttttgactttttaatagtagcctttctgagtggtgtaagatggtatttcattgtggttttaatttgcatttctctgatgattattgatgttgagcatttttttcgtatttgttggcaatttgtcttttgaaaaatattgtttcatgttctttgcccacttattagggtttttttttttttttttttttttttttttgacagtctcactctgttgcccaggctggagtgcagtggtgtcatctcggctcactgcaagctctgcctcccacgttcacaccattctcctgcctcagcctcctgagtagctggtactacaggcacccgccaccacacccggctaattttttgtatttttttttagtagagatggggtttcaccatgttggccaggatggtctcgatctgctgaccttgtgatccg

SEQ ID NO: 36882 - DNA, 1047 bp, Homo sapiens
atggggtttcaccgtgttggccaggctggtcttgaactcctgacttcaggtgatctgcccgcctcagcttcccaaagtgctgggattacaggcatgagccaccgcatcctgccctcattaagctttttgtatctgtgagtttagagttttcatcaaacatagacattttctgctgttttttcttgtgtaataccttgagatacaattcacacactgtacagctcacccatttaaagtgccagtttagtgggttttgtatattcacagagttgtgccacatttgccacaatcagaacattttcatcatcccaaaaacgaacgctgtacccatttagcagtccttcctctgacatttaggaacgaagtctagcctcagttctgtgtgaacttgggggttgctgcctccaccatcctttcaggtgtttttttccctctggctcaggtagtttctcacatgcatgtgtcgatcaataccctgttgacaacttgagccagggagtggggggccccatcagatctccagacttctctctgttctcttctcttctctctgatgttctgcctcttgatttctaatcaccttggcttccctggactttctgtctctggaactcagggaggatcactgtcctctacctgggattcccctccttgggctgcctcctgtaagtgctgtccaaggagtaagctgagacagttatagggtctaccctgtttgtttcccacccttcaggaatgactctcctgcattggttggtgtctcatcttagaaatttgctgattcatgtatattatctgatacgatggttgtcacaggtggcatggtaaatttagttcctgttactcttatcttggttggaagtctcaaggtcgcgttttcttcagccaatagaaaattaatcagttctgaaagactggtatgtttttattacatttgtttcattctctctcagattagatcctgaaccagtaaggagattatggggaacattcttagattgtagaaaccattgacaatttatcaagaagtgtcaaagtgcagattta

SEQ ID NO: 36883 - DNA, 1368 bp, Homo sapiens
tcagtgtgcaggttattgtgtgaatatagttattcatttctctaggataaatgtccaggagtgcagttactgggtcatttgagggttgtatatttaattttttaagaaattgctaagtggttttctgtagtgtaagtactgctttacattgtaaagtgattcactttctctgcatcctcaccagcatttggtgttgtgactgtttttatgttagccattctggtagatgtgtagtcatttcatggttttgatttacatttccccaataaagatacccaacatctttgcaggtgcttatttgtcatctgtaatgtttttcttctgtgacatttcttcttgtcattgtccatgttctaattagattatttgcttttttactgggagtcctttatatattctaggtacgagtcgttggtggaatatgtggtttacacatatttctctcagtatgtagctttttacaaggtcattgcacagcaaaagtttttaattttaatgaagcccagtttatcagttttttcttctgtggatcctgattcttgtttcaagtctaagaactctttgaatagctctaagtcccaaagattttcctcttaggttttcttttaaaagttttatggtcttatgttacatttaagtctatgatccattttgacttacgattgagttaaaagatgtgaggattagctcaaggttctttttgtgtgtgtgtggcctgtcgatgtccagttgctccagcagcattattgaaagatgatcttaccttcattgaattgcttttgcatctttggcaaaaatcagttgagcatatctgtgtgaatctgtttctggattttttattctgtttcattgatctatgtgtccatccttccgccaacatctgcaaaaccagttctgaggccccaggaaggaatcggctctttgagcctcagaagggtacagctgtgcgtggccacagggaacacactccaggctactggggtctagtgatgaggcacttttgtcaggacgtggtccacagagaggagaaaagaaatgttctttagtctcagaggccaagacagacgcatgggaggagagggagatggcaaggacctggataactggaggcgtgatgaatggagagtctggtgcaggatccatgccacgggaggaggcccctgtggagagtgagaccttgggcggttagggctggccggactgggccccctgctcctcacagtgtgacctaaagccgcggcctggtatctagtgctttccagcgtagcccaggaaggcgcgccctccttcggcagaaacaccttaaaaaaaaaaacaaaaaacctgctattgctttttagacagaaacaatatggagacttttatttc

SEQ ID NO: 36884 - DNA, 1069 bp, Homo sapiens
acttcttcactgctgggcagttagggaagttcatctaaaccatgagacagtgtccggttggcagtttctacctcggatgcgaaacgccgactacagttggggaagggtggggcgtctgctgccctaacccgcgaagcgctttctcaggccccgcccccggtccgacccggacgaccctctgagtcctccacaacgaagtcgtctgcctagaagggccggaagtacttcagggcgcgccgcggacccaccccctcgcttccggcatcggctgtggggagtaccggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtcc

SEQ ID NO: 36885 - DNA, 1030 bp, Homo sapiens
ctgagagggggccagtgtgtttaagctggggcaggatttagtgtatgttagcactgcagagacctaatatttcctagtctagtgttttctcagcacaccccgacccccccgctttttttgttgtttttttccattattgctcgcccttctccaaggagtcttttaagatacattttccatccccacctcccgcctgttttcataaccccagcaggtcctgctgggatgggctggcactgtgagcttcatagaccaagccaggacctccccttctgtccctcttccctcctcccttcccagccagtgcctgggccttgccactacccagggcccatgctcactgccacctgaacgttagggactctgctgctggcgactgctaggcactgaatggtaggatctgtctgggagtaggaagtcatcgtgcttctggccagctgcccaagttgatacttttgggctctcctgggtatagaggtaacaggagctgtgtgcccctggcatagagtgaagctgactgtggcggctgttccctcacgcgtctggtcagttgggaccctcctctggcctgctgctcacagcgtctgcagccgatggtagctgtgtgaaaagtgtgcctaccacccaggaagggccatccctggcaaatagggtgggactgggcaggagttttttctgttacaggatattaagtccctacataatatccttgatttttgcctcttagcccacaaagcataaaaatacttactatctggaccttcacagaaaaagtttttccgagttctgatctggggcttttgggtgactttcttaaggtcactgtgtttaatggcgtcgggaccctaacttcatgttttgattcctgaattcttttatttattcatttcaaaaatttttaccaggtgcctactctgattggtactatgtcagggtccgaggaccctggcaaacaaagacattcctagtccctgtcagtgggagctcatggtacagtgggggaaaggatgttaacagttacgtcatttaa

SEQ ID NO: 36886 - DNA, 1025 bp, Homo sapiens
cgaggtcaggagatcgagaccatcctggctaacacggtgaaaccccgtctctactaaaaatacaaaaaattagggcgtggtggcgggcgcctgtagtcccagctactcgggaggctgaggcaggagaatggcgtgaacccgggaggcggagcttgcagtgagccgagatggcgccactgcactccagcctgggcgacagagagagactccgtctcaaaaaaaaaaaaaaaaaagtcccaaggagaaattggagaggctctcctatgaaaatccatctcaccattccttttctgaggagtccacaggacctgtacagttggaaccagcccctcaggcttccctgccagagcccttttctccaggagcagaggcatccatcccctcctgccagcattccagaccctggagggcttgcgcggtggcaggttttcccttgaatgctgaggcgaggctgagggaaaggtgcgtggccaggaccagagggcctgctgactgccagctaaaactctgtgcaggaggctttcccacgtactttacgtactttaagatgatgagcaaaatccttactgtctccctgcaaaatccgtgtggcttcctctggcgtgtcccatactcttgtgtttgtggccagactgggcctccgctcttcctccaaactcattagttctctcccacacagaacacacattgttctgcctggaaggcccatcacatccctccccaaccctctcggttcaatctaagctttcttggggtctcagcttaggttgcctgttcagggaagcctctgggaccctcaggtctaggtcacatttgtttcatgctttcacagcggtggtgtagtgtatactggttcttcttatccctcaggtgtctcctcacaaggactgctctgtttctgctaagtgttgcattctcaccacccagtggaggctttggcctgtggaagattctaattttggtggccagcctcatgggttgaaaagtaaaggtcaagtagttaaaggaagggcgttccaggcaga

SEQ ID NO: 36887 - DNA, 1035 bp, Homo sapiens
ctacctcaaaggagataacagaaaaacaaggagtactgatgatggaagcatctggtccctcttgcagagtgatgaatgattttattggtggcagctgggtggcaggacaatccaggcatccagttatgcctgatccccaataagtgaaatctttgttcattttctttttatacacccgtctgcttcctaaaacctgacaccatttaatggtgcccttggtcaaatctaaatgatcttactttcataattctttgattctagcttgcagagtcaagacgaactctaactcatgggatggacaaactggaagatgtaaaataagtaaggctttctgggccaaaaagcctcttcttacagaaaatcaaattttaaaagaacattgacctcaaaacaataaaactgtcctggttatgcaatagaaatagctatataaatggaatcatatccttaatgaacacctcctgtggctacccaacttttcacacatcttactgattataggccttgctgtgaatgctttcttgctctatctgaagtattcccaccagagttgtttccaactttatttcctatattatgaaaaatgaagtttttttaacattgtaacaaagtatatgaaagataatgtatactgtattaaataaaccattatacaaaaatagttccttgtactgttaactattattatgactttggtcagtaaaattctaaatcatgcgactataatttacatgtttaccaatggaaggaagtgacaatgaactgcctaaagaatgaaagagacacccaggcatggtggctcacatctgtaatcccagcactttgggaggccgaggcggggggatcaggaggtcaagagattgagaccatcctggccaacatggtgaaaccccgtctacactaaaaatgcaaaaattagctgggcatggtggtgcgcacctgtattcccagctacttgggaggctgaggcaggaaaatcgcttgaactcgggaggcgtaggttgcagtgagccgagatcgcaccactgcactcta

SEQ ID NO: 36888 - DNA, 1059 bp, Homo sapiens
actttgggaggcccaggtggtggatctcctgaggtcaggagttcaagaccagcctggccaacatggtgaaaccccatctctactaaaaatgcaaaattagctgggcatggtggcatgtgcctgtaatcgcaactactaggggtgctgaggcaggaggatcgcttgaacccgggaaacggaggttgcagtgagccgagatcatgccattgcacttctgcctgggcaacagagcaagataccgtctcaaaaaaaaaagttagaagagaaatggaaggttctctcttttcctcagcttcagtatactaaaacccagaagcataggacataagttttttccatgggatactttagttatcaccttgggtgaaaacatggtactaggatttgtccttcaagtcaggttaatgtaacagaggtagcagtgacttatggttagatttgtgccttaactgtgcacttcccaatatttgctataaaatgggggcaggggggtgataataatatctaatacatgaagcctgtaggacagtgctctgtgtttgtgttttgactgcaactcaaagaaagcaatatatttttagatgaagtatatacatgtatatatatataacttaaaagtttcataaagcagtacttacccttactatgttccatgtgttctaatattttctcttacttcattttgagataatgctaggcatgacccatttattttaagacacactaattggtcaaaaaacaatttgaaaaccactgctataggagaacacgaggaaatatattttataaactgtaaagcactactaagacgtgagcagcggctgctgcatatccaggtcaacctttatgggcctgaagacaacctctccttcgtttgggcactgctaggagtcaaatctacctagacttttggtaaggaagatggtactcatgctcattgtcattgagacaattatctaatgcttagaagtcaagactagaaagcaaggcattaaccatatcagcacccaaacaagggaagacaagttacaagaaagccaaataaaacagcaaacattt

SEQ ID NO: 36889 - DNA, 1146 bp, Homo sapiens
ctgtgtcttgaggctgaacttcttaacccactttatttttatgtgtccttatcagaacataagcagtgtctcaaactcaggccgtttactagtcgccaccgggcaaagctaaatacaacttttataagaacctggccaacggtagttgaagtcgacccaaacattttaaactttgccaattgtactagagccggagcaggcaaatggtggtagatcttcttagcaacaaacagttagaagacggaaagggctagggttagggtcttttggtcacccagcccttacctggttttcagataagaacttggcctgttacacattttcacgtagaagtgatcttcttggtacagccgaggtcttaagcttttactgaaacactatccttagctgccttatgatttaagtgaggattatagaacttcagccctaactttttcattatgtgtatttttcttcattcatgtcaggttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaa

SEQ ID NO: 36890 - DNA, 1078 bp, Homo sapiens
tgcagagatcacatggagagagaggaggcgaagggctgggggaggctccaggcccttttcaacaacaaggtctcatgggttggttagagcaagaagtactagagcatgaactcactcccttcagagggagggcattaatctgttcatagggggtccagccccatgacacaaacacgtcctatgaggccccatctccaacaatggagatcaaatttcaacataaggtttggaagggtcagatgtccaaaccacagcaaagagcaagctcccagggcagagcttgattagtgattgaaacaagatggctcagtgtgttttatagaagcccaaactcagccaaccacagcttgtctgctgaagttgcagataatttcaggtcacattctttatcattttcatgctctttatcatttgcattatttttgaatgaggctaaatcatttcaaaagcatctggtcttcctagggtgctttcgaaatgaattagcctcattcaaaaaaaaaaatattcaccactaaggttttaaacagcaaatgttcgctgtgataacgtcttagagttgtgaattactgtagagcacacaaaacacttcttcagtattacaccttacccctccaaagtgcctgtggtgtaggagtcagtcactcctatctctagaaaaggatggtggctaggagagttgtctgatttttacataatcccagaaagtacttaaggtagattttaaagatcgtggaatacagaccgatggcataaagggaaaagggaggggaaagaaagaaggaatgaaatgaagccagaggttctagtcatgtggcaagtcacttacaaggatcggacaatgctccgaaactgagcaagttaagggtgtgtgtgtgcacgcgtgcgcgtgtccgtgtccatgtgagtgcgtgtgtaaatattcttaaaggcattaatgaactgaggagacataaggaattctcaggccagggttgaaggcacagaggaacccaaagagaaatctagtggggagtgcagctggcctttgccctgagggcatttgtgaaacctggtcaacttcattttcaccttttca

SEQ ID NO: 36891 - DNA, 1045 bp, Homo sapiens
gccgtgtgcagaatatgtggtctcgggtcccccaagctgaggttaaggcagtattcagaatagaagcactctgtgtccaagggtgctgctcacatgggaatgatggtgggtggagcacagaagagagatggagtgagaggcaggaatgcttcccagctgtgggtgacagagacagatgggtaccaaagtgggagcccccagcactggagcaccaccaagaagctgcggtgatgggcagatgcccagggcagggtctgaagtgcccagaacatgcagcgagggacagtgctgtgataaaggatggaaggagattggtagccatggcagaagccacatgctgtgtttttaaaataaaatgctcaggaaggactgtgtgtgggagacagatgggaatagacgatgtgtgtgtggtcacacgtacaagtgtatggtgtgtggttgcacatatgtgggggggtgtggttatgtgtgtggttttgtgtgtagtgtgtggtcagttgtatatgtgtgtgaatggtgtgtgtttgttacatggactctgtgtccatccttcacaggaaaagaccagcgcggctgccggctttagggccacatatttctgttcctgctctggggtcagcttccagtggtttctgctgggtcattatttattttttagagatgagatctcactccatcacccaacatggatggcagtggtgggataatggctcactgcagcctccaactcctgggctcaagcaattgtcccacctcagcctcccgaatagccgaaagtacaggtgtgtgccaccacacccagccaatttattttttgttttttatttcttaagagatgggatctcactctcttgtccaggcttgtttggaacttctggtctcaagtgattccccaggctcaggggaattagaggcgtgagcctctaatagcacagggattagaggcgtgagcctccatgccaggccacaggctggtccttttgagcaggatttgtgagggggccagtttctggaggttacaggtgacttgtccttccctgtgggg

SEQ ID NO: 36892 - DNA, 1026 bp, Homo sapiens
tgaccccatgtcaggccgtctgctcccatctcccagcaggtgggggacctggttctgctcccatcttccagcggcaggggtcccgggtctgctcccgtctcccaaagagggggaagcccgtgtctgctcctgtctcccagtgggtaggggacctgcatctgctctcacctcccatcaggcggggactcatgtctgctcccatcatcttccagcgggtgggagcctgtgtctgctcgcatctcccagggtgcatgtccatggggcatgtgggctctgcactacctccagctgaccatggcattcagttgagaaaccccaggccccctagggtcactgagacatggatgtgtggggacaaaggggcctggggaacagttggcctgcgttcggtgccttggggcactggaaccatatttctgaaagtaggatgtgttatttctcactagagccttcctcagtggggaagtggtgacactgtgtccggaactggtgggttcttggtctcaccaacttcaagaatgaagccgcagaccctcgcggtgagtgttacagttcttaaaggcggcgtgtctggagtttgttccttctgatgtttggatgtgttcagaatttcttccttctggtggtttggggtatccctggttcaggaatgaagctgcagaccttcactgcgagtgttagagctcataaaggcagtgcggagccaaagagtgagcagcagcaagatgtattgcaaagagcaaaagaacaaaacttccacaatgtggaagagaacccaagcagtttgctgctactggcttgagcagcctgcttttattcccttatctggccccacccacatcctgctgattggttcattttacagagagctgattggtctgttttacagagagctgattggtccgttttgacagggtgctgattggtgtgtttacaacccctaagctagacacaaaagttctccaagtccccacagagcactgattggtgcatttacaaaccttgagctagacacagagtgctgat

SEQ ID NO: 36893 - DNA, 1056 bp, Homo sapiens
ctgagcctagcacaggtggtgcctgcccagcaggggcgcaggggccgcgggccggaccgttctcacgcgtcgtgactcccacccgtccgcatctctgctcacgcacattctcttccgccaggtctgaaatcgcctgctggcctccctctgacctgcctcagtttctcctcttcactcctcgctgcctgatgtgtcattgcttatttgtttatcacttgtcccaactgaaggcctcacgagggcaggacgttttatgtcccgctcagccctccaaggccaacctccaagcttatcaaaacctcatgcaaagcacgtgctgatgggctgggaagtcctgcgtgagccctgaaggtggctctgaggggcttccctcatccctttgctcccaggcgggccccacggggtgcaggttctcagatgactctctgaggtgtgtgaataagggtctctgttcaggcgcatccccacaggagatgagaccacagaacgcagccctgagtttgaagcatcccagaaggttctttctctctgacccgcacgcccaccactgttctgggtgctcacaaaacccaccattgcttctggtaatttctcagctgctcctcctgtccagcgacccctgctgcagaggcccaggggaaacacaggccaggcctgtgagaagctcctgtttcaaagaaatgttgtcagcgataaaactggaaacggttcctggctcgacacctgacccagcctttccacccccaggatcctgcccccagacggcccttccacccccaggatcctgcccccaccaggatcctgcccccacgcggtcctgcccccatgagaccctgcccccatgcggcccagcccccaccaggatcctgcccctgcatcctccgctgggttggcatctgcatttttggtgtcttccagggaaaggggtgagtgggtggggcctgaggcccttaaggtcttcagtgtagggagtgcccctggatttttttccggctgttttgggggaatttgtgggatctcaagttcagcaggggccacactcaggacccccacgat

SEQ ID NO: 36894 - DNA, 1065 bp, Homo sapiens
tcccttgtctccccagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgagtatgtcccccaccctaagcccccgatccccccaaggctgggtggtcagagctgctcatcttacacctctacttgagtatgtccctaaccctgagccccccacgcctggggccagagtctttgtcccccgtgtgcgcatgtgttcagggtcagcctctcccagaagtgagatcatggacaaaaagggcaaatcacaggaagaaattaaatccatgaggacccagcaggcccagcaagaagctgaactcacgccgagacctgcaggagtggtgccaggtgcttgaagtaacaagtttaaaatgttcagagacaatggaatggaatctattaggcaagaacaggacattatgaaataaggacaggtggacttccaaaaacacaagtagaaattctaacaatgaaatatattacaggcaggtcacccactaaccaaacaactgaagcgagagctggtggtcttgcttggtctcacagtgggcacagcggtaggcggtcagtcatgttgctgaacgacggagggtaaactccccagccccaaggaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggtta

SEQ ID NO: 36895 - DNA, 2042 bp, Homo sapiens
tcatatacacagatggaaacaggaaagactgaggaggtcatggcatcttaaagacctgatagggtgggatgggcacctgtggtctctggggtctgtggcaggggctggttctcatgtgtggtggtgcagagaaggatggagtcccagtctgagaagggggctgtctccacatccacagatgggggcagacaggaggcgcctggggtccaccacacaggattgcgctgcaggccccggtgctgggcagccagttccccgggcatcggtccggttgtcataacacaggggggcccatccagccttagtcgtgctaaggggacctgaacccaacattacaagtcttcagtgtcatgactcacagatgctcctttcacttgaattgtgtgtgggagtgtgtgtgcattgtgtggtgtgtgtgggagtgtgagcattgtgtgttgtgtgtggtattctgtgggggttgtatgtgtgcggtatgtggtgtgtgtggtttgtgtgctgtgtgtggtatgcggtgtgtagtgcaaatgggtgtgctcggtggtgtgtggtttggtgtgtgtgtggtgtgtggtttggtgtatgtgtggtattttgggggtgtggtatgtgtgcagtatgtggtgtgatgtttggtgtgtgtggtgtgcagtgtgtagtgcaagtgtgtgtgctctgtgtgtggtttgtgtggtgtgctgtgtgtggtgtgtattctgtgtgcgtgatgtgtattgtgtgtattgtgtggtccctgtgtggtatggggagagtgatgcgtttgtggttggtgtctggtacttgtcacgtggtgcacgtgcagtgtgtggtgtgtttggtgtgtgtgttttgcttctgttgcatatgtgtggcgtgaggtgtgtgcgtgtggtttgtgtggtgtgtggtgcatgtgtggtgtgcatggagttgtgtggtgtgtgatctgttttgtgtattgtgtggtgtgtgggtggtgtgtgttgtggattgtgtggtctcgtgtgtttcgtgtggtgtggtgtgtaatctgtatgatgtgtgttgtgtggtttctgttttgtggtttgtgttgtgtgtctgtggtatgtgttgtgggtggtctgtgttgtatgatatatgtggtatgtattgtgtggtgtgtggcgtgtggtgtatggtgtgtgtggtgtcttgtgtgtgtgttgtgttttgtgtgttgtggtttctgtttggtgtgtgttgtgtgttttatgtggtatgcggtgtgtggtcagtgtggtctgtgttgtgtggtgtgtggtgtgtgtggtacgtggtctgtgtggtatatggtgtgtgatgtggattgtgtggtgtggtatatgaacgtgcttacaggccacggtggtatcgaggctgagcgtgggcctgaggggaaggagctgtcctggagtcttctctggctgatgtgacgtccgtgtcccctgctcgctgtcctccatggggtccatgccccttgcttgctgtcctccgcggggtctgtgcccctcgctcactgtctgtcctctgtggggtctgtccccccggctcgctgtcctcggtggggtctatccccactgctcactgtcctctgtggggtctgtgcccctcgctcgctgtctgtcctctgtggggtctgtgccccccggctcactgtcctctgtggggtctgtccccactgctcactgtcctctgtggtgtctgtaaccctcgctcgctgtcctctgtggggtctgtccccgctgctcactgtcctctgtggggtctgtccccccggctcactgtcctccgtggggtctgtccccccggctggctgtcctctgtggggtctgtgccccccagctcactgtcctcggtggggtctgtccccgctgctcactgtcctctgtgcggtctgtccccccggcttgctgtcctccatggggtctgtcttgccggctcgctgtcctctgtggggtctgtgaccccagcttgctgtcctctgtggggtctgtccccgctgctcactgtcctctgtggggtctgtgccccctggctcgctg

SEQ ID NO: 36896 - DNA, 1106 bp, Homo sapiens
tgttagcttaggcttgtgggtgtggcttcctccaggcccgtcaggaagaaattcagaacaaagaacggggtcagagctcagtcttcagtttctccttatctgagcccttcatgccagtagattagtttgttggggaggtcctaggtggagggtccaggtttctgaaagacaactcagggatatacattaagatgttatctttactttctttctttttttttctttttgagacatagagtctcactctgtcacccaggctggagtgcagtggcgtgattgtggctcactgcaacctctgcctccctgattctagcgattctcctgcctcagcctcccgagtagctgggattacaggcatgcgccaccacacctggctaatttttgtatttttagtagaggcggagtttcgccatgttggccaggctggtctttaactcctgacctcaaatgatgcatccatctcagcctcccagagtggtaggatgttgtcttttctttctacagggaacagtgctgggaggttgtctttactttctacagggaacaaacatctgtctccaccttccttgactgttgttttaggatactgttaccttcttgcttatcaagtcgctgatttacttctcagagttatctaagtaactggaatttcccttgaaggaactcaagattttccttgatttccatgcttggagggctcgcaggcccctgaagagagggttgcagccaggcgggagtccccaagcagatttctgcagctctgaggagcagccccctctgcagagcctgccccaccagctcgtggttctgactctgagctctggtcaccctcccgtgtcgtggcctgcaggctccttccaggcaggaagctggcccccccaacacagcgttagaatcaggcattgctgtggggtagggaaagtgaccccctcacagcccggaaatgggaaggctctgtggtttcctctctgggttccagttagattcctttcgggaaagtgaacttggatatggagttgagtgaccccgagtgcacccccgcagtaaatgatgctcaggactaaagtgactgaaggcttttggggaaacagatgcgaacaaaacag

SEQ ID NO: 36897 - DNA, 1054 bp, Homo sapiens
aaaaattagctgggcgtggtggcaggtgcttgtagtcccagctactcgggaggctgaggcaggagaatggcatgaacccgggaggcagagcttgcagtgagccgagatcatgccactgcactccagcttgggccacagagccagaccccatctccaaaaaaaaaaaaaaagcgtctgaagtcattgtcatctttgtttcccacatgtgacgtgtcttttcggccagatctgacctgaagtctgcttttgtacagaccacaagccaggaatgtcttttacatctttaaaagggtgtttacagaaaagaaaaggaagaagaagatgcttcgggcagcgtgtggctcacagagcctcggctgctcactcccgggccctcggcaggacgggatctggccggtgctctaggagcttttgaacttttatctttctttatcagtgattttcagcattgtattttccaggtgccttggtgggcttttctttgtgttctacttagcatttgttgtttcttggatctgtctgtagttttcatcatatttggaagatttttagccattactcaaatgtcattttccaccactgcctcttcctcctcctgctggactgtggcactctgaggacagctcgtgttatctcacatggcaccgacactgtgctgccgcaccaggctgctgcagattagtttctgatgctgttggctaagttcactcacctgttctctggccacacctgaacctgttatcccagatcagttttcactgatgatgtcgtcccgcgctgctcatcacttgggctccatttgctgcttttgtgtatcttctctcatgttgtgtgtatgtttttccttacatccttgagccacgttcgtatttattgctgctgcttttgaagtcctcagtcactgagtctgtcgcctctgccgtttccggttctgtttctgtttgacactttgctgcacttggagctgtgggccattgtgcacgtgcctggtggacagtcctgaccctcgctgtctgataaaaaagcactggccacatggccgctgggaaatttg

SEQ ID NO: 36898 - DNA, 1486 bp, Homo sapiens
catgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggttcacgtggcttgcatgttgggaagttgctgtggtctgcgtggcttatgtgttgggaggttgtggtttgtgtggcttgtgtgttgggaggttgcagtctgcgtggctcgtgtgttgggaagttgctgtggtctctggcttatgtgttgggaagttgctgtggtttgcgtggctcgtgtgttgggaggttgcagtttgcgtggcttgcgtgttgggaagttgctgtggtctgtgtggcttatgtgttgggaggttgtgggtttgtgtggctcaagtgttgggaggttgtggtctgcgtggctcacgtgtggggcggttgcttggctcgcctgttgggagtttgtggtttgcatggcttgtgtgttgga

SEQ ID NO: 36899 - DNA, 1071 bp, Homo sapiens
gctcatgacctagctgtaacatctcattgagggttggtggaaagttccgcatctcttgatcttaagcctgggtgtcaggtgtcagtcttgctggatggcagccagcattgcgggcttgttttgcgtgactgcctcactgaatccagacgggacatccttgtcttccttggccatcctgagtggcttcccagatctgtgccgtgagccaggctgcatgcatcccacgtaggagaaggtaaaggggaggtgcggcacctgccgcgctctggcggtgggtcaagcccccacaaccacctcccgctgctccgccgtggaaagttagctcttaggccaggtgaggctgtgaccatccccatcccatcccatcgtcacggcaccctggctgtgagggagaggtaaatccctgctgctctgtcctttctgattctaggagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcaggtaaaggttctgtggaaaccacatttgcttttggagttgagcaccatagccaggaaagcaggtgccttgtaggggagagtgagtgagtgagagaacggatgtcatgtcacatagacattcttggtgtagcttattctggcaggaggagtgtggccagacagcccctcctgcccaccggccacgtgcactctctgacccaggtgtggtacccaagcccgtccgatcacccctgcccccaactgctagtgactggtggtctctgtctctacacgccgttaagatcattggcccctccctcccctgcacagcgcctgccggcagccaaggctgtgcccttgtcccagactgtgccgcacaagcgggctgactttgggcagccagcattggcagggggcttctttgttgctgtggggcagatgcacactcctgaactgctcgcttctgtgtctgtgtagacgctggagt

SEQ ID NO: 36900 - DNA, 1009 bp, Homo sapiens
taagggctaccggttattacaagagatttttatgactcctgctgtgggggtgccctttctacccggctgagcttggtgggagccaaggctgagtcggatgtatctttatatccccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagaggtaaaccggggcgtttctgaagagctagtgtctgggggggtgtggtgtcatcttttctgaggccttattccccacgccagcctcgtcagctgtgaaacagaccctgcaccttctcttggtgactcccagtccacttcggggtgcgtaggaagagttcatgaactcattagtggctcactctgaagtcagagtagagtgagggaagtcaaggctagagctgggacattgatggccgccaggatgcgttgggggaatttttattatatctgaaatacctatcacaataaattaaaagacgctcgtaacttttttatttttaagaaacaaaattcggtcagttgtatccaatttttggattgtaagagattttgtatcatttagaaatctagatttttccgctttaagatgtctttgctttcagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggtaagttactttcattgcccgaagtaatcgtggcatagttctgtgtattcatgtcttgtgaagacttcattcaccttagatcatttctagtttttgagctttcacaggtgtttctgtgttcggatgatgttttacagacacagcat

SEQ ID NO: 36901 - DNA, 1037 bp, Homo sapiens
ggcgagggtgaaccgaagtgctgggggtttctaggagggagatcgggctccggggttccaggtccctcttaatccatcttcttgaacgagtaatgtgaacaacatcccacagggcctctggtgaggacaccgtggctcgaaagggacctgaagctccctgcggaggggaagggagaacaaggaggcagtgacatgccgccactgtggtcttcccttccgtctttccctgctggttggcagccccgctgtactccttagggaggcctttccctcttagcaccttcacgtctcacctggctgcgtggcgtttgcacctgagcacgcgggtagaactcggtctgtgtctgtgcagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggtaaaggagcagcggcggtggcccggacgctgcccacgaggagcccgtggggagcctggtcccaggacccaggcagagtgcgcctgcgtggctggaggaggggagggggtgttccgttggtagcaaaacgcgaaccgctgaggcccgcagactcagttccaggatcctgggtgtgctgttcctcagcagaccctgccagggtctctgtgaggagggagcctggcatgaggaggatctcggagggggtttcccttagttctgtccctcccctgagaactgcgaggggattgggcagacctgtccggatcccgcctactcctgcctttctcactcccttgactctgccgcccaggaagagaagaagcggaagcgagagagggagcactgtgacacggagggagaggctgacgactttgatcctgggaagaaggtggaggtggagccgcccccagatcggccagtccgagcgt

SEQ ID NO: 36902 - DNA, 1643 bp, Homo sapiens
gcacgaaagccccttgactgtgctgtggacagagaccccatctgtaattagaccaggctggagagaagatagaaggtctctccctgtgttcctcctggaaattggtggttatgatcacgtttatgtggcttaagcgtcaagcggatcaaagggcgtgagcctggatagcgtccgtggggcctctccatgaccctgcatgggcggcctctgtctgtccgccgccgcccctctgcgtccagggcgctggtgacctcccccagggggccacagtcacgaccgcacggctgcagctggcctgagacccgctccgactttcaagtccacacacgggccgggtttttccaacacagaaacgcaagtgctcccctccgcccagcgtttccccaggtggcctcctggaacgccagttctgctgcagtttaggggcctgcctaggaggggaccgtggggtagaggagggagataagctctgtcccgcaagggcctgagcacctcacagcatgattctgcagtgtccccaaacctacttggttggggagcctcctgtggggctgtggccgggcccaggccgccagggacgctttgagacatggaccggccacagcagcttcagagagcagacagggagggtcgtggagcagagctgcgttgtgaggacggaaggcgggggctggacggccacacggtggaagtgcttgtcctttagcccttggccagacaggggcagggtgggccgtaggaggggacccagtagtggccactgagggcctgtgcctccagctgagtcctcggcataccctgtccttgtcaggcctgggagcttcagcagcaacggctgcacaggccggtgtgggggactctgggcctttccttcctgagcttccggccccttggacccagttgtatcaggaccctcggagaggaggccatgtgtgcccagcctgacgggtctgtgtttggcagtgtctgacgtggggtttaggggcgatgatgtagatgtcaagagaagcgtgtcagccttgaaggcgtcaggcacatgggccacccagacggcttccactgttctgcctgctttgcagatgtagatgtagttaggaaagcgcttgcggtttgtgttgtgtgactgtagcccttagaagcttggcagccttagtgggctgagttctaggtccctggaggccaaagcatcccgctgctgaacgcccgccctggctgcagtcagcgcctttcgctcggagccgccacttctgcatccttcagggtcagagaatccgcctgatcctgactcacacagccctttccaacacgtgtgaatgcagctcatcagggctcagctcagcctcgtgtccggagcgtggggtgcacccgccgcccgctgaccgtgcccacctcccctgcagggaccagtccaacgtcaggcggatgcacacggctgtgaagctcaatggcgtcgtcctcaacaagtcccaggatgcgcagctggtcctgctcaacatgccaggtcctcccaaaaaccggcagggagacgagaactgtatcctttcttgcagtgtgcctgctgagcgtgcgggcaccccctggtggcttctcgctaagacctgggtttgtgggtgctgggagtgaggctggcttcccgcctctcc

SEQ ID NO: 36903 - DNA, 1055 bp, Homo sapiens
gccccgagcctgtgcccccctccttcggcagacagctaagggcatacgttggctttttagggtgatttttaaattcccctattattttccttaactttctaactctaaaaataccatcaggagatccctatcttctcagaagggagggttttgtagtgccaggtagaggccagtgagcaggaaggaaggaggtgctgagccaggcgcccccaggtccagggagggtgggcccccctgctgcgtgtgacctccaccaagtggggcgtccgtcggccggctccttgccctcccctgcatcctcccagcctgggctctgcgctttgcgtcgacgccacccctgagtgcctcctgccagcgtccagtgttctgctgacctgggtcccacacagcagtcgggaagtcaggccgctcaagatgtctctttccttccttttactgtaaacacagcggaattaatactgcatttccaaaatacttgaagacatttggttttgtttttgagaagcctcaatctggggttgaagtaaccggagacgagggacgtgaccgtgagaccaccttggggtggggcctggcctgatgagggccctcagccctggctgttgtcccaggacagggtagtggcctcttcagaagctgcatctctggacctctttctggttcccctgctgggtccttcccggctcggggagcttgtggccgccccccctgtctgtagctcggccagcccttggggtgggaccatcactgctgcacgtggacgctgcggaattgggtgttgccaggctcagcactcagcacctttctgcacgtggatggtgtggaactgggcattgccgggctcagcactcagcacctttctgcacgtggacgctgcggaactgggtattgccgtgccgcacgtggacgccgcggaattgggtggtggtgtgccgggctcagcactcagtacctttccgcacgtggacgctgtggaactgggtattgccgggctcagcactcagcacctttctggggtttcacgcatgctgggcactaccttgaggcctcatggg

SEQ ID NO: 36904 - DNA, 1058 bp, Homo sapiens
ttcagacccaggggctgaggacccggggagggcctgagctccacaccctgaacacggggagggaggtcggggggcccacggcgaggtgcgggccgcctgtgaccatgtccacgccgcgcaggaggagatggacagtaaccccatggtgtcctcgctgctcaacaagctggccaactacaccaacctgagccagggcgtggtggagcacgaggaggacgaggagagccggcggcgggaggccaaggtactgccaccctgcccgtgcccgcccagtccccgccccgtgtgtcccggcagggttagatcacgccggcaaggcagttgcttgtcagaagagctgccctgagctctggtatcatggccacgtccagccctttcttcctgggagggctcgatggtgcctgccctgcagctcctgtccaggcctcttccctctccaccgtccggggaagcgtgacacccccatgcatctgggtggccgggttccctgtcgagaaatgaacttggggtgttttgttcgttctgcgggagcggccccatcccctgctgtggagaggagtctgaatggtgccgagaggccgggacgtggccccttccagagggtgctgtggcctcggtgctcccaggggccgccctccttttcatttcctgtccaggacacttagcctggtagcattttccctgcagttttattccctgaggatttgtttccaggaatccgtcctaggaaacgaggggggtgcagtggggaaaggtttcccttgagtggtttctgtgggtgacgaggtgtggaaaccccttgagcatcctcgggagggttctgccgtcctgtacagacgggttgcctgagagccaccctgaggcctgaggccctgaggtgacgctcacaggcgagaaagaccctggacccgtgttgggggagatcttaggtcctcgctgtgggggtgcggcgggtggctcagtttcttctcaactccctctgctttttaaatcttctttcaaatatgtctgtgttgctctagaataagatacaaaaaacaaaaaaaaataatccaccg

SEQ ID NO: 36905 - DNA, 1035 bp, Homo sapiens
ctgtgtgccatgacatgcatcagaccagggctgtgtggggcggatctgtgcgtggacagctagcacccatagggctgcacagggtgtctgcccacttgcttacctggggtcgtttttataataaaatgaagaggtagaaaaaataagacgagaaaaaactgacttgtggccagttcttcaggccagggcttgacctcgccgccttcatggctgaggaggagggcagcattggtcagcctggtgttgctggttctccaccagcggctgtcggcctttgctggctattgggagggctcctccaaggtctcagggacccaccagaggctgtggttctggggcctggacccaggtcgggcctgctggccagacgctgtcagtcccgggcacgtctgcttggggcaggttctgttgagaccctggcccctggggataggtcagcctggtgcatggggttcatgaaggcaccagacaagctgtgagcagagctgctgctggaactgctttaaacctggagggacgggcaccggtgacagtgaccaaggccctgtcccagtgcaggtgggcagggcagtccacccagtgccagctgcttagggccgctcggggcaggtgagcgaggaggggcctctggggagagggcgctgaaacaggctgttcccaggtacgaggcgggccgaggccggggctgttcccagagctgggaagatgttgggatggacggagcaggagggcagcgcacacagctgtgggggagctggccatgggtgcggggctcagctcgtcgagggctcctggtgggtggtcaccatgcagagccacatccctgcaggctcatgtttcactgcctcttcccgggtgtgcttttctgtcccaggacacatccgggatccaacgtgacagacaccaagttcccacgctgcctcgggctcctcttggctgtgacggtttctcggactttctttttttgacgactgtggcagttttggggagtcctggtcctttttagagaatgcccctcagttgggaggtgtctgg

SEQ ID NO: 36906 - DNA, 1149 bp, Homo sapiens
atagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaagcctttgagtcatgagtgttcttagatacgtagcatcttagttgtttaagactaaactattgtacagagccatgacccatcaggtcaagcttatcttgccctaggttgaggcagagagagagaaatggaatagaaagatgggtggagaactgctggactcggtgtgtagtgaagtttaatgtttgttgaagttagtttttgtggggtttgttgttctcagctcacagcagcctccacctcccatgttcacacaatcttcttgcctcagcctcctgagtagctgcgactacaagtgtgcaccaccacatccagcttttttgtattaatatttttagtagagatgtggttttgccatgttgtccaggctggtctcgaactcctgatctcaag

SEQ ID NO: 36907 - DNA, 1045 bp, Homo sapiens
gaaaacagcattgtgtggtgcatgactgttgtctgttttcttcatggaaacaaggaaacctaagcattaaaacaacaccatccacgtctggttccttagagcaaatggaagcaccaggctctggtgcacggcgcgccccctcctgcagatgcagtgtggggaccctgcagggccctgtgctcggggccacatgtcctgggaggcccgcctgccccaggtggcaccttcagctgcatgggctgctgtgtccatcccccagccccaccagaccagccctgatcgcagctttgtggtctctttgggaagtggtcccgtgagcattaagggcgagggcctgtctggtgcagagcaggtgggtcccgcactgccgtcctccctggtaggagtcccacacctgacccctggggcaggaccttgtgggtcaggaggccgtgtcctcatagccccagggtgctccagtgctctcactgacttgaccccgtgggcagcagttacactgattaataaatagaagagctttgctctccaaagttgtcgtagactcttgataaacttaccagccagaaagctgcttcacaccatgatggactctgaagttgtctggatagcagaccttgttttctgcccactatgcatagacgtggcagctcggccctccacacctcgtgagtgccgtctgtgcgtagatgtggcagcccggccctccgcacctcgtgagtgctgtctgtctttctgcaggggtctatgcctttggtttcctcttcatgctgccccagctctttgtgaactacaaggtaaggcggtgtgtgctgcccgcggcccggcccccgtctcctgtgctgcccacagctgacctgggcctgtctctcctgtttcagttgaagtcagtggcacatctgccctggaaggccttcacctacaaggtgagtgtgacagccggtgaggaatcccttctcactgagcagagcgtgagcaagggcgtcttccagccaacagcattactggggccatctctgcccagagtgcatctgcacctgtccctttc

SEQ ID NO: 36908 - DNA, 1363 bp, Homo sapiens
gagtacgggtcagcccgccttgagcagggatcccaagagtgaacacataaaacccaaatttcttactgggaagggcgggggctcgcagagactcatttcccagtccttacaggcacagcctgcctgtgtcaccgtatagtagggatattttcatcgtttgtaagtcacattcgccaggcagctgacgcaggccatggtgtctgctgtggttgctgggaacgcacttgccgtcaccaaggccataatggccgcggccgcacagtggcctggaggaatggccccagcagcacagggcgtcacctttccccattgctgttgggggagctggaattctcagttccagttaatagaacatttctgcacagatgattttagtttggtttaatcttcaccagcttatatccaacttgcatggcgttgtaaagctgaaatcagaatggatacagctggcgatgtaactacattacttagtaggcagttttttccggtttctttccattatgtttattgatctgttgtgggttggttggttttgaccaaccagaattgatctattattgttaactagcgcctgtagttacacccgggctctggcgtgtgcggtgcctcctggggctgtggcgagtgtgcgatgccctgcctgtgcccctcacgccgccccctgcagagcagccctgccaccctgagcgctgtagctcgttctgtctgtccctgtcggggtgagctccatgcagtgtgtttacagaggcttggcgtttgggcctctaactggaagccatctttgttccctgcaggccatgaagtacttgtcatacctgctgtaccctctctgtgtcgggggtgctgtctattcactcctgaatatcaaatataagaggtaggaggccgcacacgcttcccctgctgcgtctttcccctgagaaagccatttggatgactgagccagagcggggtgcgactggagggcaaactcggggccggggcacttgggccagcgcctgggaggggtcctgcccctgcagctgcacacggtgggctctgggcctcagtgtccccctggtaaggtgtagctgagaggactgactccagccaccaggcttcatgggaggcttgggcctgagctgagaggggtcctggagcccctggcctctgctgcccgtgtggggtgctggccctgagctgagagggttcccggagcccccggcctctgctgcctgggtggggtgttggccctgagccgagaggggtcctggagcctccagcctctgctgcccgggtggggtgctggccctgagccaagagggatcccggagcccccagcctctgttgcccaggtgggctgctggccctgagccaagaggga

SEQ ID NO: 36909 - DNA, 1023 bp, Homo sapiens
agaggaggagctggatgaaatgacgctggagctccacaggcagggtccctccataggtacgagtcacagtgccgtgcccggctctggcacccgtcctgagctccgtgggtgatgccttccaagcatttagccatgaggtggcggctctcagagcggtcccaaaactggctccagggctgcccgagtggcaggcagaagtaggtgggggcttatttgggtgcaggcagagtggcgtaaagaactgccctcacatgctgtttttgttgtccgctgggcggtggctgtgcagcccacctgaccaggtacgcctgccgtgtgtgggttagaggcccaggtccagcctccagcgctctggcctgagctgtgggagggacaggaagaggacagtgggctgcgcggggccatgggcagcaggtcctacccgttactgtctgggtcgttcattcgtggctcctggccttcgaatattaaaggaactatttcctgatttctcccctcagctgtggaaagtgaagaaggcattgaagatgactattttttggagaggcctgatgcccgaatttcaggtaggatttagttgtaatggctgaaccccaagcctctctgaagagtgtgattttgccccctgtgcaaagagtaagatggccatctgcagatgagtcactgcgggcctctgtcaggggagcctccgtggtggaggcagcactggtttctgatcgcagccactctcttcgcctgaggattccccggtcatatacctagttctgaccgtcttcagtgcagacggcagcacttctgggcctgagccggcctctgggaggaaggatgctggctggccagcacgtgtgcttcgttttggcaccttgtccagaggcgctcccgaggctggtgctgactggggtccgtacagtcctggcagtcctgaagtgagtgagcccctgccctgagctggtggctgccccagtgcctgggcgcccataaggcccctaggcagatgagggctggggcagagctggagttgaa

SEQ ID NO: 36910 - DNA, 1010 bp, Homo sapiens
ggctggagatctgagcacagcggccaggtaggcactgacggaaatcactcggtgccctgtggtccagccttggttgttccggagctcagaaaagccggccaaaagggagcctcgtggggcaagaccagctcaggagcaaacccttgaggggggcgatggccttcagggtgagagggcccaggcttaagcctagctcctcactgagctctgtgccacaccggcaggagccggagtctgaggtctctgcagttggtggcccacctgtgggtgggggcctctgcggccgtcatgcctgtagaggaggagctggatgcaatgtctctgtagaggaggagctgtatgaaatgtgtctgtagaggaggagctggatggaatgtccctgtagaggaggagctggatgaaatgtgtctgtagaggaggagctggatggaatgtgtctgtagaggaggagctggatgaaatgtgtctgtagaggaggagctggatgcaatgtgtctgtagagcaggagctggatgaaatgtgtctgtagaggaggatctggatggagtgtccctgtagaggaggagctggatgaaatgtgtctgtagaggaggagctggatggaatgtgtctatagaggaggagctggatgaaatgtgtctgtagacaaggagctggaagaaaactgtctgtagaggaggagctggatgaagtgtgtctgtagaggaggagctggatgaaatctgtctgtagaggaggagctggatgaaatgtgtccgtagaggaggagctggatgaaatgtgtctgcagaggaggagctggatgaaatgtgtctgtagaggaggagctggatggaatgtgtctgcagaggaggagctggatgaaatgtgtctgtagaggaggagctggatggaatgtgtctgtagaggaggagctggaagaaatgtccctgtagaggaggagctggatgaaatgtgtccgtagaggaggagctggatgaaatgtgtccgtagaggagtagctggatga

SEQ ID NO: 36911 - DNA, 1047 bp, Homo sapiens
gccctcagggcttgcaggaggaggaagacgtgttgaataagctggagtggttcttaaggtacagctggggaggaaacaaatccagacttgaaaagccacgcacttatcacagaactggcataagacacgcccggaagcaaagctgtgctggccccgtcatccgacctctgcccacgttccatgctcatttgcaagtgtggctcagacacgtgtttgtggagctggtgtggggccagctgttcagttcagcagccttccaaacactttcctagctgctgaatgcttcattgttctttttaaacggggtgacgtggactggggagtacctgaagcttcttgggcgtggtgggttgggatgggggactgggggtatgtgtgtgacttggggaacacaggtggggtctgccctgcaccccctcccagcccgaccatcctgtccccagtgctctggcgctgcttcagcaccgtggtcatctttctgttcctgctggacgagcagacgagcctgctggtgctggtcccggcgggtgttggagccgccattgaggtgagttccgggcagtgacctgaactgtctgaggtccatgtgcctccacgcactcaggaaaggctttcagccccgggacctgagaccttctgtggaagcctgtgtgcttgttcccgatggcctcagtgttctggaagctgtaggatggcaggcagtgggtgtaaaggctttgaacaagtggagagcaaggaaatgcgtgttcgggtggtatcagctcatgaggctctgtccaccaagcagtggtgagtcctgaggccctgtccaccaagcagatagtcctgaggctctgtccaccaagcagtggtgagtcctgaggccctgtccaccaagcagagagtcctgaggccctgtccaccaagcagagagtcctgaggctctgtccaccaagcagagagtcctgaggctctgtccaccaagcagagagtcctgaggccctgtccaccaagcagagagtcctgaggccctgtccaccaagcagagagtcctgaggctctgtccac

SEQ ID NO: 36912 - DNA, 1034 bp, Homo sapiens
acagaaggagggaccgggggatgcttgctgggcccagtcatggctgacctggggccacacagggatgggaagggggatggcagggttggcgagggctgccaggcagctgggtgcaagggtatgagggcagggccctcagtgtggctttcttcatcaggtcataaaccgctccaccaccgagctgcccctcaccgtgtcctacgacaaggtctcactggggcggctgcgcttctggatccacatgcaggacgccgtgtactccctgcagcagttcggtatgtgccgcacacggccggcgcctgggtgaggccgccctggagcccctcgggcatccaagtgcgaatcctgacacaggccggggcctcctcgcctcctgctgcagatccttgcacagacgttgaatcagaggctagcagcgcctgcctcacttctctccttggagatgacctggttgattgtctggaaattggctttattaagaacataatatgtgaaatgccatgagtttggtcaaatgaaccttaactgttgatgagatttatttttattgtttgtttgtttgtttgtttgtttgttttgagacagagtctcgctctgttgcccaggctggagtgcagtggcacaatctctggttactgcagcctccgccccccggattcaagcgattctcgttcctcagtccccccagtagctaggattacaggcgcgtgcccccacgcccagctaatttttgtatttttagtagagatggagtttcaccatgtttaccaggctggtcttgaactcctgacttcaagtgatctgcctgcctgagattcccaaagtgctgggtttacaggcatgagccactgcgcccggcctaaatttttatattgaaaactgtatttgtaatgttaggtaagattgacattgcctgttttatattgtatgtttttttttccttgacagggttttcagagaaagatgctgatgaggtgaaaggaatttttgtagataccaacttatacttcctggcgctgaccttctttgtcgca

SEQ ID NO: 36913 - DNA, 1089 bp, Homo sapiens
gagataatttacaaaacaaggccgggcgcagtggctcatgcctgtaatcccagcactttgggaggctgaggcaggtggatcacctgcagtcaggagttcgagactagcctggccaacatggtgaaaccccgtctctactaaaaatacaaaaattagctggatgtggtggcacgcgcctgtaatcccagctactcaggaggctgagggaggagaatcgtttgaacccgtgaggtgagatgatgccactgcattccagcctgggcgacagagggagactctgcctcagaaaaatttacaaaacaagaaagatggcagctttccaggaagaggctgtgaaattgttccagacagagagaaagagaggtctctcggagttgatggggttttgaaagccctaccaacacctgctcctgcctctccccagtttgcatctgtctccttaggaacatccctcacctgcccctctccgtgtcccctcatctggggcccccatccctcctctccagtgtcctgaaaagtgggtggggtgatgggcatgtagcatgtagcgcaggaagcctcccttgcaggtagcaaatgtgaggaggtgtggaaaaccgtttgtaatgtaaattatcgctaaactgcatctttaggtaggaaatgggtgaggcgatagtgcttcctaggatgtatcagatctgagccgagctaagatttccctgtcagtccatgtcctgtttaacttcatgtaagagccgtgtgtaatcctcagtatgtctcctttaggcagccccacatgcttggttttagaagctgactccctctcagtctccttacagccacagggctgtgtgagccctggacttgcacagtcttctgccaaggtcagggggctctcaccctctcaacttctgagaagtgggcccacttagtttgaggacctcaaaaaaggaattggtgaagtccgtgaccacatgttgcaaagcagcaccccctggcttccgtggagataaggatggggggctgtttggcgagagtctggcggaattggcagctgtggggccgctgtgccctctctgctgggctctcccccggttgtgcctgtgc

SEQ ID NO: 36914 - DNA, 1066 bp, Homo sapiens
gcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcaggtgagcgtccgcggggccgggggccgggcgggttggggtgggggcctctcctccaggccccagacgtcgccttcccgtcccagttcggagctgtggccgcgcgagtcgagatggaacctttcctggttccccagcggccaggtcttccgccctccagctggccgtgggatttgagtgcgtcctgccagggcctggccgagctgactctcgacgccccctcctttccagctgagcgtgtacaccacgacgaggtcccacctgggtgctgagaacaacatcgacctggtcttgaatgtggaagactttgatgtggagtccaaatttgaaaggtatgggcgtaggacaaaatgccagtgaaagggaaaacattactcatgttcagattgtttaaaagttagctttctgtacataacatgtttattttagagaactagtcttaccgaatgtcttgaagtggtagaatatcctaactggaggcctatgcgtggcctgtaaacattcagcctggaaggtgacaggtgatgaatgtcgtttaagaagtagttctcagcagagtgtgatggcagtgggatgtcctggacggggaggctccgaaggagcaggggccacgcttggtgaaccagtggagagcagacaactctgcagtttcactaccggggaccaacttgtcttttcctggtggaagtagttcgcttaagttacttgtgagggaaaagagatgaggatagaggaagcaattttgtagaaaatcataaataagtgacatgtgacgttagaatagatcaatgtccaaatatgtagagtatcttaaaaattacatctgacatgg

SEQ ID NO: 36915 - DNA, 1030 bp, Homo sapiens
acctgcacacagcaggtgggacagccccgtagttgccagcagaggggttccggggtacaggaaagagatgagagacaggccctatcccggaggagctcaacatagtgtgagagaacctgcccggcatcttgtagaaattccaccgtgtctgagctccaggccgcgtggtgtggctgcacgtaagtgttccaagtccagttaactgcgcttgtgaaggctcccgttgaaggttcctggattcatggggcgggcttttaatagcacacagactacatggctgttcagaggggaaagtgaggaagccctcccagaaagtcagcctcctgcccacctcccgctctcccccgccattagttgaaactgagctgttttgcatgaggacgttggctccccttgagggggtgtctcctcttaacacccagagggctgacctcgatcttaggagataaaatgttctactgatcttagactaaatcttcgaacttcatacagaaacacacttcgtagacttttagataaaactacaaactatacgaaacaggacttcattttgccaagttgagagaaacatgacaatttcattgctctatgtcattttgtatttaatatgacagcacaattcctatgaagttctgatttcagcagaaacataacgtctgtgttatcatctgtttcttcaggctgcggcatagtcccctgccctctggcgtgtgctaacctctggtcgtaaggggtgtacacgccccagtctcgttcagatgactctgtggcagatgatgccacagcactgctaaagggaaattatgccggagcaaaggcaacttacatgggcagactgtggcctggggaggcatagttctttctaagaaaggtggtatctagcaagaagttgaacaataacagagagcacattacagcaatacctccatgtcagataggcaagcccgacatgtccagggatgcacgcgtggctctttaaagcatgctcagggctctctgtgcagccaaggcagccgcccctgatcccaga

SEQ ID NO: 36916 - DNA, 2892 bp, Homo sapiens
ggtgacttcgtgcgctgcaaagaaagtaagcgcaagttcttctctccaccctgaaagcatccgtttcacagacgattctaaccctccctggagggcgtgaggtggacacccaccagggccgtgggaaaagagcctccaaatcctagacatttgctcgtccccattccataaccacaggtgcctttgtctttccagctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtctatacttgggaatgatgttgttttgtgtggttctttattagaaagacaacaacaggcattgtgagaggagagccaatccagatgagattttcttggtgtggttctagcatgtttggaaaacacaagaattgaaattctgtagaaaaagctgtcttggtggcaaagggacgctccggagtgttctggtattttgcggacagtagcagacatcttacagagttgaaacatggatggctggctgcctgcctggtgggttgacttacgtaatttctcaattttaagcacatgcaccttaagcgt

SEQ ID NO: 36917 - DNA, 2103 bp, Homo sapiens
ctgcctcctccaggcctgggcagcctgcctcctagggcccctgatctgagccaggccctgtggccctgcggcccctgctggccctgctttcactgtgccctgttgtttttttttttttaatttttgtgagatggagtctcgctctgttgtccaggctggagtgcagtggtgcaatcttggctcactgcaaccaacctctgcctcccaggttcaagtgattctcgtgcctcagcctcccaagtagctgggattacaggctcgtgccatgaaacccagctaatttttgtaattttagaagaaacagggtttcaccatgttggccaggctggtctcaaactcctggcctcaagtgatccgcccacctcagcatcccaaagtgctgggattacaggcatgagccaccgccccccgttctgctggccccaccagcccctgctgtagagccaccaagtataacctggaacgaatgacagcagcggtgggggtggcagttgccttgtttctcaacatgaacaatgggctgtggagcccgaccttcctcctgcacaggccccacctgcaggtgggcagggtaactggctgtggtagggttgaggacgcccactggggaggacagtgtgcaccgggtccctgcttggggtggggtatgtgccactaggaggtctttctcaggtgaaccaggcgatgggtgaggcctaggctgccctacagtgaccacctgggggcaggatgggtgatcacttctcacaggcttccaggccgctgatatggctgcgtccccacggcgacaccagggtcccgcctcacctccaccctcagcagctccgccctgacggcatatgccctgccttcctcccaccttcttgcaggctgcttccccatgtccctttctgcagcctatacctttcatggtgtcatcatttcctgaagtcatggccattgtgctttgctgctgctctgggagcctggcacattttggggggactgcatgtagcaggaagggcttccacggagcagtctcgtgtgagagagcgtggcaagtgcaccagcgtgctgctcttgggacacagagatccaggaagctgccccccaggctgactgtggacacagaactcctagcacctaggaccccagaggcacacgccggtgctcaggactccggatgcgcagcgcaccgatgtgcttcatacgccttggggccccttgtttttgttctttttcgttatcattactgtgtaaaaccttaagatgtggccctggtaaaacttccagcggctcagagagtggacagtgagaacctgaagtctgttgcctgtggtagcctcagtcctacctctgcgtttcccgtgcagcatctacacgaggctccgaggatgaaagtctgcatctgcagttctcatgtccaaatggacacagatgtcaggttgtcccctctgaagcagccttgcaaccactagggggcaggaggcactgctctctgggggctgagtgggatccaggtcggccgaggagctggaggccgtggccctgaagctttgacccggcccgttctgaggctccagcagcaccaacgtggatttcgtctgcagatgtttgattcagcaaatctaaaagcaggagagaaacgtagaccacagaagacagggtggccgcgtgcggcagcgctgtgggatgaggcccaggggagggagagtggagggtgaggatggggtctccagagcctggagcagacccggtccatggggtagaggcagagccccgggaagagggtgtgaacgcggggacagcttgccaggccggaaggctggaggcgtcagcgtttcttccctgagcaccgcaaggaggagccggtggaggtgaaggcgcagcccctccctgaagagaggcgacgcccctcccaggcagcccacttctcggagggtggagcaaacgctcacaagatcacagcgcgctgcagcaggagaaggggactcggagtcagggcgacggccccgtcggagccccaggaaccgtggaccccaggcagagagagggcggcgggggatggtgcagccccaggcagaggactcggggaagaaccaggtagaagagctggcccatctg

SEQ ID NO: 36918 - DNA, 1044 bp, Homo sapiens
gagggcacagcccgcctcactctgcttcatcctgtgcttcacagacagttgcttcacgtttgtggcaaccctgtgttgagcaagcctattagcaccgttttccagcactgtgagctcactttggcgtctctgggtcacatgttggtaattctcgcaccatgagctcacttcgtgtctccacgtcacatgttggtaattctcacgctgtttcaaactttttcacgattctcacgtgatggcagtctgtgtcagtgacctttggtgtggctgccgtcatcgtttcagagcacccacgagaggtgaagctgatcgatgaatgtgtgactgccccaccaactggcccttcccctgtctcactgcctctcctcagccctcctctcccctgagccatcggcggttattctggtggggcggtgggaactggctgccacgaggctgggctgacgggggtgctgccctccttgtagggccttgggtgtctccgtgactgactacacgttcgaggactgccagctggccctggcggaaggacagctccgtctccccgctgacacttgccttttagaatttgccaggctcgtgcggggcctcgggtgagtacctggttcttcttccttgagcattagctagaacccgtgatgccgaggtctggcgggggctgcctggggttgcagggaggggaactgaggagataattattaattattctggcttttttcaaatatcaacttaagcccacatagtgtctttcaatcccttaatgctggcatcagctgtctgtggacggcgccccaggagggccaccctgtgtcctgccacatctgccctgggaagggaacgggtctcaggggcacaggcacctggcttgacacttggacagaacacatctcgcaccttccaattaggagaatgccttttcttgaaaactagcttgctgctacttctgtcaattttaatattttgatgagtcttagaagtaaatctggtgttagcatgccaccattttattgaaaaagaaagctttccctctttttttgtctaggc

SEQ ID NO: 36919 - DNA, 1105 bp, Homo sapiens
tgtcgtcagctcacacgccctccccatctccctccctcagcaccttccatccctcaggtcccattccccccacacttgtccttgcaaccaggtcctcccacctggatttacccccacgtgaatgcctccctagtgcttcctcctgcaaagctctgtccagtggagctagagcctcccctccaccgggcggctgccagacctgagctgcaggagccacttggaagccacatcagcctcggtccaccggccccacccccaggctcctgctgcagcaggtcggggcatggctgggaactcgcctctccagagagcccagaggggaacacagccacggccgggcccatcagagtgtgcctggctctgacctccgagccactttgttcacactccgctgacaccctgaagattcagctgggcggcccgttccctcacgttcccatcctctccctcccaaagcatgtgtccgagggtagaaatgggcccggcagtctctgtcccgcaaagctccactcaacccccaccacaggcagctctgaacaatacaaaaagctgagtaggcgccgagccaggggaatgcattcccacctccaagcccagcacctgtgctccggactgctgccaatactggctacttttggggacttaggaggaagagaacagattttacagcgctcaaggagagatcgcctgtgggcctcactgattattttagaaccctccatttcaaacagactccgaggaacttgtactttttttagggtacgagagtgctgccatttccattgtagtaattcagaattctcttaaaaccccactccaaattaccgggaaccatgtttcatcacatcagggccgttggagggtctgccaccgtcagcaaaaccccccaccaaggaacatgggagggagaagcagcctcggactcctgggcctgggcggggcctgtgcagccccactcggagtggagatgggagggagaagcagcctcggactcctgggcctgggcggggccgtgcagccccactcggagtggagatgggagggagaagcagcctcggactcctgggcctgggcggggccgtgcagccccactcggggagtggag

SEQ ID NO: 36920 - DNA, 1027 bp, Homo sapiens
gtggttgatgcagacacgagcttacaccaggatgcccagataagccttgtacaatgtggcatatcacctgtcttgctttcccatctttccgtttctcagggctccttcgaggagcctctggttgctttacctcaatgactttatgtctctcttatgagtctgaaccacttggataagatttgggtttttgttttttgtttttctgagacagcattttgtcttgctctgttgcccaggctggagtgtagcgatgggctcactgcagcctcgacctcctgggcccaagtgatctccctgcctcagcctcccacgtaattggaccacaggcacacgccatgcctagctaatttttgtagagatgggtctcactttgttgcctaggctggtctcaaactcctgggctcaagcagtcctcccgccttggcctcctaaagtgcggggatcacaggcgtgaactaccacacccagctggaaaggattttttaaacctaccattcattattatgggtattgtagcttaaggacatatgaagctggcccacatgcaaataattatttgtttggctcttagttttactttacatatttaataccgctgagtttgtcatagcaccatgctctgtttaatacatagtcaaagatcccccttctcagcctgacccaggtctccagagtcaagaccttgggctaaatagtcacctctgtgtagcctgcacaattttttctaagtcgatgaggagtagttctttttttgtttaaaaggggaattaatatgcacttcttgcatctggaaataaaagatgagtcacatgcaacttaaatatttaataaaacaatttgctgccttccagtaaatattggagagcactacgaaatatactgataagcccggctttcagcccggctgttcacttccatagaggataagctgctctcattacagaggactgggctgaagggccttggcccgggcctgagggcggcagttcccccacccagcaggattatgtggctggatgggcagtgg

SEQ ID NO: 36921 - DNA, 1116 bp, Homo sapiens
aggatgcagaggcgggcctaccaaatgtggctgttggaagtggacgcagctctcactgggccacagtggcctccctgcacgggctgtgaacagacatggatgtggctgtccctggcctccctgcacgggctgtgagcagacatggatgtggctctccccggcctccctgcacgggctgtgagcaaacatggatgtggctgtccctgggccgcagcggcctccctgcacaggctgtgagcagatgtggacacggctctccctgggccatggtggactgtttcttcctgtggggtgggctgtgggggatggtcagggtgaataaggggtgatggccttctgggggcctcaggggtccctgttgagccatcttccagcctcattgttgcaactagtgacgttagacccatgcccagcacaagctatgtgtgaatatggaggtttctgtgcagtttagaagcccgtacctcctcccctctgccttgttcctgcattcagaagccctgggctctgactgcctcatcttggtttctcccagcctggcccttgtgcagcctgccttgggtgcacagtgctggcggggtctgggtgctgctgaccctcaggggcccctgggagactagggaggccagagacccctgcagactttcccaccggggtttccatgaagtcactgacctttcaggctcatggggggtttctgtgctcttggggactttcctgagaggtccccagggtgttgaggtttcctttgattcttactgagtttcagtgatgtccccttgacacatggtcgggatggtcggctgagctgtagcagcagagccattatcacccacagcaggtctcggcactccacgcgagctcctgggctcggtcccaggcaatgaggactatttcctccacactgcgtgtctcaggggctgggactcggctgccgggcgttggagctggggcttgagcctgggtctgtgccagccctgccgtcctccgcctcccctgacacagccacccgtccacctgggcacacagaagtgctgggtgaactgcatgagcttgctcccaggtgctgctgagcccacagcaggaagggggcaacccagccctggacacagggga

SEQ ID NO: 36922 - DNA, 1050 bp, Homo sapiens
tttgtgccctcctagcaaccgccttggctcagatccatggggacccctgtcctggaagtcttctgggaggatcatctgtcccagggcaatgtgaatccagtaaggcttcaggctcttgtttctctgtgcagtagttttacccagtgtgatgcgcccacttaacccagtggccgagtgagccgtggcttctcatgaggctgaatcatgttctctgtgtgcctgacctgtggcttctcacacaccgtggctgtctgctgcgtgtcaattccctgaggtgtggaataacagcctaatctgtagcctcatatgaaagagaatacacacatttaaaaggctaaatttgtacctattttaaaaagagataaagagtacacaaattcagttaacctaggctgatttttactttattttccaaatttattggccatctaatttcctccagaaacagctcactgtaataacacaacgcctggttgtgggaaccccgggcttcctgtggagatgagatggggaagttcgcacgcaggtctcagcttccgccctcagctctgagcgcccccccccccatattgcgatatgcgttttaggtgttttaatgtttttcccatttcaaaatgataggatgctgataaataagttgctaacatgaaggtccggaggtcttctggcctgggacttgtgctgtctgtgttccggagtctcatgttgtcttagcactgcctgccgcgtggcccgtgaccaccacacagggccccgcggcctccttcgtaggtgagagcgcagccagcgaggacacaggcggaggccaggaaggcgcggcgtcttttcttccctcaagcagatgtcccagcggcggcgaccacaggaagcccgtggcctggactgcgccctggagggctctcccgtgggaccgcccctgtgcctcacacagactccgagactgcggacgtgtgcccgcgtgacgcagcgccctcttttgcagggttgtggacttcctgctgaaggccatcatgcgcaccatgtggttcgccggcggcttccaccgggtgg

SEQ ID NO: 36923 - DNA, 1049 bp, Homo sapiens
agctgggccaggtcctccaggggctgccccttggctgaccggatggttcagatggatggtgccctttcctgaatgctctgtgtgggaacacctgttcccaagtttggggatgccatccccatgatgactctaggtactccccgtatgttggcctggaggttggagcttgaacttgagcatcaaaccactttatctggtctcccagaagccagcagctcctgccacctgcgtctcagcctggggctgcccctccacacctgccagcccaacacagccctcccaccagccacccaggggccgtccctgacccagctaagccagtccacgtggatcaccagacttgcctccttgaagccccgccagacgtggccccagggccccttcctttgccctaccccaccggcctggcaccgtagccagcactcaggctgtgtacatgtgtataggtcctctccagggccggctccactctgcctcttgcctctgctcacagcagaacatttggaacctgcagagccggggcctgcgcctgcccctcacgcttagacgtgtgggcttcccccacccacctccacatgccagctggcttgaggagatgcaggcctcagcggccttcctccttttccccctgcatgttctgggagatttcctcctcctcatttcccagtctttcctgtgagttgcttgtctccacagtgacagtcttggtttctgagagtgttttcttgttctttgatgctcctcagcgccctgttcttccagactctcttggcgagcgtggtggatgttttgcacccctcttctgatgcccaccctttctgtctccttggggtcagtcctctgcttctctgccatgcagctgctctgctcacacgtctcaggattcttgggtgtcgtccgtgtgagggcggtaggacggagtggatttcctgggggtgctgatggagatccccgctcctgtgtatgcagatagatctgtctcctgattcacattcccctgggaatgggctgcccaggcacctgagcaccctgggcttgtgctggctccc

SEQ ID NO: 36924 - DNA, 1031 bp, Homo sapiens
cctgtatttgcccgtagtgtggagcagggtgtacagggcaggccaggggctcctgcagctaagtgggtgggacttaggccaggatgttgtgtgtgggcggcagtgggaggtgggggagggtcccagtatctgtagatagtgcagggcagggtatacagggcaggccagggggttgggccaagatgttctggggggcccctgtatctgcgggtagtgtggggcagggtgtacagggcaggctgggggtgggacttgggccaggatgttctgggctggcgggggaggtgggggaccttgtatttgcgggtagtgtggcgcagggtgtacagggcaggctgtgggctcctgcagcttttgagggtttgggccaggatgtgctggggggctccctgtatctgcagccagttcggagtaggaagggccgggcaggctggggactcttgtagcaggatcccctgatgcaggatgtgctggggggctccctgtatctgcggccagttcggagtaggaagggccggcaggctggggactctttcttgtagcaggatcccctgatgcaggatgtgctggggggctccctgtatctgcggccagttcggagtaggaagggccagcaggctggggactctttcttgtagcaggatcccctgatgcaggatgtgctgggggtggggctcccaccacagggggcttgggaggtgctctccaccagggccccactggctttctgcagatgtttgttaaacaaatgcaagcagctagaaatgccacggatcctgaatttcaggattctttttactcagaccaggcgggaggtccggggagattggcgtttccctgggccacagctccggagggcctgtctcagggcctgggctgaatgggaagcgtgctggtatgtgtgaaggtcctgttttggctggaggtggaaggtggggtcctggcggagcacgcagggggacctttttgttggaatgatcccaggagcctgcttctcctgagccccccacgatgtatcactgtctgcagcg

SEQ ID NO: 36925 - DNA, 1046 bp, Homo sapiens
tagcattctgtcctaaaacttgggtttctaatatgagtgtgtgtatgagaatatgtgtgtacacacatgcatacacatatacataagtgcatacacaggcatatacatgcgagtgtacacaaacatccacataagcatacccacatacacacagaagctcacgcacatagttttgttttacagctgacagcaaagcaccatcagtttcatgcagaaacccgtgattgtgacccaaagttcgtcttaaacggacactgtctttgcactcctgtttcatcgtgagaaagagccctttatcttatattgtcagcacgcatctgtgccaacttttaaaactctgcagcttctgggtctgtttcaggacgccaggctggcgtgagccatgggagctgctttcttcccccactcatgcaccctgctctgcacgcttcctgcaggcacggttcctttctcacatcagcccaagtgagacaacacctttccgttcccagacaggagatgacacccagggcgcctccttcactgcctgtggtcgtggctccggaactctaaaggagcacatgtttttacgcatttcagaatgatgctggcctcttgcctgggtccggccccctatcgtcattggcactcaggactgctccttcctcccactggaacacagggccatgtgggttctgctcctgcctctgcttgctgttcacagccatggtcggtgctggccgcagcaggtgcattttaagtttttactgtgggccgggcgcaacggctcacgcctgtaatcccagcactttgggaggccgaggcgggcggatcatgaggtcgggagatcgagaccatcctggctaacacggtgaaaccccgtctctactaaaaatacaaaaaattagacgggtgtcatggcaggtgcctgcagtcccagccacccaggaggctgaggcaggagaatggcgtgaacccaggaggcggagcttgcagtgagcggagatcgcaccactgcactccagcctgggcgacagagccggactccgtctccaaaaagaaaaaga

SEQ ID NO: 36926 - DNA, 1023 bp, Homo sapiens
gacaggtaacttggagagggctcatgttatcttatttaacaaaaacattgcccagagcatggtatgataaagacctggcaggaatggagagcgcctcccacagaactttcaccaggtgcagggaggcaggatgcccatggggcgtttgggcagatgccacagggcgatgttgggtgggacccccagctaccggctccaggaggggtgaggaggccttgggctcctcttccaggcagccccactcagagccttgcacagagggcggcgctgcatggaggggcagccggagccaggccaggagcaagagggccagagggaggcaaggtgcaaagcaaagcctggaaatccagacaacactgggaacatcctgcactctctaagttcaccagtgcacagacccgcctgtggatggactcacccttgtcctctgggtcccgcctgtgcccaggactcccaggacctcggaggtatactctaggcatgatcttcattactctgcagaactgttcaccttaatttgctggaggttgtcttaaaacatggcctctatccatccacatatttagcggaattgattaaaataaacttaatactttcatgtcatccttttagggatttcttcaaaggtttagatatttcaagcactgtgttgattctataattcacctgctggagagagttggcttaagggatattctgaaatgaacaaacagccacagtcacctttgaagagccgcacgttgcccgtcccatcccagctctgagcctctgcgaggttctcccctgcctgctgagctccctcccctgtgacaccaggagcggcccctcctccccacactgcaggggcctccagatcccaaggggcaggcccaactccctgagaaactcagggaccagtagccactgtctccctggggacaagggtttgtccagaaaatgtggtgggcaggatgggttggatctgagacaggcctccaggtgccggggtcacaagccagtcagccccggcagcaggcggtcacc

SEQ ID NO: 36927 - DNA, 1035 bp, Homo sapiens
tgtctgagcatccctaattggaagatctgactccatagcacatttcttttgaatgtcatgctggtgctcagaaagtttcagattttagagaatttcagatttttggattagggatgttcaacctatataaatactaaactttgaagtagaaaaactggaagtagatggtttaaacataaagtgtcttggtatagacaagggttctcccactgctcatgacgggagcattattgtaaagcactgagaatctggtacagtgtcattttcgttgctctgttccactctacgaatctgccatcatttacagtcccctgttgtgcatgtagatcatttttgaatttgttattggaaaatactgcagcaaatacctttaagttcacatgctgtaaatctacttttatagttaaaatttttcaaaaggaacacaagagatggttttttgtacatttttgtgcttaacttaccactgactcttcttttcatggtcaccctgggatatagacccgtaatcgacaaaactttgaacgaggctgactgtgccaccgtccccccagccattcgctcctactgatgagacaagatgcggtgatgacagaatcagcttttgtaattatgtataatagctcatgcatgtgtccatgtcataactgtcttcatacgcttctgcactccggggaagaaggagtacattgaagggagattggcacccaggctgggagcttgccaggaacccagtggccagggagcgtggcacttacctttgtcccttgcttcattcttgtgagatgataaaactgggcacagctcttaaataaaatataaatgaacaaactttcttttatttccaaatccatttaaaatattttactgttatgactttagtcatatttgttgacctaaaaatcaaatgtagtaatctttgtattctgttacatcaaaatccagatatgttcttgtagtttctttttttttttctttttttttttttttttttttgagacaggattggtgcagtggtacaatctcagctcactg

SEQ ID NO: 36928 - DNA, 1063 bp, Homo sapiens
gcagataactagccagagcccgtccctttgtttcccataaggaatacttttagtaaatcttaccactggcttgctgtcaataaatatgtgggtaaatctctgttcaaggctctcagctctgaaggctgtgagacccctgatttcccacttcacatgctgtatttctgtgtgtgtgtctttaattcctctagcaccactgggttagggtctccacaaccgagctggtctcagcagtaaatattgaaaaggaatagatacaattgtcattatttacagatagaatttccaaacaattcccagggaataaactgaaaaactaacagaaacaaaacaagaatgtagtaaggtgtctgggtaagagatttgtatctaaaaatcagtagctttgcaatgtgcaagcagtaatctgcttagacatcagtaaatacctcattcatattttaaacaaaaaattaaaaatgccttgaaataatgtaaccagaaatacaaaaaaaaaggatatgaaaacgtggctgctaatggacatgaaagaatgtaatactagattctgagatgcaatttttttcatttgttcttcctgaaaaatcattaggttgatgtgcattacagtgttacgattatgtatgagtctaaggaaaatcagatgaaatttccaaattaaaccatgaaggtgcattggtagaggaagagacaattagggtcagtggagcaaagcacagttagagggagaagcaaggaggaggagggatcactgaggtggtgcctgtctgtcccacaggaagcaaaagctgacgcctacttcccagcatacctaagtaaacttcaggcccactgcatagcacatgtctcatcacagtaaaactatgaaggaactcagtgtacaaggagcttctacaagataggcagaagacagtagccagatgggcctagggccccagccacccacgcccctccctctccttgaagacctgtggctccaacaccaccatcaccagggctctgctcagctcctcctagtgtgtatcaccacagggctgctggcttgtgtcacgttcaccaccag

SEQ ID NO: 36929 - DNA, 1769 bp, Homo sapiens
gcaaacagcagttaggagtagaatgcaccctttttacatcactcacattagggctcatacacctcttccaggacctttgactgcagggaatcaaatggctgatcgcctagttgctactgcaatatctaatgctggacactttcacaatttaacccgtgttaatacctctggtctcaaacgcagatacagcagtacctggaaagaagctaaagctattatccagcgatgcccaacttgccaaatggtacattcctcatcttttacaggaggagttaatcctcgaggattggaacctaattctcaagctctagctaaatttttctctatacggaatattaaacacattactgatatcccatataattctgaaggacaagccatagtggaaagaatgaatctctccctgaaacagcagttgcagaagcaaaagggggaaaacaggtactacaggacaccccataagcaattgaatcgcattattaactttaaattttttgagcctgcctaaaggccggatcttatcagcagctgaacagcatctacagaaaccagctgcaaagacagaagcagaacaactggtttggtggagagacctgataacagaaagttgggaaataggtaaaataataacttggggtagaggttatgcttatgtttctccaggactgaaccatcaagacacctgaaaccttatcatgagcgaatgctgaggaagagattccgggaggatcccgaggacccccccagttgcagccatgtcaagactgatgctgaggaggaccccaactgtcacgagcaacacccgtcaaacacagccatccacctgaggtcagatcaagaagctgtcacagatggcagaagaaaacctgaggtaagtgggacaaccagtcaaaatgagtaatttaatggtagctatgatagtggtgatcaccattgccatgagtattccttcaacaagggctgacacagagaacaattatacttactgggcatatttatcaatcttggctggcaagaatgcctggatgtaatcactctatgacacagttacacatgctttctgatctcagtatttaccatgataaatctgctcctataattgaggcataccgccctcaaaaacctatctgtaaacaggattggacccagtcagagaaaatgaacgtacatgtttgggaagattgcattgcagaacaggcaggggtgctggcaacgattcctatggaatcattattgattgatcccctacggggatgtttagcttgaattgcacctctcagtctgtgtgccacggccccactatgttcagctggtctgaacaaaatggtcagatggtagaaatgataagaaatacggcaagaattcctattatctggaaccatggcggtgtagtggcacctcaacctcaaatgatatggccctttgtaggagctaaacataaggatttgtggaaactgttaatagctcttaataagatcaaaatttgggaaagaataaaaaagcatcgagaaggacactctacaaacttgtctttggatattgcaaaattgaaagaacagatatttgaagcatcccggcacacctgaccttaatgccaggaactggagtgcttgaaggagctgcagacagattagcagctggtaacccattaaaatggataaaaacacttggaagctctgtgatttcaatgaagattgtgcttttaatctgtgttgtctttgtatagtctgcagatgtggatcctgactctgcaagaagtagcccaccat

SEQ ID NO: 36930 - DNA, 1076 bp, Homo sapiens
cagagaagactcgagctgcagctgatcgaaaagcaaggccataaagcccaaataaatagaaacgatccagagaagactcgagctgcagctgatcgaaaagcaaggccataaagcccaaataaatagaaatgatccagagaagactcgagctgcatctcatcaaaaagcaaggacataaagcccaaatcaatagaatcgatgcagagaagactcaagctgcagctgatcaaaaagcaaggccataaagcccaaataaatagaatcgatccagagaagacttgagctgcagctgatcgaaaagcaaggccataaagcccaaatcaatagaatcgatccagagaagactcgagctgcagctcattgaaaagcaaggccataaagctcaaatcaatagaatcgatccagagaagactcgagctgcagctgatcgaaaaacaaggccataaagcccaaataaatagaatagatccagagaagactcgagctgcagctgatcaaaaagcaaggccataaagcccaaataaatggaatagatccagagaagactcgagctgcagctgatcgaaaagcaaggccataaaactcaaatcaatagaatagatgcagagaaaactcgagctgcagctgatcaaaaagcaaggccataaagcccaaatgaatagaattgatccagagaagactcgagctgcagctgattgaaaagcaaggccataaagcccaaatcaatagaatagatccagagaagactcgagatgcagctgatctaaaagcaagtccataaagcccaaataaatagaatagatccagagaagactctagatttgctaatttttccaactccacattcagctactggtgttattgttcaagagcaagatcttgtagaatggctttttcttccacatactaattcatggcctctaactccttatttggatcaaattgctactatgataggaaatgggagaactcggattgttaaattacatggatatgatcctgaaaaaattgtccctctcacgaaggcacaaatacagcaagattttataaatagtcttacttggcaaacccattta

SEQ ID NO: 36931 - DNA, 1269 bp, Homo sapiens
ggctgaggcaggagaatcaggcagggaggctgcagtgagccgagatggcagcagtacagtccagctttggctcggcatcagagggagaccgtggaaagaggggagaggggagagctgtttgtttgttttagagagggtctcttaaggcattcttaaaccacaaacaatagcatgagcgatctgtgccttaaggacatgctcttgctgcagataactagccagagcccatccctttgtttcccgtaaggaatacttttagtaaatcttatgactggcttgctctcaataaatgtgtgggtaaatctctgttcaaggctctcaactctgaaggctgtgagacccctgatttcccactctacatcctatatttctgtgcgtgtgtctttaattcctctagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatggtgagtaagaaggggagctcagaagcatcagggtaacgatgggacacgtgtgggctctggttctaagccggaggacacccaagtactcttacccagtccccatggtgtgtaagaaagggagctcggaagcatcagggtaacaatgggacacgtgtgggctctggttctaagctggaggacactgagtactcttacacagtccccatggtgagtaagaaggggagctcggaagcatcagggtaacaatgggacgtgtgggctctggttcgttccaccttggaaccttttcacgctaataataagggggaaggagagtataacgaagtaacagaagaaataacagagcaggtttgtttgccaactaaagctaaagcggcaaaggagggagaggttcatccctacccttctgcaccccctccttattttgaagaaaaagagtggcctgaccctccagatctttcatttccagaggacagtgggcgaaaagtagttgctccagtgactgtccgagcagcaccttgagcgacccctctcagttctattcaggtaggaattcagcaagctagatgagagggtgatttagaggcttggcagttccctattagaatacaccccgcagatcaacagggaaatatagccacatttgagccttttccctttaaattacttaaggagtttaaacaggctatcaatcaatatggaccaggttctcatttcgtaat

SEQ ID NO: 36932 - DNA, 1037 bp, Homo sapiens
aaccccacccctcccgctttttggagcccccagtctctgctagtccactccatgtgtactcaccgttcagctcccatttccaagtgagaatgtgtgacacttgaccttctgagtcacttcacttaggatagtgacctcctgatccatcctgcagccatcttctgtggctgcagaagacatgattgcattctttttttatggccgagtagtatttcatggtatatatgtaccacattttcttcatccggtcatccgttgatgggcacttaggttgattccatgactttgctgttgtgactagtgctgcgataaatacacaaggctgcaccagaatctggaggtaaacagcggtaggacgtactcctcaccgtatcaagaatatgaaagagaccaggaggcctgaactatacagaagtgcacttcttttccacatagaaggtcagcagactagggcagaattagtgactgcttggcatccaggacagccttctgtggttcactcgtgtgtgcttgggtgtgacctccgtgacctgaccgtcgatggctgtcatggatgagtcacagcgtggaggagagggaaccgcaggaccgccggagaagctcagtccccagcagggcagctttctcttagaggtttcctggagttcaacacaacactggtgcttacatctcaggcccggatattgatcatgtcatcatgcctggcttccagcagcttggaaatgtctttaagctggacctgttgctggccctaaatatactcggaagagagggagagtgggcggcgggtggaaactgatctgtggcctgtgcgctgggagtcggtccagtaggaccatctgtgatgatggaaatgttccgagtgtttgccatccagtatggcagccattagccatggggccgtggagaacctgatatatagtcagtctaagaaactgaattcctctaataacaaggattcttgtccatgaatgagatctcttgtctactatttgcaaggatttctgcatattttctaaaaagaagtctattgcttt

SEQ ID NO: 36933 - DNA, 1030 bp, Homo sapiens
agaggaggatgcagagcccgggaaaggcaccctaggcagagggcacagcagggcaaaggcctggagtcaggcctgagcctgtgtggtttgaggaacggacagaggcctgcccggcaggaagggaacagcacaggggagagaccttagaccagagcagagggcagggctgtgctgggcactgtgggctgtggatggtgctggcatttaagaggggagaccatagaccagggcagagggcagggccgtgctgggcactttgggctgtggatgggagctggcatttatgctcaggtgatgggaatatgttaaaagattttaaggaggggagtaacagttgggattaatgtgtattctgggaatctcaacaaagtaaattcatagttcgaattttcataagatttctgcacaggcagagagaaataagatcgtgtctacagctgtgtgatgattttatttaaaaatattactaagattttaaacgtgatttcaaatggtgtgtttctatttcacattggacataagtagattgcaaggctaatggaaagtagaaaagttaactcacgaacataaaagagatatcgatttgaaaacaaaacatttattcatttacttccgctgcagatttcttgactgctgaatttcatgagaagggattgttctgtgagggtcgtggagctggagatccaggtgggagaggtgttctagcttggggaggagctgatgttccaccttgagggccctgcagctgcagacccggagaggagctgatgttctagattgagggtcgtgcagctggagacctggagaggagctgatgttctagtttgagggtcttgcagctgcagacctggagaggacctgatgttctagtttgagggtcttgcagctgcagacctggagaggacctgatgttctagtttgagggtcttgcagctgcagacctgaagaggagctgatgttctacattgagggtcgtgcagctgcagacctggagaggagctgatgttctacattgaggggcatgcagctg

SEQ ID NO: 36934 - DNA, 1085 bp, Homo sapiens
ccagcgtgtcatttctaccgcactctttcagtccctagggtgagcccagattcagggggaggcaaggagctccccttgctagaggatgaccacacctacaactggtaaggacttggagggatggagtgggctggtccttccctggtcatcgggattcatagttgagtgagccccatgccttgggggagcactgtcatcaacatgaatttgggggtggggagcacagtccaacccagagcagatgctgagatgcgacagccttctcacggctcctttcctcctggccagggacacctccccttctcccagaaaggagttttgtgagacaggagaccacgcaagaagcctagcgcggggggagcgccctcctgcccagatcagcagcaggggcgcagcagggtcacccagaaaggcctggtggggcggcagagggggcagcatggccacatgagggccaaagctcctccccagcacccacatcacttctccagggggagcagacgccggtgtgtgttgctgtgaactctgtgctgtgcccattcaccctcacaaagggcctctgcaagcagcttgacatgggcattgcagcccgcaggcgtctggccagttgaagaaggtggagagcgttattacctgaaagaaaagggaaccagctctgcgaagagcctgcttctgttgtgcagtgaaagggaagccctctctcgagccgttcttaagtgaggagttgatgcactagagtgtctgtcacgggggcccctgaaagtgtcagaagccagaccccactaggagacctgttatgcactggggctgagaatagttcagcaagagagaggactttcctcaagcgtgtgtgtgtgcgtgcatgtgtgtatatggcacgtgtgtgtgcatgcatgagtgtgtccacatatatacgcgtgtgtctgcatacactacctgaacaggcagtgtgggagggtgtgatgggtcagtggcaccgctgtagtgaccctcagcagactgcaaccttcagccagcgtgtgctgtccatgtctctgatctctcacggggtgggtgatgtggttttgagaaccacagggtcctga

SEQ ID NO: 36935 - DNA, 1004 bp, Homo sapiens
ggtttcagtcgtggacagcagctgtgtgctggtcctccactgccattatcctgtgtgtgcactcacatgcatgcccacatgcacacacgcacacacacacacacaaatgcacactccttttatgtctcctatggttgagtgctttctttgttgaaaaggccaggcagcttccttgagcattttgtgtttttgtggaattgaccaatcaatttccaatcaatcaagttcagtcctcttgggtaaatacttagtgaagtttctgggtcattgggtagatgtaggtttacttttagagaaaaagagttttccaaagtagttgaaccaatttacactcagcaaaaatgtctgaaagtgaagttgttccatacttcatcaacatttgatgttataagcttaagtttcaaataattaaatagatgatagatatagatagatcaatgataactagatagctggatgatagatagatagatagatagatagataagtggatagacagataagacattgatagagagacagatatgtggatggatggagatagagagctagatagagagagatatgttgatagagagagatagagagatgagatgtgagagataggtaaagacatggatggagacagataaataatgagatagagagatagagagatgaagatatagagatatcttcatggataaagagatggagacaggagagaaagagagagagatagagagatagatagggagacagagatgatagagaggtagatgatagatagatagatagatagatagatagatagatagatagacagacagacagatgacagatagtcaaatcgacagatgaaaccagaggaggaaaagccgcagcatcccggggtggacattaaggagtcctgggtctaatctcgcgttgtttttaccagttatgaacatggggccctgggtgtctctttctgctgcccgagaagatggttcatcatcatcacatctgtcttctctctgtcagag

SEQ ID NO: 36936 - DNA, 1053 bp, Homo sapiens
aagggaaatgatagagacatttttaaaaaaaaaaaaaagtggtttccttggtttgagataggggaggaagggatgaacaggcagaaggatttttagggcagtgaaagaattctgtatatcatagcggtggatacatgtgttacatttgtcaaaactcctaaaatgtccaacactgagtgaaccccaatgtagactatgaactttggcgtgacacgtaacaatgtgtcagtgtaaactcactggttataacaaacgtaccactatgagtgtggtgttgatagtggaggaggctgtgcatgcatgggggcaggtggtatatgagaactctgtcctttttgcttgattttgccgtgaaagtaaaactgctctaaaaaataaagtctctttggagaaaaaaagacaacaaaaaccaagagcaaacttccaggcagtgggagtaatgacaggaagtctccctatctggagtgaatgtggcatgttaaagcatcagaagtcagctcaggtaacccagactatagtgaacaaggagccacttggtattgatttacttaagaggagggatggggcacaggccagatcatgtagagtcttgtaagccagggtagaaaagttttagatctttgaagaggttaaagaaatggagtggcataatctgactttactttaaacatatttcatactgcctctcatgggagatggactgggacaaggcagcagaagaagccaggacaccagggaccaggctgtgatccaggacacagagaatggaggcatggctgcagtcctggcagtggagttagatggaaatagaaggagcgaggatcccaaagtgtattccaaagaggctgtactacatcctaccagcagtatatatgagtgtccaattcctccccttccttgccaacactagatataatcagtctcttaattttagccaatttaatatgagtgtggtagtaattcctcttgtgtatttccttaatgcacacttcctcaatttgcttttctttttaattaattaattaattttattttactttaagttccaggata

SEQ ID NO: 36937 - DNA, 1122 bp, Homo sapiens
tccagaattgcgggagaatacatttctgttgttttaagctgcctggcttggggtagtctgtaccgcagctgaggagatgtacacgatggcctttagagtccgctctgaggcacccctggagactgctcctgctgtccaggacttgaccgcagcaaccacctgacccgccctcatccctccctcacctcattcccactcgcgtccaaatctaccctcctcaccctgctgcaatggccttgcgcaaacacacctctgatcatggcccctgtgctcagcgatgcttggaggccagcgtggcagcccaatcacaattgcccagcgtggctacgtgccctccagggtcccaccgcattccctgggccccccaggccctcacgtcgccgtgcccacccttcgttcttcagggaccactgtggggtcaggtctcagcatcgcccccgcctctgtttctattatcaggaagccgcttgttccctgtcttgctagcaaatacctgcccatgttttcacattcgagccggtcctctgcgctccaggttcaagcaattctcctgcctcagcctcccaagtagctgggactacaggtcgggcctggttagtactcggatgggagaccgtttattcattttataagcaatcgtaataaagacacacggggatgtgcagtgacctggttctgccctgcagaactgctcagcatgtttgggaggaaagatgcattcagaaacctcccttcaacttctccttggccactgtgtgagtgtcttgatgtcactccaaatcagcatgggaaggccagcaatggggtccaggtggggaaactgtgcttgtgctggacactggaggatgcggaggctggagctgccgcagcagagagggctggcactgagcaagcctcggcaggtgggcagatgggggcaggcgggttggtgggtctccttgagatgccacatttgcaagcttgagaagctgaacttgaaatccatccttggaaaatcattttgcaagcaggtactaaagcaataattgcccttcccttggggggccctgaggaatgaggagagggaacctggaggagggattttgcagaaaactttagcccattcagttgtataaactccaa

SEQ ID NO: 36938 - DNA, 1027 bp, Homo sapiens
cagaggaggaggggctttgccaagcagcagggctgacctagaatggaggctgcatcgtggaaggatccgcctatgtcacccaggcccgaacccctggatctcatttagttttttcttttgtcaagagttgccttaccatacaagctgctgtaaggatcaaaaaggtaataaatagcatgaacgaattttgaaaagtgcaaatgctaaacacatgtaaagtggtatggcttgtgaagcgtgcttgggtttatcagtgatcattacttgattttatgagctgttcgtattatcagaagtaatgaaatcagatgatctgtacttgtgtaaatgagggaatattaattcccctggttcctacactgagttttgtctaaacaaggccgtgtgcagttatatatacctaacctttattcccccatacctttcagaaagctgtgagaataggtgtcagtcatgagaatgctaattgaaatatatcgtgtttccagatatatagatcaaggtcgaaatccccagctctacaccaaagagtgcctggagagggctctagctaaaaatgagcaagttaaaggcaagatcgacaccatgaaggtaagactctaaggagtgtcagaaatacagtgggaagagatgccttctcagtggaatttggttaagagactcatttttttccatacttgctagaatattgactttcataacttcacatattgagatttctgaattgtgtaataggcagtaagtaaaattagatatcagctgcgtaatagcataaaaaacatacactaatcttactcttaaggaaatccagagtaatttttgtgatagtagttctcactggctgtgatcattttcatttttttaagatgcacttttattgcattgatactttctatttctgtagtaattcctactgttgaaggctttccctgtagtcatggttctttgttttagaggattcttgaatattgatttttctctttgtccagcttctgacctccaaacttctttttaccatatccattgt

SEQ ID NO: 36939 - DNA, 1054 bp, Homo sapiens
gtgacctgttaaaatgttaaaaaggacatgtattttttaaagatctttaagtaaaacattttgctcattcccaaagccaaatttaaattataccatggccctaattcagaagttcattctttggcaggtgtttccttggtgcctggggcactctctctttctcccagttcctgtggcagtttgtccaggtgcccaagaacaattcataccctcctttctcgttatttatatacttgtctttttgcccctgccgggtattttagaaatcgtgcttggtgcactttgtgtccttcagtgtgccttacccagagcagatgcacgataagcatttttacacgagaacaagctggtggtgtaggcctctgctaaggaacaggctgtatatgctctttgtgggattaaggtagaatcagctttaactccaaagaaactgtccatgaattttgtttataatagcaagtagatttaaaatgacactttaaaaaaattctgttgtctttctctacatataatgctgtagaaaaatataactgatggattttgtgaacgtggtatttttaacttttcgtagcagcacaaagaatgctcctctttgtgtgtcaatgaaattgttctttatgacagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtgggtaagaaaagtggttatgtcttgatctaatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttacca

SEQ ID NO: 36940 - DNA, 1044 bp, Homo sapiens
tccgcctcctgagttcaggcaattctcctgcctcagtctcccaagtagccgggattacaggtgcgcaccaccacaccctgctaattttgtatttttagtagagacggggtttctccatgttggtcaggctggtctcgaactcccgacctcaggcgatccgcctgccttggccttccaaagtgctgggattacaggtgtgagccactgtgcctggccttgctctgtgttttttaggtgaattagttggctttatcattcacacaaccctctaagggcagatactgtcaccatctccatttttccagatgaggaaaaggaagcaaggagaagtacttgaactgaggttacggagctgttaactggctgagctgagatttgagtctaggtagctctgttccttagcattatgttttcatgattcttacttgttcatctctatatttagtctctctggcttacagtttcattctcctcccatcctctttggagactgtacctatatcattctgtgattttggggcagtgtagaatccctaaaagtaaattatgtcatgctatagactctgtaaagaagtatatttagatcttggactagaaattgaaaaactagaattgctttaaattaaatgtagaatatttggttttttaaaaacatgaaacagtttcttgctttgttaatagatcttagatatgtgtgcagcacctggctcaaagaccacacagttaattgaaatgctacatgccgacatgaatgtcccctttccaggtatgcattggacttgtgttcaaaatggtaggaatgccactttggcagattgtagacaaggaaaagactctaactttgcctgctaatttggctctaaagtctcctatgacaagcagttgggttttccgtctaccggaagtagaactggacatcttgcctaccaccgtcagtagtactcaaacaaacacactcataccatgggggagctttattttagaattatgtgtgttttctataaaaacgaatggcatttcttttttttttttttgagatggagt

SEQ ID NO: 36941 - DNA, 1050 bp, Homo sapiens
ttgtctgcacctgaatagttctgccttgtaacagatgtcctggccgactagagaagacagagggcagggagtgtggtgaggaattttagatattgaaggtctaaagatggaaagatggaagcagtggttgatgtcttcatctctttgaaaggtagttatgagaaatagaaagtgggcatgggctatgtctgaaaatagtggaggactaagaaatagaattttaggcaagaaggaaaaaccatttgacagtcactttctgtcctaagttgatgctgtctgttgaaggtatttgtttaaatatttaatagcatttctgtctttgagagctgcccctctagcttctgtgctctactgctatggggagttggggctctgtaagcttcaagtcccttttctttcatggaagttggtattatacctgaatttctaatatttgaatggtatagcaaccatttgtccgctagtgtacagatccatctcatttagtgttctgtgtgatagtatgagttctctcattctgtataagattatgtgctgttttcctgttgcctttgaaacaatgccaaagattgaaattgtctgcggtttttttttttttcctaattgttgctgattttttttttttcctcaagggaaatattagtcgtcaagaagctgttagcatgatcccaccactgctcctcaacgtgcggcctcatcataaggtagcatatagcaactagaaacgtgggggcgggcagcttgttaccagtgtcatgcctgtttgttttgatgaaaccattttttcttaatataattagtcctttttttcttcttttcactttggatagagagtgatatgtacgtatcttagtttcttttttttttttttttcttttttgtcctacttaatttttatggtttagaaaattttctcccctttagttttactgatttgtttaccatatggattgtcttcagtgatggtgattggctaaattaggttgaaaatgatagtgaacatgtattgagagctcattgtatggcaagcattactctgtgctctttttt

SEQ ID NO: 36942 - DNA, 1035 bp, Homo sapiens
cacgagatcaagcttttcttcctcctggtaactaggttgtagactttgctcaagtcgtttggtttgaagatttgattgacgacactgattgtgttgtacttgaagtagaggtctgatactgtagtagtccattttcacactgttataaggacatacctgagtaatgtatagataaaggaaataggcttaattgactcacatttccacatcgccggggaggcctcaggaagcttaaaatcatggcggaagatctctctgcacagggtggcaggagagagaatgagtgctgagcaaaggaagaagcccctaataaaccatcagatctccccctgagaacgaactcactgttgtgagaacaacatgagggaaacggcccggggatttaattatctccacctcgtcctgcccttgacacgtggggaatattacaattcaaggtgaaattggggtgggaacacagagccaaaccatctaaaatattttaagaagacaggattacgattctcctcgggcatgtttgtatttttagcagtgatgcatgtatgtgctgcttcacacaatcacctggaaacatttgtttctaaaaccttgtgtttagaagcgcagagacgggataagaaatgcttttaagatgaagaagttcctgtccaggaggaacgtttcagcatgtgtctatagggaagaggtgtgctcttaaggcacctccatgtgggcattttcttctgcaggctccaacaaactaggagaaaccatacgatgtcaataaggcttgctagttttttattattctctgcaaactacagttacacttggatttgatcagcccttttaacatttcatagctgcttttccaccttgtttaacaatgtgtctgggtatatgacaaggtaattaccaaactcttagaatctgcaggttgtctgtagttgaagaatgaaggtgaattgctctctgccaacagccagctatgtttttgtttgctttaattttctgaacacacagctgaagggtatgaacaaaacattgtagatctgg

SEQ ID NO: 36943 - DNA, 1034 bp, Homo sapiens
ctgttctagacattggggatacaggatgaagaagctggttgggatatttgccttccaggagcttacattccgctgtggggaagcgtgtaagaaacaaacaaagtaaccaatagccagaggaacctcagattttgaaggatcttgaccagttttacttttctacctttacagatcccctatcatgagattgggatgctaaaatcaagacgtgaattggtggaatatttacaaagaaaactgttttctcaaaacactgttcattggttgcaagaatgaatactgacttcagaactcaaacaatggaagaacttgcatttttatggaactcagtattaaaagaaaaatataatgtgaattagccactttgcagaatatgttctagactggtgatctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagtattttgtcatagttatctgctaaatgaaaatattttgctctttagagaccttttgttttctaacagatggaggaaattttttctctttgtgtgctgtgagtggaagtgagatttaccgtaaggaaaaggagcaatgagaaatagagtacagtgctttggatataaatattatagaattatgcagaaacaatcttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttcaaggagaagaggacaagagagccgactggagtagcagagtgtattttttgaaggagggaggagggatacaattgaacctgtaacaggttga

SEQ ID NO: 36944 - DNA, 1069 bp, Homo sapiens
tttgggaggccgaggtgggcggatcacctgaggtcaggagtagaccagcctggccaacgtggtgagaccccatctctactaaaaatacaaaaattagccgggcatggtggcgggtgcttgtaatcccagctactcgggaggctgaggcaggagacttgcttgaacctgggaggtagatgttgcagtgagctgagaccgtgccattgcactgcagcctgggcaacaagaatgaaactccatctcaaaaaaaaaaaaaaaaaaaaaaaaaaagaaaaaaatgacttttcttggcctttaagctcttgtttcttggggtatcagcatctctgctcttactatgtattgaggaagggccaaaggccacttactgatctttgccattctaggtaatttaagaagaatgagtatagcctcaggcatcacaaaaaccactgctaaacactctaatttgctgtcaatcctacctttaggtaggttaagttaaatttttaaaaatctaaactgtaagtctctttcttgataagcgactatattatttacattatttgttattactgacatgtttggacttattactaccatattggcttctgttttctgtttattatcccattttcttgctgctttcctctttctgttgaatcaataaagttttctatagtcttcctttaacctttctgttattttgaaatccatagattatatttccatttttttagtggttattttaaaaactataattgactatatgtatttttttcttatactttaatttctggcatacatgtgcagaacatgcaggtttgttacatagttatacacgtgccatggtggtttgctgcacccattaacccgttatctacattaggaatttctcctaatgctatccttcccctagcctcctgccctcccacccactgacaggccctagtgtgtgatgttcccctccctgtgttcatgtgttctcgttgttcaactcccacttatgagtgagaaaatgcagtgtttggttttctgttcttgtgttagtttgctgaaaataatggtttctggcttcatccatgtccct

SEQ ID NO: 36945 - DNA, 1066 bp, Homo sapiens
cgcacctctggttcaacagaagaagggtgggagtgggagctgtcaaggatcctgccttttcaagagaaacccagctcaaaactacttaagtaaaaaaaggcaggtggagttattgacacatgtaactggaaagacaggagatattttatacagagcagaagaaaacatatctgttttctttatgcggaactatcagaagtagccagaaaatttctctttatcacagtctagaaactattaatagtaataatactaaaaagtggccatctaaatatatttgagtatactggtgaatggccaattttttaagtgatataaaaccaaaatattaataattactgtaattatatataatattacaggggtttaaagaaggaagaagaggcttttgctggaatagttagaaaaggtcttacagaagagttaaaatagcgatatttatatgatgaatcatgtgagatattttattacagctctgggatcgtgaatagtgaatctggaatttttaggactcatgatattcagctccagccttagtagtgttcttggaatgtaaatggtcactgttcagtggagggtatccacttcggacttccaatttttaggcaaggatgagagtagtggcaaattaaaaaaaattggactttgttcccaagtaatcaaggttatccctgctttagtttattctttttaaattagaagatatgagaagaaccaaatcaatctccagaatttattacccagaagacagtaggcacttccactcaataagttaaagtgcatggatttgaaatttaagtaatcctgtattggaacaagacaaggaagcatttaaatctcaatccagcttctccctcatctgttggggcatatgctttaggcagtgtaagtggatgtaggaaattaatcttccaaaaggccaacaggcattattcccacatactctaacaagaaggtcaaattccttatttctaatttgttttaagtttcaggaagaaatttaaaatctgagaaataaaaaaagggaagaaagtatgttgttctgtctatagatgccttgctggca

SEQ ID NO: 36946 - DNA, 1046 bp, Homo sapiens
gccactgtgcccggccccgtagttacctctttaaagactttgtctccaaatacagccacgatctgaggtcctgggagttaagacttcagcatatgaattctggaggggaacacaattcagttcataaccatgtctttccaggttaattacagcatcatttaattagtaagtcactgcatgcagcctagacgggcattggttggagactagtgaagtacacagctagtgtatggagcagctgtgaggaagactgtccagtgacctgcaccagttcacatgggattcccaagatacagccttctctgctatcacatgcactctgcccggcacacattaaacataaccagctctacagaaaaggcagcgttattgggacccctcttgagacatgtgcaacttccaaacctgaacactgacagaagcaatcctggtacacagggaggtaacttgggcagtccgggcaggtagctcagtggagctgaaactgcttgaggggatgatgatactattaatagtaataatggcgtggggatgctgctttggggatgacaggcacatgagcactgaaggatttacaccttattgcaagcccaggaccgacaaggtaggaactggcaaggtggggtgcccctctctggggccgtgcaggcactccttttacattttcttaagacactactgaaagatcttcatatggagagccatttcctttcttgctgaaggttcttattctacactcgtaattcaaagctaagctccccttgcctagaaaaaattgcctgtgaaccaacgcaacttgcaggttactctgacatcattcctctgcatgccagtggtgtgtgagttaattggtgttatagtgacaagtgtagcacaccttgagtgcaaaaacaagggcagaacattgtgagagttgcttctatttatgtgaaaaagagtgttcacgtgttgatgcatgcacacatatatgtgtgtgtgtgagcatacacatgcacttgcatatcatgttagaaataatctgtgcaggctgggcgcggtggctcacg

SEQ ID NO: 36947 - DNA, 1084 bp, Homo sapiens
cagaagccacactgatcaacagaaatacattccggatggtcaatgccttgaaaacatatcctaggcggcacaattaaagaggctgtgaatgtttactctggacgagaggatgtttggaggcagatattttcacatatctgcagggctgccatgcagatgaaaggaaggtagtggacacgactgtgtgccaggggtttccatgcactgtatacccttctcctccgcagggacatagccctgtcttcctttttttttttaaatcaagggtagttaacttgctcagaatcacagccagacacaggagcaccaggtctttattacactcagttgctcccctggaagtaaacctgttctgattggctttggggggcaaagtagggtcattgggtggatgttgaagggatatgaaatttaagctcagtacaaagtaccgtcttaacaaagtcattaaaagttagaatgcgttgcctgtgggtgtagttccttctgcctggagatgcagagcggaggctggacagccacttggtggggatgttgtagaagggatccatccacaggcaggcatggagtcctaaaattaccctgaacgatgaggagttttccagtctgagcagggccacctgaatcctttcggcagacctccgcggaagatctgtgaggcactaaagcagcctttggcaataaaagtgtgtcacgtaactccatctaaacctagcatccccccagacattagggcgctgtggcaatttttcactctggtattgcctaacaaagtagccaaaatattggcaaaggtgatggatgaaggtaaactgtatcagaatccagccaggaagtgtggatgctcagaagagaaagttggcgtctgtcagatcccagagggtttagctggagctaacacagtgatgcttactccatgccaattagaactgagggactgttcttgaagcccctggtgggaatatgtcactagtggtgtcttatcctcttttaagtgacactgcttcattgccaagggagcagccttatgaggaccaaaccttgcccctttccagcccttccccaactgatgggatcagtgttg

SEQ ID NO: 36948 - DNA, 1083 bp, Homo sapiens
tttctttacccccatcactagcattaatactagcactagcattagtagcattcttcctcccaccgccccctccgccgacccagttcgttttccactgtgaaatcagttttacaactcattttaaggggcttcaggaatcaagaacaaagctgcgctgagtgggggatgctggcgattggctggctgccctgagggtgacccactgctgtgtgccagctttctgtgtgtcttgggttcaaatttgtactgcactagaatagattgccgtagttcatgggtgtggtgggaagaaaaatgtcctctccaggaatgtccacattctaattcctgcacctgtacagatgtaatcagtggtcttgagatgggagattattttggattatttatgtgggcccagtgttatcatgagggttcctataaattaagagggagccaggcatgtgagagaaggtgatgtcaggacagaagcagagattggagtgatgtggggtcaagagcctaggaatgtgggcagcctctggaagcaggaagagacaagaaaacctgcccgagggcccccagaaggaacgcaggcctgccaattcatttcagactgacctccagaactgtatgataataaatggtgattttcttttctttttttttttttttgacatggagtttcactcttgttgcccaggctggaatgcaatggtgtgatctcggctcactgcaagctctgcctcccgggttcaagcgattctcctgcctcagcctccctagtagctggggactacaagcatgcaccaccacgcccggctaattttgtgtttttagtagagatggggtttctccatgttggtcaggctggtctcaaactctcaacctctggtgatctgcccgccgtggcctcccaaagtgctgggattacaggtgtgagccactgcgcctggccataaatggtgttattttaagccactaattttgtgacaatttcttacagcagttataggaaacctataactgcattcgaccctgttctaagtgctttacctccatacactcatttcatcctcacaatatccctgtgacccccactttgca

SEQ ID NO: 36949 - DNA, 1046 bp, Homo sapiens
tacaggtatgaaccaacatgccccattcagtagtgtgcttcttacaaacagaaggtttatggcagccctacgtggagcaagtctgttcgcaccattttttcaacagcatcatgctcactttttatctctgtgtcacattttggtaattcttgcaatatttcaaattttccactatttttatgtctgttatggtgatctatgatcagggatttttgatgtttctattgtaaatgttttggggctccacaagccatgcccaaataagagtgaacttaatcgataaatgtgtgttttcctactgctgcactggccattcctctatctctctccatctccttgggccctcctatttcctgagacacaacaacattgaaattaggctgattaataaccctacaatgggctccaggtgttcaagtgaatgagtcacacttctaccattttaaatgaaaagctagaaattattaagcttagtgaagaaggcatgtggaaaactgaaatagactgaaaattaagcctctggcatcaaacagttagccaggttgtgaatgcaaagagaaagttgttgaaggagattaaaagtgctactccagtgaacacacaaatgataagaaagtgaaaaagctttattgctggtatggagcaagtttgagtggtctggatagaaaatcaaaccagccacatcatatctttaagccaaagcctaatctagagcaaggccctaactcttttcagttctctgaaggctgagagaagtgaggagagtgcagaagaaaagtttgaagctagcagtggtaggttcattaggtttaaggaaagataagccatttccagagcatgaaaatgcaaggtgaagcagcaagtgctgatggagaagccgcagcaagttatctagaagatctagctaagattgttgatgagggttgctgcactaaacagattttcttttttttttttcttttgagacggagtctcgctctgtcatccaggctagagtgcagtggcctgatcactgcaacctctgcctcccgggttcaaatgattct

SEQ ID NO: 36950 - DNA, 1035 bp, Homo sapiens
ccccttccgtgagacatgaacctttggggctcgacattgcaggcgtgggtctcttacaaattcccgtctcatgtgcttcgatggctctttctacacgtcgacacaaaatcctaagcacccgactgttagggtgtgctcctgagtcgggtcctgtcccccagcatcactgggccccgtcagcatctgtgggtgtcaccctcactctggctttctgtttcctctccgatcctgccccctgaagagtcccttttccctgtgagttctttcatcgctattttttgttgttttgttgttattcaatccggcatttctagtgtctatagccttactctgcagtgttgccagaaccagaagttaccattggtttctcacataataccatagatgtagctaaaatgaatttttttctataatcttgatttgaggtttacttaccatttatagcctttagatttgcagcattcagaatataacgcatgtttctctctccatagcccgacttaaatctctgcaatggctaacgaagcttatccttgtccgtgtgacattggccacagacttgagtatggagggctaggccgtgaagttcaagtcgagcacatcaaggcttatgtcaccaaatcccccgttgatgcaggcaaagctgtgattgtcattcaagatatatttggctggcagttgcccaataccagatatatagctgacatgatctcaggaaatggatacacgtatgtataaagttgtgtttctttgtttaaattcatacaaatttcagtggtttattttgttccctttaaaaaataaaaccacagcggtctgactatacagtatctactgtacattagaaacttccctatctcactgccgtgaagatagatgggaaatgtcttgggaaattaaacacccacctggtgctcctaaccccattcctgggtttcctgtcctcctgggagtacctggcctttagacttgctggacattgagaattcttttcccgtgtggggcctcagccagacgcaggcactggacatctga

SEQ ID NO: 36951 - DNA, 1033 bp, Homo sapiens
tgcactcctgctacggaaagacggctgtgccttgttgaagatgatactatatgattcgctaccagagtggggccatccctgcttcaggctgttcctagatgtttaaaagaacattccaaacgacgttaagaaactttgtgctgccatttgtgtattcctttccaaatcttttctaaaatgttagaattcagaccacagttcctgagctttggatgcaaactccttggccctgaatccctggaagccctcccctgtggatggtatcagccatcacagcaggatgtgctttaagaatccaaatgaattcagttataccacgtggcgggacttttaaacttgagctgagcttactcatttctggccgactattaatcctatagctaaatcatgtacgtaaaggaaggggaaaaaaatccaacctgggtaaccacacaacaaacactaaataaaaccaaggtaatgtatggggcatctctgtgctgcttagtaaaacttgaagtttcttaatgtcgcgaagtaacagaaattacttgggggaatttcaggtgtttttggtaaactctttggggaagtaaacagtcagtgaactttcggaatgctgggacttttgactgcagcaaaacaaagctaagacaagtggattccttaaaaaagaccactggcagcagaggagaagcagagctgggaagagacaggctggtgagctcaggggataaattctaccccctctacccagcaggactggccttaagcaaaactgaactaagagggagatgcttcccctccacccacctccgtgagtgtccccgatcgatcgcgctgtcccagctgggctgaccttgtattcacctccaggtcttgggtgtctgtacctcttggtggaggcatttggaagtgcacacaccttgtccactacctcaaactgtgtcctgatgtttttaaattatggcacacgtagccataaaaaataagtgtacagaagagtatataattacatggagagatgcttgccatagccttagttcagaaggca

SEQ ID NO: 36952 - DNA, 2020 bp, Homo sapiens
tgctggtgggaatctaaaatggaacagccgctgtggaaaacaggttggtgattcctcagaaagttaaacacagaattaccatataacccagcaattccacttctgagttacacacaaaataattgaaagtagaaactcgagcacatatttatacacccacgtccatagctgcaccattcgcagcagtccaggtgtccatcagcagatgaatggataagcagaatgtggtctgtctgtacagtggaatgttattcagcctcaaaaaagaattcccacacattctgcaacataaatgaaccttgacaatattatgctagatggaataagccagacacaaaaagacaagtactgtatgattccacttacatgagatccctagggcagttaaactcacggtgatggccaggggctgggaggaggagagaatggggagctagtgtttaatggggacagactttctgttgggaatgatgaaaaagttctggaaatagataaaggtgatgatagcataataatatgaatatacttaatgccactgaactgtatacttaaaaatggctaaaatggtacataatttttttgtaattagttgctgagctggctggggtttcaaagcgaagttagaagggagggagagcttggactgtctttaggaagaacgtttgccttgagcagaccagagctaaaggagaccctcagtctggtgtcctgtcacttcccgccgagtcgcctcttgcggctcgataagactttctcatgcaacacaattcttgaatattgtgtaaaaagtgcagtcttaaagcaaggacctcgcctgcggaagtgctggacacatggggttcttttctttcagtgccttatttcttaccagtgccaaacagatgggggcgctggagcacagcagtgcaggatgaagtctcaggccttcatgttgttcttccccaggttaattaggtggaatgcacactgttttggttgtgccccaagagactgctctgacctaagcttgccactgagtgacattccctgtccctgctcctcagctcggagtcagccctcagggtgtgcacaagggcaagttcacggcctttccatcctgagtgagtccctttgactgcggcatcagaccctcagtcttgccatcactcagccaagtcgccagcaccacatccagcagaatgactagccactttgtataggatgcagcacaaaggacaccagtccctggctcatcgccacacccggtgggcctcacctcacccctcgccacccagtggttggcagaggcacatttcttatgctgagcctagcatgattttcattgacatcctctgtctttatgagcagaatccaccaagccactaaagctcagcagattcagtcatgactcagcacaaaggagctatctccgtgaatttggggtttcacaaggacagcgccatctgtgaatgactcctgtggactcttagacgctgcaacctgcaaccatggccctggacactcctggaatgagctgggcctgtggggggagggtcattcttactgctgggggtctcctttagcccccagggtctccatggccattcagcagttgcgatgggacagtgtcttgagcagctcacatgggagtgaggtgctaaatgtgggtttaggaaaggaaagagcgtgccctgggagtcagaggctggtttctaggcctcagcttccgtgtgtgttttccagcactcaggctagagcagagctgtcatgatctcatatcatcactgttcacacacatttctccgggtacatactcgaggcatagaaccccacccttgtcgtgatcaatgcaggagacgcccagaggacagcacctctgaggagcaccgagggcagggaggaagggcgggactgtggcaggcccctgggctccagactcccgtcctcagtgcacacaggggaccagtgctggagacagattcctgatagccaggtcccccgagagcctcacgtggcagctactacacagtggggctgggct

SEQ ID NO: 36953 - DNA, 1071 bp, Homo sapiens
tctcattggcttgtagatggccgtcttctccctgtgtcctcaaacagtcttctctctctgcctgtctgtgtcctgctctccccttatagggacaccaatcatattgggtgagggtccaccctaatgatgttgttttaacttaatcacctctttaaaggccctgtccccaagtagagtcacactcagagattctgggagttaggacttcaacataggaatgtgttgctgggaaggacgggggtgaaattcagccagaacagcctctcacttggcacacagtggttgcctgcctcaagtccttcctgccctgcctggtcctgcgtttgaggaaggattatgtagtatattactttgtacccacgcagtgcttgcaaatgctagacacatgtcatttttcaatgaaaaactaacttgctcttgagtcccaaacttgggtttaatgaagccagtgaatcagcagttcttgaggctctattcagagcactgtgtgagaaagagtaaacagacgtcccacccagagtaaggtggctgaggtctcatcaggaagatggggatagacagttggagggcagggtggtgagaagcaccgactccaggaaacacaggaagcgctgtcagagttcagaggatttttaatgccgatagagtaagagagcgtagaagttatggctctcacagagcataaacgctggaggtaggtgcacgtgtgtcctcagaggaccagtgtgggggcagtcattaggagaatcctgtaaacactgctccttcctcaaaccagggcagttacgccccggtgagaccacctttgtctccagtcccaccctgtctgaggctggccttcatagagggtggatgcagacatggatcgcctggcatcagggcaaagttcaaatgaaattctgatgaaggtaaaagccccaggccaccccgggtgagcggacttcagccaccaactgggagccatgcgctgctcttggccctgctgatcccgaggtctgctcacacctaccttccccttgctgtgtacagcagagcaaaacccttttctctcccctcatttcaaaacatggg

SEQ ID NO: 36954 - DNA, 1051 bp, Homo sapiens
tcttccctccaagtcactggagccctcatccattagggacacagaaccagaaaggaggaatgtttcctctgcagctttagtttgaccccacctaggctgagtctttggtctgttagttcatgtgctggttatgactttttgaaaatcttggaccacatttatgactcttaagcaatttaggtacacatagtccacaagagccagcctcccctggtctacctgaaatgtgtgtaaagcatttaatctaggaaagccctaagctgatgggccctggggtgctggcctattgctcctgggtggcccctggtaaatcatgaacctttggtgcctgtttcctcatctgtagtgcaagatttgtgcatgtgtctctttctcttatgggacttttatagagaaaagaaaatgagggaaaaatatgaatatctgtaagctttgaaaagaactaaaagcacagcgtgaattaacagcagtcccatattcatggggtttctgttatagaggtggaaccttgctagactctggagaaaataagaaaggataagttagtcctcaagaaccttccagagatggattaatcctcactgaggccatctgcattcctttggtggcagagtagttcctgggtaggtatttataaatcatttcaggcttaaacaggattagaggtgctgtgcttttaaattgttttaatttagagtttttaccagaaattattgtataacattttgagggtagcacaaggaaatggattgcctttgctgtatggtgccttgaacacatcccacaggtttacttttttgctatatgtttttttctgcacccaaacaatgcaccgtttgtattttggcatttacttcaataatcttccaaatagacacccgcaagtacacttggatagcagacagtcccctaagatacagagcaagatgtgcgactctccttctgtatccttaggagctctgtcaacatagaaggtgtcacaactcagcattgtaatgaagatgaagataatggcatataataacatgtagggccaactcagaccagagat

SEQ ID NO: 36955 - DNA, 1092 bp, Homo sapiens
atgtttgaagagtataggtcatttattttgtaggattttcctcagttcaatttttctgatgtgccttcatgattggattcaggtcctgctttcagggcaggggctgcacagaagcgaggtcttgtccttcttgatgcattggatcaggaggtacacgacactccccatctcatggccggtgatgccagctttgattgttcagttaagatggcatctgccaagtttctccactatcaatttactattttaccctttgtaattcatacatatctcatgggggaatactttgcaactctatgagtattgtgtttctcatcaaacttttgcctgctactttcagcattcactgatgatgcttgcctgaaacagtaactactgcagatatactgtatttgtttcccagggctgccttaacaaaatgccacaacctgggtggctttaaataacacatttgtcatctcagttctggaggccagaatgctgaaagcaaggtgttggcaggttggttgcttctgagagctgtgggaagcatgtgttccatgctgctcccctagcttctggtggtttctgcaatctctggcatcccctggcttgtagatgcatcactccagtcctgtgcctttacatggtttctccctgtgtctctacatcatctttcctctttgtgtgtctttgtgtccaaatttccccttttcataaggacactggtcatattggattaggacccatcctgatgacttcattttaactggattaataaagatcccacttccaaataagctcacattctgaagtactgggagttaggatttcagcatgccttttttggaggacacaagtcaacccgtagcagatgccaaatggtgatctatagcaatttttaatggttctctcagtcaagttcattgttaagataataaatagaaaatttaaaacttcagttaaaagatggcccagcaatgtgccagcttaaatctcaggcatgtatgcctgggaatttttatctttagccatgatctgcatgtttgaactttaagccgtttggtgaaccaatttcaacattacccttaagttctaatgtcaccttttata

SEQ ID NO: 36956 - DNA, 1067 bp, Homo sapiens
cacccctggggaaaggtggaagagggaaacctgcccagtggccctaggagggccaggaagccggactgtgtcaggctgggctccacatggggacagaggtctccttgagaatttgtaaacaaaggcttgcttttacatgagttcagttcgtatttgtactgtttggcaatttgtcttctgagaaatctgccttgaaaaggattttcagacacctatactcctggcctgacaaaaacacgtgtagcatctccccagagggttgctgtctgcatcacaggccccatgagatccttactggtaaagcccagtgaagacagattcctcctccaagtctcccaggacaagagcaagaatccacaggcaaaaacagacagcaggattagactccagaggacttcagaaaatcaaataattggatatacaactaaaatgattaaatatataaaggaattgaacgcacaagaaaagaataagaccccatcaaatacctggtgaatttgagacaaaagctgtaggaatgaaaaatagagtgattaaaaatcaattgatgggatatagagcagatttttgagaggattactgaacaggattctgtttccttctgccccaagtagaatgtcctctccgttgagaagaggtgcgggcagcagggagattttagttctaaacccaagccagaggaaatagtcgtcattttccttgctctcttttgcccttttctaacagccagctgctggggcagtgctggtcctgggagcaaacgtcaccatctccctccagtcgggctggccaagtctcccagggaaattgaagaccagtacacctgaagcatgtaagccccaggctgcctctcccattctccttcccgttcatcagcagcataaagaaagttggcctgggttttcgtgactcggcagggtccactcagtttaaaatgccagaggacatggtgtggcaagttgactgtatcgtgatgttagccgtcttgtggcagagactcagagacttgaagggtaaagctcagtaaggcccacatccagagcctggggggccaatgactacaagga

SEQ ID NO: 36957 - DNA, 1024 bp, Homo sapiens
gcagtggtgaagaccctaaaccccaaggctgaggtggcccgaacggaggtggcgctagcggtcaacatcagcataatgcagggtctgcaggacgtgctgggaaccaacctggggcccaagggcacaatgaatatgcttgtttctggcgctggagacatcaagcttactaaaaagatggcaatgtgctgtttcacgaaatgcaaattcaacacacaacagcttccttaatagcaaaggtagcaacagcccaggatgatataactggtgatagtacaacttccaatgtcctaatcattgaaaagctactgaaacaggaggatctctacatttctgaaggccttcatctcagaataattactgaaggatttgaagctgcaaaggaaaaggcccttcggtttttggaagaagtcaaaataaggaaagagatggacagggaaacacttataaatgtggccagaacatctcttcatactaaagttcatgctgaacttgcagatgccttaacagaggctgtagtggactccattttggccattaaaagacaagatgaacctattgatctcttcatggttgtgatcatggagatgaaacataaatctgaaactgatacaagcttaatcagagggcttgttttggaccacggagcatggcatcctgatatgaagaaaagggtggaggatgtatacattctcaagtgtaacgtgtcattagaatatgaaaaaacataagtgaattctggctttttttacaagactgcagaaatgagagaaaaactcataaaagctgaaagaaaattcattgaagataagagttaaaaaatagaactgaaaaggaaagtctgtggtgattcagataaaggatttgttgctattaatcaagagggaattgaccccctttccttagatgctcttgcaaaagaacacatagtcactcttcacagagctaaaaggagaaatatcgaggggctgactcttgcttctggtgaggtagccctgaattcttttgaaaacctaaatcctgactg

SEQ ID NO: 36958 - DNA, 1045 bp, Homo sapiens
tattttgggatataattcaatactgtacttattttgttgcccaaattgtttttgctttggccattcggaagctccttctgcctggcttctgtgtccctttgccgtgttcccattcttttattttggggcacagccttccttcttgtaccatagatgctccaagcgaatcatcttgcatattctctgccttggtcctagaatgagtcatttctctaaggaatcctggttccttttattgaagaataaatagaaaaaccaagatctgggcactgggtggactattcgattttgaaggctgtgtcctgacagaatattgacagcaaactcgacagcagaaaacccacctctgcagctgctcagaggaacgactcttgttcattggtgggagattattaggggtgtgtgctggtttggaaaagtcaatgtcattaggctctgcaaatatttgaggaacacagcacatcatggtcaactgggaggcatgttctgagttgagactactctgggtgaactcattaaaatgacactgttcctgatactctttgtcaagggaacttctaaagcgtcctgttttttcaaatggacttgttaaatgtagtctgattattatgctagggctcagtactttgcctaggggaagctagggaaacctcacctgcagataggtattgtagcttttaatacataccatacccactttttttttttttttttttttttttgagacggagtctcgctctgtcgcccaggctggagtgcagtggcatgatctcagctcactgcaagctccgcctccccgattcacgccattctcctgcctcagcctcacgagtagctgggactacaggcgcctgccaccatgcctggctaattttttgtatttttagtagagatggggtttcaccgtgttagccaggatggtctcgatctcctgaccttgtgatcctcccaccttggcctcccaaagtgctggattacaggcatgagccaccacgcccagctcaccatatccacttataagttaaatgtattcctttctaagtta

SEQ ID NO: 36959 - DNA, 1033 bp, Homo sapiens
acctccctattcctgcatgccaggccaagtggtgaaagccagcccatcgggctgctaagtttaccaaatttgccaatttacccaaaacatgactttttaaaactgtttctgaagtccatagccaatcatattttaataaacagaagtttttaacacctttggatgcttttagttgactagtttccattttgatttcacaatggcattttcagaacatctgctgtttatcttctcaagctccctgctctgctgtactttggggagttagtgccaagagagggggaccctctgcttcaggagacatagagaagaatccatgcaaagcacaggcttggcctctgctaagcctccccaaaccattagcacacaatggaaatgggatctctccagatggatcttggcaagcagagccagccaggcacttttgtgcagtgcacgaactacacgactatacccagcacccctgggatgccacattcagagaaagtcagagaagggggagaacaaggatcagggaaaggagagtgactgaatgtcagagaggtggagtagcgtgaaggtcagaaggagaagggagagagactggtcagaaaaagaggggaggtgacgactcagagaaaactggagcagaatggcagaggtggggttacagacagggaaaatggaggccccagagaccctggggccctcccagcccttgggaccctgccaatccttcctgtaaaaaatggctataaactttagaagagtttaaaagagacaagatcttaaaactcagaaaatttgacaatttgttggttggccaaattggttatccaccggttgatttttggcgagctgacctgtttcaagatggcaggtgtggatgggactctgtccagggctggccccacacacccacattctgatgacgcagaggtcatgggactgtgccagggcccccagactacatccactggtccccaaataactggtttcactggcttcaacacatggaggctgcttgatgtggtgggggtagggaggtgttgct

SEQ ID NO: 36960 - DNA, 1059 bp, Homo sapiens
ttggtgattagaacccagagcattcattggctgtgacccactctgggtagagggatgagattgtagatgatttttttctatttgcttatctaatttttctatgacgaacaaatactacatttaaaattgtttttaagcttttgaaacaaaaagaatataaagatatccttttctaaatatttccacatatgcctttcgacactttgcagcttatagtgatttaggatactacattatcaataaactgcaccatgtggacgagtcggtggggagcaagacgagaagggccttcctgtacctcgccgcctttcctttcatggacgcaatggtgagtagagaagatcgttggctttctttctttttctttaactggtggtaaaatatacataatataaaatctaccattttagctatttttgtgtgtacagcttaatggcaggaagtacattcacattattgtgtaaccaatcttcagaactcttcatcttgcaaaactgagattctatcctaattcaacagtaaccctcctcggccccctccccagctctgggcaacctccattctactttgtaactctacaaattggactacttgagatacctcaaaagagtggaatcatacagcgtttgtacttttgtaattggcgtatttcactgagcgtgtcttcagagtttaacaatgtagtagcaggtgtcagaatttccttcctttttaaggctgagtcactttccagtgaatgtctaggccacatcttgtgtatccgttcgtcagctgatggacacttgcgttgcttccacctttgggttcttgtgactaacgctgctatgaacgtgagtgtgcaaatatctgagtccttgtttttggttctttggggtatatacccagaagtggaattgctggatcatacagaaatttgatttttgattttttgaggaattagcagactgatcttcgtagcagctataccaccatcagagtactcaggttccaattgtctgttgacttttaaccagtccatcttgtcaatttatttaattttgccacaagttctggtaggtg

SEQ ID NO: 36961 - DNA, 1049 bp, Homo sapiens
gacctaggtgatatttatgccccctatcccccacattggacaagtgttgcctagtatagattatagatgggtgatattaaatgtctgtgtcccagcccatatgcaggaaactgtcctcttcacagctgtgttagagtgtgcagtacctgatgcatacaagtcactcaatgtgtatttatcgaagtgatttaaatatggcctatcagccatgtaaacacacataccttggaaatgataccctagaagcacaggggtgaaattacctgctcccgtgaaaagcctcgcaagctggtcacagtgggtcaacaacagtacctgtgagacttttaaacattgaggacttgggaatttgaattagaataatggttctcagatttgcctattggatgtggaaaaatgtgtgtagacttatttcggttcatattaacattttatggtttgcaacagctcctggatgaacaggtttgagaaccactgattcagaaagagcccatggccctggctggctgaagtcagtggacccgtggatctgaagggcactttctgtgtcccttgtttaggagggtcaaagctgtccacctgtaaacaggtcaagtcagtgtcttcttgctgttgcaatatcataaaatttgtttacatctgttcaaaaaccttgtttaattttttttgtaatgttctgctcttcataaggaatacaagctgttttagaacagtcttggtaaggcggtttatagaagctgaaggttgctaaatattgctaaggcagctagcctggtaattatggactctatgcaaatcactttaaacaaattacccccccacccccccaatagctctagctggaaatagctcaggggcatgggagggagggagtcgccccaacagagtgggtgaaaacagttgttgggattttatactcacagctcccagggtagaattaacctctatagctataatcagactcctctatcatgtaggggaagagtagatggaagttagaaaatctgggaggaaaagcttcttcccttggcctccaaatatctcccgga

SEQ ID NO: 36962 - DNA, 1050 bp, Homo sapiens
acttagtttgtctaatctttttgtggtttgcatagaaggtggattgagtgtttttcaaagttgggacttcctgtttttccctgatctgtgtttttctcttttaattcttcatttttggcatcagccaagaacacattcatatgggactagtcttaagttccaagtgtgtttgaggggtttaaaaattaggtgatatagtagtttatgtcgtgttttatctgtttagtgtacttttatcttcatatggaagtaagtaattatggagaaaggtttttgttctgtacttttagaatgatgtgaggagggaggcggagtagaaatcttaatgcattttaacttgtgaagaagcatcatattctatattggggaattggaaggtatcataagacttactttaaagcagactaaactgtattgtcacagctattaattttacacaaaatgaaaatgtgagctgggcctggtggctcacgcctgtaatcccagcactttgggaggccgaggcgggtagatcgcttgagcccaggagttcgagaccagcctggacaacatggtgaaacccaatctctactaaaaatacaaaattagccatgcatggtgacacgcaactataatcccaactactggggagactgaggctggataatcacttgagcccgggaatcggaggttgcagtgagctgagatcgcaccactgcactccagccaggcaacagagtgagatcctgtcgagagagagagagagagaatgtgtactgctcaaagtccaaaattatcattgttttattcttaaagtacagttttaaaaatctgcactttgccatcttgaaagttaacaaacaattttaggagattcccttttattctcaataaaatagaaagaaatatttactgtggtttattccttagtgttaaagagaggttaccaagccaaacactgaatactttagaaaatttctagatagacacagcttagaaatggagcttagcttttttttttttttttatcaccaccattctgagagcacaacatgaatttaggatagttga

SEQ ID NO: 36963 - DNA, 1062 bp, Homo sapiens
cgaactcctgacctcaggtgatccacccgccttggcctcccaaaatgctgggattacaggcatcagcaaccgcgccctgccaaagaaagatttaaatgtggaaatgacttctcatgcgtaagaggctgtgaacttgaaagtcatttgtgagttttgatctccagtttgcttgaaaatactcactttttctctctcagtctctcaattcctgaattatttctagaaggatcacccactcacacaccatgctatgattgccttcttgctatacaatgttgtaaattgttcatttccactgcaaattgttcattttataaacaggatctctcctttttaaaagttctttttattttaaaattgttgttgttattcctgatattctgagagatagagacactgatatttaagtgaatcacagttcaaagcagttatgactaataaaataaatgaactaaacttattttcttgtaatataggtataaaatagtatatattaggctttctgactactcatggaactgttacaagtaaacactgaagttcacacttttcccattgcaacaaatatagtaaatgtcagaagtgtagttgaatgtttggttttatttagtgttataaaattacataatagtgtattttatattaccaagtccagataaccttaaattaattacagtattttttttttttttgagacggagtctggctctgtcgcccaggctgaagtgcagtggcgtgatctcggctcactgcaagctccgccttccgggttcacgccattctcctgcctcagcctcccgagtagctgggactacaggcgtgcaccactgcgcccagctaattttttctatttttagtagagacagggtttcaccgtggtctcgatctcctgacctcgtggtccacccgcctcggcctcccaaagtgctgggattacaggcgtgagccaccacgctcagccaattacggtattagtaatgtttaatggcaggttcttagagcataagaaaaggacaaatgtggttttcgtgtatttctgggatttgaatatctgtggtcgtg

SEQ ID NO: 36964 - DNA, 1060 bp, Homo sapiens
ttttgtcagaagacaaagagcatgactagttaagcagaaagacaaacaggaaaagtgattagtagccagcaggagcatctgccagaatctcaccagccagaaacgcatagtaacccagcatcagagtttctgggtgggaaacaggaccctcagtctcttagggaagagtgtaggattcatgtggcttttcaccactgaacgcactgagatgtctggaaagatgaagggcctgattacaaaaatggtttcaagtcagtagtgctgaactcgggaagcatttcaacctgtctgtgggcacggactgcgggtttttcaaagggctccttttacaatggaacagactcttccaagaggcaggttattcctgtgactaaccagagggacagcagtcatctcgctgagcaacactcatctctttcagtctcaacagaattaaaaatatatgtggtttccagttaagcctggtcataaaatatacatatgtgaagcactttaaaatttaacgagctctgcactaatccagaattattttttaaaaaacttgtaaagattacatcaccataaaaatgtaaatgagttgtactagtatcagaagtaatggttaatcttgcttgattaaagtaatgttactgaagtaaataaccttttctttcctactttggctgttttacttgagaaccgtgcttttgtcttaatgatggtactaaaacaagcagttatgtagccctgacagtgttcctggtgactgctcagagtgctttataagtctattaattcacgaatcttctaaataatcctatgaagcagccactgttattatcttctttctccagatgaggaaactaaggcacatgtccaagatgacacaatagatatttatttatttattttgagacacagtctcattctgtcacccaggctggagtgtagtggcgcgatctctgctcactgcaacctcagcctcctgggttcaagtgattctcctgcctcagcctcctgagtagctgggattacaggtgtgtaccaccacacctggctaatttttacgtattttttagag

SEQ ID NO: 36965 - DNA, 1047 bp, Homo sapiens
cagccctgggaccttgctccttgtctttgctgcaacatgcaggttccggcgatttccgagtggaacctttctcccacagtcaggactcaatatagtcaggatgcactagcacagctgtttctcagagccacatcctcagcctccacagcaaaggagactttatttccaaaccagtaacagcccctttttcccccttagtaatctctgtgtttttactggctacataagcattcactttgaggtgccaacttttctctctttcttttccccaatatggatgaaaataataaatgaaaaattttgctctcattaaccagccactgtgtctttagtagtttactggctcccttcctggcctaagagcaacgctttttgcctttgatgcagcacccttcatcccataaggcaacctgtaagatggtcattttaaaatcaaaagctcgagtttcattgtttttttttttttttttgaggcagtcttacactgtttcccaggctggaccgcagtggcatgatcttggctcactgcaacatccgtctcctgagttcaagcaattctcctgcctcagcctcccgagtagctgggactacaggtgcataacaccatgcctggctagtttttttttgtgtgcgtgtgtgtgtttttagtagagacgcagttttaccatgttggccaggctgggcttgaactcctgatcccaagtaatccatccgcctcagcctcccaaaatattgggattacaggcgtgagccaccacccttggcccttgaggttcattcttaaccatgctcttccctgggtgtcaaatgtatgtgcactctactaaattaattttgttgggtgatgtaaaatagatctctagtagaaacagcccaagagacagtactcagttgcttctctgggactttgtcacttgctcttgaaccattccattgcttatatatgaaacaattcagaaaaacatcctttgaaaagctgagggactaaaaatcacgatattaattactaaataagtcttgtcatccatttcttatcctagtccaaac

SEQ ID NO: 36966 - DNA, 1035 bp, Homo sapiens
tgcaatataaagtttcaatgaacatctttgtgtattaagtaggtaatgtgttttctctgactgccttgggctttatgcctggcataatttggtgcctatttcagtgtccaattcatacatagaaaatgaggtcatgcctttcttacagtccatatttagtcaaggacactgtgacctccttagtccacttggtacttacttccctgctgtgtttcccagttttctttagatgtccatctgcatttaaaatacctctcttaggatgacttaggtaagcgggttgtttctagagccacagaggtataatcctgaggttggtttgtttactcgtttactcattcatttatttattgaggtggtttgatgaccagcctagatactaatctatctacatacttccaagcatatccatcatacagaaacaatatttaaatctcttcctagtaatagatcaaattctttaaaagcagtttttattttgttttgttttgagacaagtctcactgtgtggcccaggctggagaacaatggtgcaaacacagcttactgcagcctcaaattccggggctaaagccatcctccagcctcagcctctgagtagctgggattccaggcatatggaaccatgcctgcctaatttttttatttttgtagagattgggtcttgtgatgttgcccaagctggtctcgaactcctgggcttaagcaatcctcccatctcagcctcccaaactgttgggattacaggcacgagccaccacatccagcctaaaaacagtttttaaagggtacagtgtgataccgtttatgggaaccactttttagatgagacaagcccagttgtaaattaatggtgaataatttggttttcatatttggtttgggacaatggagcaggttatgttgggtgggaggaggagagagcatgggtggagaaccattcctttactgtcttgtgtgagtaaataaacctctttaagctcctgatatagcataccagagtgacttgggtggtgtctacattaaaaaaagaaa

SEQ ID NO: 36967 - DNA, 1033 bp, Homo sapiens
gcccggccggcgagccagggcaccccggggtctccaggcggcccaccgccctcaccccccaccggcgtccccaagcccccagaccgtccccgccgcgccctcagcgccgccgcccccgggccggccgaggctccgcggcgagtcccgcccagcgccccggaggcgccagccccacggcccgagcgtgcgcagcgccccccgcggccgcgccaagcgcaggcgacggcacaggaaaggaggccgcggcgcgcccggcccggccccctccccagcccgcccccggggccgctggcggtgtccgcgcctccgcgcccgcccctgatttcctccgggcggcggcggcggcggcggcgcctcgtgcgcgcggttatttatttccgggccccagagcgcttataatggagccgctgtcagcagaaccttctgccgccgccgccgccgccgccgtccctcctcttttttttcccggcagatctttgttgtgtgggagggcagcagggatggacttgagcttgcggatcccctgctagagcagccgcgctcggagaaggcgccgcagccgcgaggaggagccgccgccgccgcgcccgaggccccgccgcccgcggcctctgtcggcccgcgccccgctcgccccgtcgccccgtcgcccctcgcctccccgcagagtcccctcgcggcagcagatgtgtgtggggtcagcccacggcggggactatggtgaaattcccggcgctcacgcactactggcccctgatccggttcttggtgcccctgggcatcaccaacatagccatcgacttcggggagcaggtaagccccggccccgcgccccacgcccgctcgccctgccttggccttacacgcccggacacgggggcggaggggagtcacctgctccgagtccctctttatcctgaaacatttggtcgggtgtgcagcttgtcaagggtgacttttccagcaccccattccctccctccctcccctcaattattcagcagacttttccagccctctctggaaaatgtta

SEQ ID NO: 36968 - DNA, 1008 bp, Homo sapiens
tggggcttcctctagtggagaaacagtccaaaccaaaaagagccggtccatcggatggctggtgtaaaaatggacaatgtcttttccagtggcctggccatttaaataaaggcacatattggggcatggagttcttgagtttgggactccttgattttggtttaaaacgtgtgcaaggaggtccccttggtccctgtagctgttgcggctctaaagacatgtgtccatttgccttttgtaaggagtttccccactgtggctgctgtaactctatgttgcctttgctaagggtcacaacatttatttagaaaagcacaggttctggatccaaagttcttttacatgaaattggctggagttctagatggttgagttctagaatcctcagagccagatgagcccatgattccctgtcttctggtaatcttacctagctactgaacccagtccagtttctaatttgacccagtcagacacctgaggccttcctacagacccagccctatttctgtcatgacttctgaaccaatctgctccaaacaaagtgctcaaatatactcagagagcccaaaatgcaaattcacagagctcagaatccaagagagaactcaaccatgaccccagttgctgcgagagatcaatgggcacagtgggccctggcagttaccttcgcttggtctctcggtgtttctgggaatcactagaggtctactttgaatcccgtttctggcacctggagcagcctgatgtttctgctgacatctcctcaatcagaacaatcacagaaggcctcatttggctccaacaagtctgagaaatgtagttttaattttggaaggccatgtgtactaaagttgggaagggatatgaagagacaacctgtcttcacgctggcatctgcatttggccattcattgctaatattttcctatgacatccaagagggggaaggtctctcctagtgtctcagatagaaagttccagagctttaatcaaagcagctgtaga

SEQ ID NO: 36969 - DNA, 1547 bp, Homo sapiens
ccttccgcctctaaaactgtgattctgtgactatactggagagctgagaattcctgtatcaagtgggctttctttgcctgatattcactcccaaagccatggaccctgcatgcagggtgagactggtcccaggcagggatgccactgttcgcctgtgggtgaagagcactgcgtctgagaatggtgctgtgctgcatgctgcatgctgcatgctgcatggtgctgaccctctttctcctgccaccccaacatccatacctcacttcatcctttgctttgttttgggtggggacagagtcttgctctgtccccaggctggagtgcagtggtacgaactaggcttactgcaacttctgcctcctggcttcaagcgattcttgtgcctcagtctcccaagtagctgggattacaggggcgcaccatcacacccagctaatttttgtatttttagtagagacaaggtttcgccatgttggccagactggcatcctttcctttaaagaacttaacacctttgttggaattgtggccaaatccacacaccatacacacactcccagtgccctggcttttagctgctgcagatgtttgcagctggtagctgtgctgagcctccgcggaatttccaggcagtggagaggagttgttctcagggtcggctctgagcctcacgcctgcggtttcaacccagttgtctttctaaacaggtacctggcctggggcaagttaccctcaaagcctcatttctccacttttaatacatgaaaaattcaatttaattgggaggtcgcagtgtggattaaacatacagaaacctattatgtgcttggtgcagggcctggcccttggtcagggttccaagaacagagcagctctttgatcgcatagctgatgtacacagaccctcgtcttggtcagggaggaggcaggcagggtgggattggcatggactggtcaggggaagagtagagaagggaagtcagctgacactggaccttttgtgtgaactctctgacgatgggagctcttgacatcctgggactatgttgacatgaggcatggtgaagggccacccttggccttggagtatgtcttccccactcagagaactcatctctggcagctcccaagcaaattcatgttggaaaaacatccttttaatctgccagaatgctcctgcaagacaagagtctgagatctcaggcatccgttgactttggcgccattgacaccttgcactgattttcagtcttttggcaaaaaatgttcccactccatgataatttgtgatttttccatttgaaacaatctgacacatctgtggagttagtatttcctgttggatgggatgagggaataaatgtcagcatgttgagaaaatgaaatgggagaggcatgtttgtcctgtgtcctggtgtctcttggtggctccttgggcgaggagttagagtgtgttgacgtgttggcatgtcagggtccaggggtgaaccaggctggcgattcctgcttggtgaggtgatctgcttttgctgactaatggtcctgtc

SEQ ID NO: 36970 - DNA, 1033 bp, Homo sapiens
tttttaagagacagagtctcgctctgtcactcaggctggagtgcagtggtgcaatcgtagttcactgcagcctcaaactcctgggctcaggcagttttcctgcctcagttccctgagaagatgagactacagtcatgcaccatcacactcagctccaactcacttttatttttttcattaattttttttcttatttctttttaaaatttttgttttttctttctttttttaaattttgttttttctcaaactcacttttataacaagcccactgtcatggtaactaacccactcctgctataaaaacaatccattcatgaaggcagacccctcatgtcttaatcacatcttaatatcatcatgatggcaattaaatttcaacatgagttttgcaggggactttcaaaccatagcaattagattaaattaaaaaagcatccctcaaaagaatcacttaaattcagaatatgctggacatacgcgttataagtaagcctatctgtgcttgggtaaatctttggctgaagaggcctaggcgagcctgggaactaagcaccagttttaaagtctgtaccctgccaaaatcaaaacccaaatgggccttttattccctttttcaaaaataataattgagcacaattctgcagtcatatattgcacaatagagagtcaaagcccttttctttctctctccgaagaaagaacagatccattcattgactgacagcaagctcttagccagagctgctcagatttggtctgaaagtttctccaagttctacatgcagtttccaatctgtggttaattttttaaatttgtgctttgaaaattagatccactgaagacaaatatgaaacaagagactagaagtaggttttaaagctgttttggaataaaaggatgtggagaactgtagttattatttcttaccatcagtggtgtacctacataaaaaattatgagttttaaaaaaaagtctcatgctgaacaattaagggccactcttttctctcaagagtccatctaactcaa

SEQ ID NO: 36971 - DNA, 1024 bp, Homo sapiens
aatgtaatggtaaacccagggtctaatttctgatggcctcatcaacaatcaacattagataattttagtcatatgccattcacatgtcaatatttgtacctggaaaattcctttgtgaaaatgtggttctcagtgggtatgttctgagaaggacccatgcttgacctatttctttaataaacactaactctacaatctgtgaacaggatttacatagagctgtctgccaacagaaccaaattgacatctttatggttcattcctagcactgaattgaaacctgatccatagtattataatagtttttcctttctgcatgaaactgtagcatttgattgaataaagtcctcttaacgaatgagaaagtatgcatgtgaccttttctgtatgcacagcatcatttaaaaacataaaactgttttcagtttggccaggtttttccaagtatgttataaattagaaagaaataactttacatacaacaaatcattcaaaatttcttcaatagttggtacattataactcagatgaacaagttattctcatcatgaatcttgttttattgtttggtgccaatttaaagcaattttttccttggcatctaaagcttgaaacctgaaaattatggctgagagctatcggattttctgatagatattccaggaatccagatgcccctagcggtgtgctctctgcaggaagtggatggggcttcccgagcttgcagctaggccattgcatctgatggccttaccttgagctgattcttgagaggcagagcacagattcaacagagtcagtctttccagagccagcagggattagcaaagggggtcctgaggttttttttgcccctagcttggtcagattgtgggcgtcctcagcctgtctatctctcaaactcttaggagaagcagttgtgtggccctgattcttgcaatgaaatgctcttttgttttgtgggcttccagaaaatggccagtgaaaatgctctagttggttgtatgctttcaagtaggcggag

SEQ ID NO: 36972 - DNA, 1091 bp, Homo sapiens
gagagggtgacattggatataagaagagaaacgtgatccctggtgcttctcgtggaggtggcgggcagcctgggaggggtgggctggccccagggaagagctggcataggctctggtaggcatttgtcttgccctgtgctctgatctgtgtgctgcgcataggcaggttaaggttctctttctattttatagaaacttgcttgtgggaatgtcaagataaagagaaccttaaattactcttttgagatagggaaacagtcatgtgtttggaatggattaaaatgtgttttgggttttgctgtctatctgcttcatgctccaagtgctttttctacattgtcatcttttagggaaatcatttaaataaaaaactgtaagagaacgtctcagctggaaataggatctgatttatgcagtataatgttggaaatcagtaaaagacatctatgaagacaaggaatttcatacatagtttgttcagtatgagtttttagaattattttaaattgcaattatgcacaggcaataattttctttactgatagagttttatcagtagtaaagaggaggataaagaagagaatgaaaagcaaactgagaatttaaaatctgattcctaagcagaaaatacatttctgacccagcagttgtataaatacagttgtataaatagagcagacaagaaatactgcttaagttttagatttcttttaaaaaggaataacaaaaaagtttgtattcatataataaaataatttgtgtaattggaaacagaaatttaagatatattgtcaatggatatgatgacataatttctacaatcatgacaaaatatgtacagtgactcacttaagaaagtttcctcttttcttttccagtatcttaattaacccaacaagtaaggtttgaaatacatggaaaaaaaagatttatatttttaggcctaattgatagaaataaagattaattttcaaaaaacttttcaataaaaacaatttctatctagtaatataaatacattttacccacacaggtcatcttctaagaccaaatcttcctaaattaattggttaatttaggaattaataata

SEQ ID NO: 36973 - DNA, 1030 bp, Homo sapiens
acccagtctcaggtatttctttagggcaatgcaagaatggcctagtacctagctcagctggagtgggctgcagaacttgactcacccgccctgcctcgaagtccccttccctgctgtgaccaggtcaggtagaaggtggaataggagtgggcaggtattcaatttatacactaggtggagctaaggagcacattgcactgccctagggtgcccctgacttgatttacccatggcttttctcataattccagtgcaagggtgcacagtagagcatgctcagtttctctttgccttgacctcagatggccttggttccatcctagccatgcccttggtttctcctactctttaggcacaagaacgcaaacagaatacaaactccctgctgctcctccccactgtcttatctgtttgtccaccatgccttgctgacctgggcacattccctgaattcactggattatcgtgatgtgcttctcctagagtaaggttattcccctcctccactgcagcagactctgattgttactacccaccatttccctgtgattgatatcttccagaatttctcatctctttagagaaaggagtctattacctaccaccctcttttcctctcctctgatgcttataattcattttcttggccatcacaactaaagaagtacttccctagggaaaaaaaaaaggcttctgagttccatttaatcctggatttgcaattaaattgttattgctttatctcactccattttcggatgatcgtcctttccaaattatttaaaactatatattcatgtttaagaaatgtaccccccagccaacacacatacatgttttaaacagctctgaaaatgggatacatattacaattgagagggtctttatttttttggcagctttttttccttaatagtgcacaatttaatttcacacagcatcttcagttactaattttgcagaatctgcataaaaggccaggagaaattaaagccaactttagttgaaactctgaattttgtgatattat

SEQ ID NO: 36974 - DNA, 1053 bp, Homo sapiens
agtcaagaagacccaagtttatattctgactccatgatttggacaaattgctccaacctaatctatttatggatatataatttccatgtatctaaattcatcatgttgtttaggaacattacatgcgatggagatgtgaaaatacccagctaaggtgggctttgattacacatcaactttttttctgtagtgggcatgcctaggacggttccttgaattcattactgtgtgtcttgcttctctccccatcactcacccaagagctcttcttctcagaagccttttcagcacctatcactatgccttattcccagttgcaaaggactgagtgtctccttttgtccccgcattcttatgttgaaaccccatcaccaatgtgatgagaggaagcctttgggagctgattaggtccggaggatggagccctcatgaatgggattagtgccctttaaaagagaccccagagagatcttttgccccttctaccacgtgagaacacaatgagaagttgccatctctgaatcagaaagcaggtcctcaccagacactgaatctgctaaggccttagtgttggacttcccagccaccagaactatgagaaatagatttctgttgtttataagccaccctgcctgtggtattttgttacagcagctggaatggattaagacaccagtatgtgcatgtgtttatgtgtgaaggaagaggccccaaagctcagtttaatatttggatctgttacaccgcattctctagaactagagtttatagaatcagataatatttgaatgggaaaggccctgagacaccttcgcagtccagtggtttgcaaatctgactgttagcatgtaggttcctgtacctctccttggagctctgacccacccagtccagagtgggacccaggaatctgcaatttctaaaaatgcttgtgaccagtcgaagtaaaaaaaatgccccaagtaattctgatgatgatgaggcagttttaggaagggcttatctagccagtgccttaatttaaagatgaaaataccgaggcagaggatatgg

SEQ ID NO: 36975 - DNA, 1094 bp, Homo sapiens
attcacagatgctcaagtccctgctatacagtggtataatatttgcatagaacctgcacacatctttccttaccctttaaatcatctccaggttacagatacctagcacaacataaatgctgcataaatagctgttataccgtgtgtgtctgtgttttaaacattgtttatttgagacagggtctcactctgtcaccaggctacagtgcagaggcacagtcacagctcattgcagcctcaacctcctgggctcaagcagtcctccacctcagcctcccaaagtgctaggatgacaggtgtgagccactgtgccccaccaaaaaaagttttttcaaatattttctatctgtggttggattcagaccacatgaacactgagggctgactgtagttttgaatgtctgttactgaggaggcaccagcataaagtattttatcacttcagacgctgacaatctagtatttttaatttttaaatcttttgaaagctaatacatataggtgatttgtaaaaaaaaaaaaaaaaaaaaaaaaaaaaaaaaaaaaaaacaactagaagtaaaatgttacttttttccagctgtagccctaattacccattttcctttcccagaaacagctatttttactgttttattgaatattctctcaaaaataatttaagctgtccaatcatttactcatacatacatatatatccccatcctcatttttaatagatggaaacaaactgttgtagcttacttttttctcagcatagtattttagctctaatcctacattaatacctatagaattgccttattctttttgatgattatatagtacctcagatagctctgtggaaaaacaggataaggccatctgtattagtccattctcacactgctagaaggacatgcctgagactgggtaatttataaagaaaaagaagttgaatggactcagtctcacatgcctggggaggcctcacaatcatggtggacagcaaaggaggagaaaaggcacatcttatatggcagcaggcaagagagcttgcacaggggaactcccttttataaaaccattagctcttccgagacatactcactatg

SEQ ID NO: 36976 - DNA, 1032 bp, Homo sapiens
cccaggttcaagcgattcttctgcctcagcctcccaagtatctgggattacaggcacccccaccatgcctggctaattttttgtatttttagtaaaggcaggatttccccatgttggccaggctggtctcccaactcctgacctcaggtgatccacctgcctcggcctcccagagtgctgggattactggcatgagccactgcgcccggccaacagaatatatattgtatatataatacaataataattgtattataaggagaggattgtatgaagagctttcctaggagaatgatttgtgatggagttttacccagagcaggaataggtacggctgtgagtcacaaggtggtaggactctttatttgcttttttgcccaaatgtcatggaggacacagagcagagaacctggaaaaatgtgccattgggagaacgtgatgcaccattttaggccagaatgacgcatggaagcgtaaagtaaaaaattgcggagacaccaaaatgcatctgtgtggattgttaacaaaaaagcatgaaaatgtttgatactggttgttatagggaatcattcaaaatttcttatgcgtgtattaaatctgaaatggcaaaattaaaagccactttatcaagagaaggtcctggtattttcatatcttttcaaaaactaggaattctaatacaaagtgccaattacctgacacacttatttgataagcagaggatggacgtgtccattctcagacataggcaagcaaacagctacaatttatttagtcctgattccactgtgcttgtgctagtcaaactgagatgtagctgaaataattcagttctcattttaaactcagttttcagaataatgttcttaacgtcaatattttgagtgcatttaagtttttgaagccaagatactctgattgtaatcacatagcaggcacaaagagaggatttccacataaaggcaaaataacgttttagaaatttcttggcttcccttccttcctcctttccttcctctgctttctgtatct

SEQ ID NO: 36977 - DNA, 1102 bp, Homo sapiens
ccacctagtaattctcacaggggccagggaacctgggtctctgtattctgtctttgtttctggcttctctggctgggcttgaacttgacactgccccgtgatgtccctctggttttggcatcccgtaccagctgatgctgcccctgttgacctctgctccatactgatttgtcttctggttatttttgaggctcacagtgttaaccactgaagagttttaaactatatacaagccttgcaatatctccatgcaccttaatccactgaggactaagccccttccccataagcctccctccttcccagggataatccttcccttccaccacagcacctcttccatctaccaacagactgtaccggtatgtcacatacccttctctctctccaggcagagtccaacttttcagcactaagacagagtaattctgccaataatgacctacacggttaatatgtaaaaaccccacatttaataagaagcgtttgtttagaggctccacagggtcaggacttggatccatgtgcctgtagttctcttggtccttcctcaaggttacaaaatggttgccatagctacagccatcacctcctcacaaaacattgtcattccatttttttcaatgagcatctgttatgccattgtgatacatctctgagtaaagcaaataaagacctcaccctcttagagtaaacattaatcctggaaagaatcagggttgggaccaaagagactcccctcggtgcccctcttcctttaattaggaaggaaaatcttccccaggagcccctcagtagttttgcgtgacatcttcctcgtttctctgcttggttctttggccaggactgggcctggttgctgagcctcactccacaggaagctgagaaagtgagtggatgagttcgtagggttggctggggtacagttggagttcttttagcaaagcgttgctgttgggccacactagaaaataaaactttaggctgggtgcggtggctcacgcctgtgatcccagcactttgggaggccgaggcgggtggatcacaaggtcaggagatcgagaccattctggctaacacggtgaaaccccatctctactaa

SEQ ID NO: 36978 - DNA, 1030 bp, Homo sapiens
gcttgtcacccaggctggagtgcaatggcgcagtctcagcttactgcaacctccgcctcccgggttcaagtgattctcctgccttagcctcccaagtagctgggattacaggtgtgcgccaccacgtccggctaatttttgtatttttagtagagacggggtttcaccatgttggccaggctggtctcgaactcctgacctcagttgatccgcccaccttggcctcccaaagtgctgaatttataggcatgagccaccatgcccggcctgacatcgggagtcttggtagagaactctggtgttcactgtgtggctctcccagcaaaaaacaggtgtgttcgtttcttctcgtgatctgtcatttgaacgtgggcaccgttgactgaactcagcagcacattgccaggtagaatttgtgaaggacgtacgttcattttggggtaggcgtggggaatatcaaattcatggaagcaatatgatcagaaccctgaaagctgttcttttaagtcgaaagatgtggtagatgttaagtaaagcaaattggatcgctgaaggaagtggatgaaatgtgttaataaggacaggtgaggagaaagctgtcactcatgaatagccttctgtctgctgcttcttggatttaggagcatatactcctttgttttctttctttctttttttttttgcatcccttttatttttaacattgtgcttaatctgtggaagagtcttcaacttaaaactctttcatacgaattctcaggcactcctatcttagagaaagcgtcaggctgcccctgaagccagcctggcatgtcacacattggaccctttcctgctggtagcaggagggaggcacttaacaattaagcagttcgagtcacccagctcagaagcctggactccctgcctggacgtggatgctgcgatgccgagccgtcaactcgtggcgccccctgcccagagtccagcctggagagtcctgaagaggcccggggatgggaataacctggcctttgagtgctgcctgacc

SEQ ID NO: 36979 - DNA, 1064 bp, Homo sapiens
gtgagcaaatcccttccctcccctacctgcacccccaactcccacccctgtccgtctagctcatgcagactgagatatttttttttcccctctaagcattagccgccctgaattaacgttttcacgggcagccccctcaatgtgtgctttctggtagtgactttgttctaaagctcactttgctcccccagcggctacaaaggaccaattcccaaatccccatcagcctccctcccagctgtcactccctcagaagactctggagcaaagggccaggtttgagactggagaccagaggttaggggtggactgcggttctcaagatcagggtctgaaactcccctgggtcttctctcatctgtgcagatggtccactctgcttcattagctcttcagcacttcactctgttcttcttcatcctaggggtactttccttgtttttttctccggcaagttctttctatgaccctcaaaaatatgcgacaaagaatagtgacaataataaaaacaccaccgcattagatgctggggtttgcgttcacccctcctcaatataaagacgattcttactgattataaaatattagggaaatatgtgaaatgttttaaaaattagttacccataattttaccagccagagacaaccctctttatatttgttgtgtatatacttttcttccctttaaattgggatcatagtttaccttaattttgtaacctacttttttttttaacttaataaatcttgaaacattctttcgcattttttcatgactataaaattctgtcagtggctatactttcaagtcagatttctattactggattgtttatttgttgttgcaaataatagtactgtatttttcatgtgcacaaatactttctccttaaggtaaattcttgaaagtgtatttgccaatcagaatatgcacgttgttatgactttgatgtatatatagccaaactgccctcattaaagccaacagcaaacaagatatatatatccaatgtgtataacaatggatgtatagctttaatatataaagagccttcacaaatcaa

SEQ ID NO: 36980 - DNA, 1013 bp, Homo sapiens
ctcactgcaacctccgtctcccgggttcaagagattctcctgcttcagcatctcaagtagctggaattacaggcatgcaccaccatgcccggctaattttgtatttttagtagagatggggtttctccatgctctccaggctagtctcgaactcccgacctcaggcagtccacccgcttcagcctcccaaagtgctgggattacaggcgtgagccatcacgcctggcctttttatgtatgtatttttttttttttgagaccgagtcttgctctgtgtcacccaggctggagtgcagtggtgtgatctcagccactgcaatgtccgcttcctgttttcaagcaattctcctgcctcagcctcccgagtagctggaattagaggcacccaccaccatgcctggctaatttttgtgttgatgagatttcaccatgttggccaggctggtctcgaactcctgacctcaaatgatccacccacctaggcctcccgaagtgctgggattataggcgtgagccaccatgcgggcccttctggtttttgattgccactcatgtcccctgttgttttgactgtctcctgcacctggagcacccattgccagcatctttgacttttgaaaacatttcatatagaagacctgtaaaaagctgcctttttacctttggaggaaattttagtaaaggaagcatttaaagcaaccattcttctccctaaacaaaacaatcccagtaaagccctcagtggtcacttccatcctgtttaccaagttgtcatggaaactattcatcagagctctgtagagatcaggataaattgcagcgagtgaagctcagcaccagcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtt

SEQ ID NO: 36981 - DNA, 1070 bp, Homo sapiens
tgaacaccatacatgaagatggagagctgagagtgagcttgatgcggcctcatcgcagcgggagaaggctgtctttgctcatggaatcagatgctggctggggaatgtgcagaaattaggtgggatgggcagcctgaggttagaagccttaaaccattggttccccacctaggatgattctgccgtggggacattttgtaatatctaaaagacatttttggtctcatagctacggtcaagcgacgctactggcatttactgagtagaggccagggatgctgagaaacatcccggagtgcctggggcagccccagagtcatctggcctaagatgtcagtggtgccagaacatcccccccccacttaccatcagctcacctggaaagtttggggctgatggtacacagaccccactatatttgttaaagttttctttttgtttttttttttttttttgagacagagtcttgctctttcgcccaggctggagtgcagtggtgccatgtcggctcactgcaacctctgcctcctgggttcaagcaattcttctgcctcagtctcctgagtagctgggattacaggcatccgccaccacacccggctaatttttgtatttttttgtagatacagggtttcaccacgttggccaggctggtctcgaactgacctcgggagatccacccgccttggcctctcaaagtgttgggattacagacgtgagccactgcacctggcctttattttgttttagagacaggatcccgctctgtcacccaggctggagtgcaatggtgtgatcatagttctttgcagccttgacctcccaggtcagcctctagagcagctgggactacaggcacgcaccaccacgcctggctaatttttaaatttttgtcaagactgggatcttgctatgttgtccaggatgatcttgaactcttgacctcaagccatcctcccaccttgacctcccaaagtgctgggatttataggcatgagccactgcacccagtctgtttaaaggtttctgaaaggagaatttctctaagaaaaatttcagaagatttaaga

SEQ ID NO: 36982 - DNA, 1082 bp, Homo sapiens
aattcttgttaatctaagtaaaattatgttttcaagggatttgccacattagaaacttgggtcaaaaatcatgttttcctagagtttattgcctaggttttattagtggggatttactttctgtggaagggccttctgcacatcgaggtagtttgaccttgctgcttgtgaatacgctgtgttgtgttcagtttctaagtgttctgccacggaaagaagtcatggagttgtagactgaccgagggaaaatgttgacttgtggacatgagtacttgagcttaagctgtcttttctggatttttctctttctgtggattttcagtcatttttctggctctgaagcccaccctagggtgataacttgcattcaagggaacccatctttctaagttgtgggattcctgtttgctattttgaatggagaaatacataaaaagtggtcatgcacatttttctctcaacttctatgaaatgtgactatacctgtattataaagtgatatttaagaatcacttgttataaatttttgacgtgaaagtacagatactgcattatctgtcaagatcagttgacctgcagattttctccccttttccatctgcctgtttgcaagtctttataggaaactaaaggcaactggttatgtatgtttatttctcttgtccagctcaaatttatatagtttttaagccaaaattataatactttaaaaactcttgatcttttagtcatttttattctttaggagttacatttctttgccaatatgtttgtgattatgattaataataaattagcctttgccaggtgctgtggctcacacctgtaatcccagcactttgtgaggccgaggtgggcggatcacgaggtctggagtttgagacaagcctgacgaacatggtgaaatcccatctctactaaaaatacaaaaactagctgggcatggtggcacatgcctgtaatcccggctactcaggaggctgaggcaggagaattgcttgaacccgggaggcagaggttgcagtgagccaagatcgcgccactgcactccggcctgggtgacagagcgaaactctgtctca

SEQ ID NO: 36983 - DNA, 1030 bp, Homo sapiens
attatatgtaataagtatgtgtatattacatatatgtaaaatataattagtgtctgtgttttgtagtgtcttaagtattatgtatgattatttccagaaagcagaatatgtatctataaatacaagtaaaaattataatattctaaatcttcaaaatctggatttctcagtatacctagagtgacagttagtagaagctgtttgttttcacgttgagaaggacttgctgttggtgagtttgcaggggctggagagggagatagttgtgctggcttcagtgccctgtcttcttgcttagaagaaaatttgggaagggaactcgagttgcgctggcaggagccttgagtcagcagagtgagatgagacctcaggtgtgtgccgggagctggcaggtggcatgggccctactttatactacttggttggccgagagttgaccagcaggcaagttctgtttctgccccaccctggtcggcacttttctttggaagacgcaagtacctgtctggttgtagctcttctgaaaatgtgcctggattggcatcatggggatgtggcgtgctaggggaaggcagggcattctagctatttaacttctgggaatttctaggttgccccaaggctgctttgactctggcctaagtttctgtttcttaactttcttccatggtgttgatgacttaaaatgaagggtctacatgtttcttcactcttgaatgtccttgtgccttctgggtgcgaagcacttctaccctgctccctaggtggccccaggcctctgccagccctgtggggctcatgtggcagggttggccaccttaccatgagatggggccactaggactgtctcctctcctggtggatgtctgagcccaggaagcagctggggacagtggcttttcttcataagagacgggtgggtccctatcttggcctcgagcagtttctcaggactggcttgaccaactctagtggttcatgtggcagaaatgctactgctgaagttgtaatttttctctagaaaaatgaa

SEQ ID NO: 36984 - DNA, 1026 bp, Homo sapiens
tagcagccgtcctgccaggcaggagttgccttcaaggcctgttaagggatatggggtatgtgtgacactgttgtcactttttttgtggaaatgccaagtgtaagaaatctctgttgcatttgacaggtgttgcagttgaggatgtatccattctaatctatgagtgcttttctttctctttttctttttttcaacttgccatggaagatagggaacaggaaattggacttagcaattactgagtggttgtccctactcagatgtcaccttgttaacaagctgctctaactccttaagttctcacccttgacacacacattgttcatgtgtgaagacgctacccacccactcctgatctttgcaatcaggagttaaatttcttacttttactggtggcagggaatttatttgttaaagcaaacaaaagaagatcgcttggtgtcactgggtcgttgagagccacaacatgtatttggaagtgagttgcatccaaggtacccatctttttctttggcagactctggaatggaactttcttgttttgcagcactcatcggtcagtggaggtctgagatggactcattgccctggctggctggctggctggtggctgttcctgcaggacgggagggtgagtgtcagggaggtggctctgattgcagggagacctactagccttagggttgggagaatattccttttgttgctccttccctccagctgtccccctgccctctcttctgttgagagcagtggactctgggtgtaagggcacactcagacacagtaagggctcaaggtcggtgagggagattgttgtcctccgaagatattagtaacagtgagctttgctgaatgagcccagacaaggatgggaggttgagtctttgtggaataccgagtccattcttggaggtgctttccttcagaagcttgggaagccacctgtgtgctgggtagcttacagttcgccataccatctctagaacaagggatgcagcgtgccctccgcatcaagcgagattt

SEQ ID NO: 36985 - DNA, 1029 bp, Homo sapiens
tggtgtgatctcggctcactgcaacctccacctcccaggttcaagcgattctcctgccttagcctcccaagtagctgggactacaggcgcctgccaccacacccggctaatttttgatatttttagtagagatggggtttcaccttgttggccagaatggtctcgatttccagaccttgtgatccacccgtcacagcctcccaaagtgctgggattacaggtgtgagccgtcatgcccggcccataaagtgtggtttctaaagctggttgtcccaacttcatgaggatagtaggaaggtttacatactaaagcacttagggccatgtgctcatgcctgtaatcccagcactttgggaggccgaggcaggtggatacctgaggtcaggagttcgagaccagcctgggcaacatagtgaaaccctgtctctaataaaatccaaaaattagctgggcgtggtgacatgggcctgtaatcgcaactacttggaaggctgaggcaggagaatcggttgaatccgggaggtgaagattacggtgagccactgcactccagcctgggtgacagagggagactgtctccaaaattgtaatagtaataataaaaatattaaaacaaaataaagcacttagaaaacaagatgatttgagaagtgtttattaaaagaaaatgtgggactcatttgtttccctaattccagctgtcaattaattagtgaagtgttacttgaggttttttgatagaatcttctttttcagttaaagattctgagtgctttgttggagtttcttcatatcacctatcatttgcttgttagcttatcgatacccatggaacagttattgacaggacattgggtcgttttcccaagagcattccttgaataaaacattttgctgccttgctaagaggtgttcagaaaatatttccaccaggcctaaagtaaatctagcacctcatgtcacatgacatcatgtcatctaatgctgccagttacaggaaaagacattagagttttggggacaaagcc

SEQ ID NO: 36986 - DNA, 1052 bp, Homo sapiens
ttttagtcttaattataaaaggacagccaaggattgccaggtatttaagaaaacttgcagttgggtgcggggactcacgcctgtaatcctagtactttgggaggccaaggcaggtggaccacttgaggtcaggagttcgaaaccaacctgaccaatatggcaaaaccccgtctctactaaacacacacacacacacacacacacacacaaaattagcggggcatggtggcaggcgcctataaggctgaggcaggaaaatggcttgaacccaagaggtggaggttgcagtgagccaagattgcaccattgcactccagcctgggcaacaagagtgaaactccatctcaaaaaaaaaaaaaaaaagaaaggaaaacttgcaacctgagctaaagaagtctggcgggaaggactccaaaggaaataaatgatacaggaactggagatatatatacataatatcaataccctcagagctattaaagaagaaagtatcctcataaaataaggacaagaaaacatgaaacaagttcagaaagcaagagaaattccttgtaaattaacaatgtgataaccaagatataaatttcagtagaggattagaatacaatatggaagaaatgctagaaaggaaaatggaaatatcaagaaatagaaaacaggagtgaaaagaagaggcagagattcaaaacaagaggaccaacatttctgaaattccagaaaaagaacagaagagaagaaattatcaaagagattgtggcaaacttttcccagaactgaggatcacaagtctctgaattaaaaaggcacactctgtgccaagcccaatgaatggataaaaagatcataagaaagcacaccatcttgaaatctcaggaccctggagataaagaaaagatacagaagacttccagagaggaaacaaacaaatggaatcaggaatcagaatcgccatactagatgtaaaaagataaagactttcaaaattctaaaggaaaattgctctcaatctagatttttttttttttttttttttttttggatacagggtcttg

SEQ ID NO: 36987 - DNA, 1056 bp, Homo sapiens
agcttttctgaaggaaaataatttgaaactaagacatgtgaataatgaatttttatgttcaatctatgttcagtggtacccccaacacatacccctccatcctaacactcagctaccacatccctttgtgtgaaacagtaatagaatatgaagatcagttgttgtaaatcagagcctttttgccacccagcagccttcatataggggcacagaagaaagaagggtaatttattcactaaatactgaaactattattcattgttttgaatgagtgcaaagctctgcggacaaatgtcgtcttttgcagtttccgatatggtctggcagcattgtaaataatcctattatagttaacgaaaggattatacacatagttgtattgtttgtattacttcaaaataagtgggccattcactgagccttagaactttttttttaatgttacggtatttttgacaatgggaattatattcaagtatcaaagtctaccatgcaaaactagcttatttacaaagtgcaaaggcattctgactaaggaacttaaaagaacttctttttcaatgaaagaaaagtaatttaaagatgaaaatcacataaaaattaaacagagagatcattcttttttttttttttagctcaatgaaagctatttttattccttcttttgaaaatgcaccatttgtttgctttgtcaaggtacctttaaatgaagtcatcctagggggtcaccatttattaatgcaaaatttgacatattgttgtcattaagatcagtattaagtttttctctttttgggcagattgaatctataaattaccccatttctgttcattaaatttaacatagaatccttaaaaacaggggatctcaggattggtgttgaaaatggcaagacccaagaatgtgcgtattctggcatcatatctaatcttcaagtaatattttgacttatttgatgtgaacagggttgggtgctcagcattttttccctgatatacagcggcattctgtgtaccttttaagctattcctttagcccttagctaaatgcagttt

SEQ ID NO: 36988 - DNA, 1009 bp, Homo sapiens
tacacacactgggactgcagaacgaaaaggcatggcataaaaaaaatgagaagactgagaggcagtagggacttagtttggttagaccatggcagagttgaaagggagttacagagacaggtttgatttataaacaaagtgaaatggtccctatgcctcttattttggtttcattttataaaacttttgtgagcttttttatttgttgcgtactgtttttactctgtgaaaccaatcaataatatcctgaaatggtgaacaaaacatccagaaggaggtcatgatgatctcttaaggcacaatgagtaacctttgagaagtcccttgaggactggacattgagaaagcaaatactttattgggcaaagaaaaatactggtacactgcaagatacttagtgcagtctgtctttagtatgttgaagcaaataacaagtctttcaaactttgcatctctacagtttttatgtgtgttctgctttgaatagaattggattttatctttgtaaccgtgagtgagccctggaaatagtttatgtgagacataaatattggaactagagagaatatggtgacttggctgtttagatgtcatttttcagtggaatttctaagcctagcattcactcactcgatgagtatctcttgagttccatcataagtgctgaggaatcagcagtactctttttttatattaagtttgattaccatttaaagttaacagtttttaggtggacaagaaagtgtctttttcatgacttaatattaaattcataaactataaacatttttgagaaatgaactatagtatcttactgttcattagaaaaacaataaattgcatgttcaatatcctctgacacttcatacgtgtcagagtatctggttggcccgagaaatggccaaaccaactaaatagtttgaaatagtaattcatcttagggccctatagaggccacttttgaaaatgtttgctttaaatacacacatttcccctggtattcctacaa

SEQ ID NO: 36989 - DNA, 1087 bp, Homo sapiens
agaatggcgtgaaccctggaggcagagcttgcagtgagcctagattgtgccactgcactccagcctgggcaacagagcaagactccttctcaaagaaaaaaaaaagaagttgtgctaatgcgtgcatggaaaaataagaatatagagtagagactagaagaagtcaggaaattcacatcacagcactccagaatacagtagatgtttataagataaaatatggcttgcggtctgcttgcaagcagggctccagagatagcaaacaattaaattttcccagtgaagttgtgaaacagatgaaatttacatattctagtataaactcttgcactttgggatcaatttttaaaaagagatattttctgctattgcatttgcggtagtcaaaactcatttgagtatattttataatcacaaatttcaaacagtataaaatactacagcatatatgtcttatttttattgtctttgtgtttttccaatatgaataaatatggatatttaagatacatactgagacacacagaatctatgtcttttgtctgaggactggtggaactcatattgtcctaggctgttcattgacttgtgatttgttccatgttatgtggcatgttattgcttagtatttattgaattgaattacatggtaatggaaatggatttattgcatatttatgcaatgtttgtagctttcttttttatggaaagaattatgatttccatttattcaatctcaggagttgcataaaaaatattctttcacattgtgtctagttctaaaaggctggaattgatttgtatgttgtaatgccatgggataagaaataagcagccacagagatcaaagtaaaggaaaactatgagtaagatagtgaaatgaatccagaggtaaagttagtatacactgacgtattcatcagccctacacctacaactgggctacaaatttggctctaaactcttctgaggccaaatcagaaaaggaaacacaattcactacaaatgctattttcagagcccttaagatcaatccaattcattgcttagaaggtctcagtgaacccacagagagatgagtatggaa

SEQ ID NO: 36990 - DNA, 1135 bp, Homo sapiens
ggagtctgaggcaggagaatcacttgaacctgggaggtggaggttgcattgagctgagattatgccacaacactttagcctgggtgacagagtgagactctgtctcaaaaaaaaaaaaaaaaaggaataggggcaggaaagtgttttgcttttctatactgacacaatttctcttttaaagggagacaatacatgcttctcttggaactctcttgagctgtttttattctctttaggttatttcttttcacaagatggacataatcaggagaagggactcctctctccaggggccacacgtaacacagcccaaggaaaagcatttgtttcactcccaatttttagtattaatgtgtttgctcttagagtgtgtaactgattattctgctctttgttgtcatcagatttcagagaaatcttttaacagaaataaatgtgaaaatacaagtgaatggtgctgtctgggttttagcacattcagatatactgttcttaccatttaactttcaaagactttaatcagatcctttagtttgattcacctgatatccattgcacagctactgtgtgccagccctgtttctgtgactcagagccacagacagaatgtcgtgatgcatatttattcatgtacttctttttttttttgtagcgtccatttgtactatttgtttcctagtctggaagaaggaggattagcaacctatcggactgccattgttcagaatcagcaccttgccatgctagcaaaggtatagaagacatctgcagcatttgtagttacgtctgacatgctcttctgcggtccatgcataattttgcatttgaataagtaactcgttaggatatattaggagtgttaatattttacagaccaggaagtattttttgttgggttttaaggatccagtcttattagttctgttacctttgtgagtttcaccagcagctaatgaactccacagtgaggtaacttgagaacagatgaagaaaaatttgacagatgtgcatgaacagagttaaacatttggggaaaaggaacatgggaacaaagcaaaagaaatgaaatatactgtcttttccctttgtgtagtatttctgtagtacatttgtttttaatttacattaacaagcc

SEQ ID NO: 36991 - DNA, 1034 bp, Homo sapiens
tacttggggagataagatggaaagatcagggcttagaattcaactggatagacagctccctttcctgcttaatttgggatgatacaaagatggtgctcccatgctgagtttttgttttgtttttgttttttgagacagggtctccctctgtcatccaggctagagtgcagtggcatgatcatagctcactgcagcctcgacctcctgggctcaagtgatcctcccacctcagcctcttgagtagctgggactccagtcaggtgccaccacaccagcctaattttttattttttgtagagatggcgtctcactgtgttgcccaggctagtcttgatctcctgggctaaagtggtccctccaccttaggattacaggcgtgagccactgcacccagtttatgctgttttaaagactgaacttatttcattgaaattttagctggccatgactcatccaagtcatcatttaaattttggaatgaatcctgatcatgccaggaattcattatctaactgtggaattcggcagcccaaatacggagacagaaaagttcatcacatgcacatgcggaagaaaggtatgtctggatgattttaagatgtgaatctcctattttggcctgtgttttctgttgtaaattatttcgcctctaggaatggttccctgggtgactctttcaccgtctcatattctagtgcttactgactctttttttttttttttgagacagggtctcactctgtcacccaggctggagtgcagtggcacgatctcagctcactgcaaactttgcctcctgggttcaagtgattctcctgtgttagcctcccaaatagctgggattacaggcatgtgccaccatacttggctagtttttttgtatttttattagagacagggttttgccatgttggccaggctggtcttgaactcctgacctcaagtgatctatccgcctctgcctcccaaagtgctgaagttacagacctgagccactgtgcctggccccacagactcttttataatacttactt

SEQ ID NO: 36992 - DNA, 1030 bp, Homo sapiens
tgtgtgtgtgtgtgtgtgtatcttgttgtcttttagtaaaaatagcttctctctgcttcttcccataatcctctctctcacctggcacctaatttgaagtgatatccttttgttgcaagttaataaggcagacagcaacctcatcctactctttatgtatttcttattctccccttgttttctgatggttgtactaatcaatgttagaatgtttaattatttcttatattgactcacttgtgattatctaccaataaaaatatatttgcaagtaatcatcagatcatgtcattatcaatctcccacctccccttttttgtttgtctgaagctcattttctaaaacattcctcaagaagggcttatagaaacagtggtccttgagtttctgcatgttcctcacagtttgcctgtggcctttgttttaacggtcagtttggctggatataaaatctgtggatcccattttctttctttaatattttaaatacattctcattgttttctggcataaaacattgctgtcaaaagtataacaatatggtcaggtacaggtactcacaactgtaatcccagcactttgggaggccaaggcaagtgcatcacctgagctcaggagttcgagaccagcctgggcaacatggcgaaaccctgtctctacaaaaaatacaaaaaattagctgggtgtggtggtgcacacctgtggtcccagctacttgggaggctgaggtgggaggatcacttgagcctgggagatggaggttgcagtgagccgagatagtgccactgcactccaaactgggtaacagagtgagaccccgtctcaaaaaaaaaaaaaaaaagtgtgataacaatatgagtttaagtgacttggtccttttatctgagtgcccaaaggattttttctttttctttagaaaccaatagtttactagaatatgtctcagctcttgtctcagctcttttcagttaattttttcaggtatgctgtatatactttcagtatatactttcaagttgtcttttatctc

SEQ ID NO: 36993 - DNA, 1025 bp, Homo sapiens
gcatatcataatgcagtttaaaacctccaaaataaaagcatttagtatttttggtaatgaagaataaaaatctaattgactgggaaatagcagttaagtgaatttatacactgaatactttgaataattttatgattattcaaagtctttgaacagataggctcataatttttacaagaaaggatttatttaaaatccttggtagtttttcctctgtgtttggtagttcattgatatagaacctactgttttttagtaataattgctagtaggttgctagtgaaagccttgagatgctatctggtttctgcaggagacgaaaccattgcgttaaatctgagatggagtgacctcagtaccagcatctccctctggaagtacattttccccaaccagagaagctaccaaggattgttaggagattagaaaattctacctggtgccccagccaatgttaagaggattgaaaacctaggggtgggtgctataacttgtaattatatgtgaaccgaatgtggacctgtcactatgtttgtagataaattgttgaagaattttttctgtgttgctgcttgttagagtgaattctgggtaatatggaagaaaaaggaatcaaaacctgaatctgagtctaaaaaattcagcataatgactcagaagaggaagaaaagcaacatgctgcagtaagacctgtattttttaagaatagggtttcacacactgaggttaaattggtatcttctgtagagggaggcacctggaccctatgctatactgagaaggtggtccatggaaatcaataaactgactcagaagacatgaaaaaaggagcaaagaatttgcaccatcacagtcgcatcaccagtaggagactcatgccaaatgcggagacattgtaacttcttaaggaaaaaaaaaggaagcacaggtgcctggagaactgttggcctttgaggaaagctgagttgtggtggttggtatttgtattgagtggacagagagctgtatttggactaattaatgaa

SEQ ID NO: 36994 - DNA, 1044 bp, Homo sapiens
acaaacaaaatgttgctatttgcaaataaaacattctggctagtatggattcttttaaacaaatccagaaagtaaaattgtttaataaaaatatgtttaaacataaaacatgtttaaaaccagaaaatcgtataatttttactgttatactgttaagccacataattattaaagtaactttaaaagaaatatgtaagtaataacactctcagagtaagactgtgaattctatttttattcttaaaacagttgcatatattgatattccctctgtcacttttcatgctgagtcagaggatggggcggtggtggtggcagatgtccagtttcagctgggtggttccacttggagagttccatgttctgtggtagacacggggggagcacgttcaccctggacttccttccatggtatagttacgttttcctgaaatctagaatcagctggagagtttaaaaaaaaacttaaggataccctggcttaaggatatagctaccttatatactccaggcagtgaggcccagttttctgtagttaaaaaaaaatcctcaaacgtttgattttctcactgcttgtttttgagccagtggcatagatgaagtttatgatcaccatgatcatcattcaactaatttgtcaagggactactatatgagccaggtgctagtgaagttatatgttaggctggcacaaaagtagttgcgggggtctgccataccgcaactatttttgcaccaaactaatgtatgatgcttgcccaggtgaaaacccaaagaccactaacatatgaaaggagtctttgatgaatggttgagccaatggatgcatcaggaaagcctctcattttaggagctatcactgggataggcttgccaggggtgcttcctaaacagtaagatctctgaggaattgagaaattgtagaaattattggcatgattaactgtgcatccttgagatgctgtaaagccagtattaacaacatgaagtcagacctagtcagtatgaaagatttttattggaagtttcagtgtcaggcttagg

SEQ ID NO: 36995 - DNA, 1046 bp, Homo sapiens
atcttggttcactgcaacctccaactcccgggttcaagtgattcttctgcctcagcctcccaagtagctgggattatagacgccaccacgcccagctaatttttgtatttttagtagagacggggtttcaccatgttggccaggctgttcttgaactcctgaactcagttgatccacgctgctcagcctcccaaagtgctaggattacaggcataagccaccgtgcccggcccctcctcatctttgaagacaactcatatgttacctcctctttggttcttttatactttatactttttttgttgcttgtttgttttttaattgaacttagaagttacattgcattgtattctttttgtatttacttacatgcctttcttcttacacatctttacctcttaagataggacccgtagcttattttagagtacctatgaacctaatatagttgttagcaaagaataggtattttaaaaatacattgaatcatgcaaaattttgtaactcttaaatatttttaaatgattataagaacaaagtagaacttaaaaatgataatggctattatgaatttcactcaaattaaccactattctttagaataaaaaggaaaagcccccaagaactaaactttgtatctgagaaaaggatttccagtagatggcattataagactatttttctgtttttcttaccatccctttcactgatagaattaaaatttgtttctttctgattgctgtggtttatgaaaatgattacatctgtataaaatcatcttatggacagattaagcagccagaaaaactcagttaacgcgtctctgggacttctgggtctgttattttccccagctagccagccaattctctgcagtaatctccctccctttttcattctttaattcattcaaaaatatatttacggaaaacctgttatgtgtaggcagtaggcaattgtctgatgatacattggtaaagtaagatagatgtggatttattttatgctgagccttccttcattttcacatgtatcttgagtattag

SEQ ID NO: 36996 - DNA, 1024 bp, Homo sapiens
cactgtgcctggccctactttacagttgtttttaaggtgagtcccatcacaggccaaacaagctctcttggtctccgaagttaatcaggctctgtgggcccttgccatgctggaaaatgccaagacacaaccaccacccaaccaagtgtttccagctgcagctcacacctctcccagccccaacttggcaccttgtagccagaggttcagacacctggcatcgctctccttggcctccccaggcccatcacccacaggacaagaccctgtccagctgtctgcaacaagggcagagctacttctactggcagctgcaataaaggggactcccaaatgggcccatctccggcaagcctcatgagttccttcagaccctccttacaactgacgtggcctgctcacccaccgacccagatggaagaacaccaagtcttcatcaaggccacctatgtgtactagcagtccagtgggtgtccctctggtaccctcatggatgataattgctcatttaccaagttcatggtattttggaggccccaaaacctcagacatttgcggccttattggtcatccttgcttcaccagcacctgaggaagcggctgagagctggagactggccagcccttttttattggtctaggtatggcaaagccaatactgttctttcctaccagtctgtgaaggaacagacataaaacctgttttgttagatgtgaatctaggaaatacaatatatttttaagtaaaagtactcttgctttacttgtaaactgattttcgtttttttcccctcaggccatcaagccctgtcgtcctatgaccaacaatgctggcagacttttccactaccggatcacagtctccccgcctacgaactttttagtaagtttctaaagaatcacatgcatatcatttaaaatgtaaatagagtaaaatgtgaataggctaaagttattgattctgttctcaaatgttcttactttgaaaaatattttatttttatgttgacaaattggcctttct

SEQ ID NO: 36997 - DNA, 1062 bp, Homo sapiens
gaacgtgggtctgcgtggcacagccccatgtctatcacaggtgcacccaatgatgccatcacaactgatgctgtcacagcacacttcttgtgctggctttgtttgccttttctcgtcttttttttttttgatacagagttttgtcttgttgcccgggctggagtgaaatggtgtgatttcggctcaccgcaatctccacctcccgggttcaagtgattctcctgcctcagcctcccaagtagctgggattgcaggcgtgcatcaccacgcctggctaattttgtatttttagtagagatggggtttctccatgttggtcaggctggtcttgaactcccgacctcaggcgatctgcccaccttggcctcccaaagtgctgggattacaggcatgagccaccgtgcctggccagccttttcccgtcttaagatccatgcatatactgttccaccacctctcatgctttcttcatttctgaccttttcgatttttactcagcatatttattccttctagctttttaaatttcctattaacactcactgctgttagttctcagattaatttccccactttttttttcagtttattcataagtataaccaaaggtcagttattgtgttattttacaagtaaaaggaagatggtcataggattctagatctagaaagatccttaaatcttgtagtctgaaccccctctggagtatactgtaagtggcatattgtggctgtaagattaagggtagccataacttcattcaggtgtctcacagggctgatactccatgtcagcagtgttgtccgtgtcagcctgtgtcagcagtctacaacctagcctggagatttccaggagacaaggccacctaggcacagatgcagctttcataagtcttaaaacaaagtttccccttacaagaatagtttaaactccttttagaaaagagacacctggtaactgacctggactgaatacaggtataagcaaaggagaaggatcctccaaacttgagaatggtctctggatgaagaccctcctggtgacttggtcatctaagtccct

SEQ ID NO: 36998 - DNA, 1035 bp, Homo sapiens
cacatttacctgaagactgtgtcagcgataagtgtgtgtttgattcagagtatgattgccagtacttgagcattttgtttttaaatgtttgttaaatttagggttgaaaaatagcatcttgctgttaaaaatgctttgattacctgtgagatcttacatatctttgatatgatcgttattgatatagttcctaatattgatcctttatttttaaaagggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttaggtgagtcagagtcactaactagcctgagacccttgcgattatagcttcattcctaaattttggggaaatacccttgagagtcccacattgagatttcttctttttcattttatttttcttaattacagtcagtaagatacatagcagtagaacttccttctttttgatcgtatttttccttagttcatttggcagaatacagcagcgatctcatttgcaaggcatgctaacaagggtgccccttggagagttgtccagtcagaagagttcagcatctttccgagagcaggagcccatgccccctgcctctcatgaggacaggtgtccttccttggccctctcctttgccaggtgcgcctggtttgatgagggaaacagcgactgtaccccagctctgtttgaaggtttctctccacttgtgtagacagtttgcatagctttttcataaggtggtctattttttcatgtgtatgttctgaggttccaagtaggttgtgagatctttgagaatggaaattgctttttatcactttgtatccttagcccctaacagaatgccatgcacagatgagacattcagtgtgcatttagctacatgttctctctagctcttatctgcccacctccattacatcccacacgctgagaggcagttatccatactgggcaaagacac

SEQ ID NO: 36999 - DNA, 2018 bp, Homo sapiens
atgtgatgggttgatttctaagaaaacaaaaataatttcacacaagaagcagaaaactttaataggtcaataactcgaaaaatggaaaaagcttactttgcaccacctctaaaaaaagctttaaagtggtcttgaacactaaaaaaagatggaaggaaagctcagctcattctgtagtagcaggaaaaaccagatggcaaaacctaaccaagggaaaaaaaatgacacaaaaacgacacagcaatctctcttacaaatatggatataaaaacacgaattaggatattagcaaatgttttcagtagtttgttaaaataacagatagagtttattccaagactgcatggatagaaaagttaatattagaaaatctgtattgtatgtgtcaaaatctgtagggttatctcagtacttaccttttaggtatttaaactaaaatcagcatccatatgtgagtaaaaactagtaaactagaaatattaacagttgtctttaacatgatgaagaatggtagctcacgatgaacctgatggataccatccccaaagagtcaaatgtggtgttgaaacctgcaggcctttcccatacaaatttgaaaaaaggcaaggaggccccattgcttatcgttgttactgaatatccttgtgatacaatcaacatggtaattaaaaacatggtgtttttgtgtgtcccgggtattgtactggtatgggtgatataggcattaacaaaggcccccacttaataggaaaaggaaagttaagtgctgtaagtgcgtttgataggacacttacatgttgctctggattagatgagattaattaggaaggatgaaatgccatgggttagatgggattaattaggaaagatgacaagagggcctgaggaggaggagaggagacaggagaaaagccagagtattgtgtcagtggacatcattgaggacctatttgaggtggatgatttttaatgtataagtgctggaaatagcctcggtttaatggtttcttctctaatgcctggtagcttgcagagaaggtagacttgaattctgtaagttctgactaacgcagcagaaaataaaaattagaaatggaaatactgtgagggggaaaatttaccagtttgcactgtggcatattggtaagaagaaacattgggagtttggattttgaattttggagtgcctgagacacttacctaaaaaagatcttttgtttctgtgttgaaatgcccttctcaaagtgttaaaaaaaatattaactgatgttcacaacaactgaccctgaccattcattacatcattcacaacgcctgcttaaaaggatgggtgaggatgtcttttgcctgtgtttcttggcaataaaacatttggtggaatttctttttagaacatgatgaaatgtctgtatcaaccatattagcatttaactaccacttttagctttatcgtattaggcaagtgactgattttcaaagctgttgcctcctttgtaggggatgttaatatctgcctcctaggcttgctgtcaggattaaatgtgaaatgtcagtaaagtgcttagcagggtgccagcctcagagtaagcaccaaaacaaaccaaaaagagtccctaggagctaagagttgccgttattacctgacagtattttaacagccttttaagtaaaaaggactacctggttagaaaatgtaatgcaaagacaaattaaaattcactatggaaagttattaacaaataatttaagcatcttgtaatgcataggaccaatgggaagaaaactataaaatgtagctgatgacaaagaaggtgatgtaataaaaggaaggtatgtccttttcccgtagtggatgaccatgtcgtaaaaataccagttttcttcacaatatagtcacgtaccacatggcatttcagtgacagactgtatacaatgttggtcccaaagattataataccttatttttttactggaccttttctatgttcaaatatgtctagttacataaatatttacca

SEQ ID NO: 37000 - DNA, 1050 bp, Homo sapiens
acgcatccatgggggtgggggctggggaggcaactggactgattgctgcacagagatcaagcaaggtgattgaaaatgacctttggttttcaagacaaggtgggcactgatcatgtcacttattggagaggtggtggaagctgaagtcggattagagtgagttagaagtatatacacttttgtcttagcttgggctgccatgactaaatgctatagactgggtaacttaaacagtaaacatttatttctcacagttctggaggctggcagtctgagatcagggtaccagcacagccaggtttctgatgcatgccctcctcctgccttgcaggtggctgccttcttgttgtagtctcacctggtaaggggtgggtggcagggatttcttttctctttctctcttcataagggtactaatcccatcataattacctctcagagtccccacttccatatagcatcacatcagcgttatgatttcatcagcaggaattttgggatggacacaaacattcggtctgtagcaacgttttcaggtcatttgactgtaaaggggaggacaaagaaggggcaaagtcaagggagacctggaggccaaggaaagtactttatgttggaatagacctgagcactttcaaatgctgatgtgaagggtctggtatcagggagaggtggaggattgcagagggggggtggtaatcccaaatctgcatttggagatgggagtgggggctggggaggcaagcccccttgatcttgtgaggtcaagatcagaggggaacttgagcaaaggcatgacagcaaatggtgaacaatgggatgttgaattggtcattttggaagtggagcagctttaaggaatggtcggtccagggactaaacatggcagtgggctgggtggccaagaaaggggaagaggagtttattgagcatgagggtttcagatgttagcaggaacccagtattaaatgggtggcctattccagtggcttgactagggggtctttgagttgctcatcaagatggtcaggcatttatgaaaccctgttt

SEQ ID NO: 37001 - DNA, 1033 bp, Homo sapiens
gagtgcgctggcacgatcatagctcactgagcctcaaactactggacccaagtgattctcctgcttcagattcccatgtaggtaggactacaggcatataccaccacgcctggctaattttttaaatttaatcttttttttttttttttgagagatgaggggtctcactatgttgatgaggctggtctcgaactcctggcctcagatgatcctcctgtcaaggcatgtcttaactgcacagacccaaatcagcggctgagaatcagaagggagtggaacctgaagggactggtctcctttattccaacctctctcctcgcctcctggccaactccttactaggtgccaaggctggctgttggctgagaaaccacacagcccctctatatttgaatttctggaacagcattcttagatgacttcagtgacccaggtatactaccactaaagaaacattcatatttatttctctaaatagaaaatattcattcattagggttcaaatctctacgtatagccccaagaaattgatcttcagattagtatcctagatgtgaacctgtggtttcttctgtcaatgtttattgtcacaactgatttactgaaagattttatttgtaattccttgtactccagggttcagatgctcttctacaggtgacatttgaacaacacaggctcaaactgtacaggtccactcacactcagggtttcttcagcctctttatccttgaggcagcaagaccaacccctccctccttctcaggctactcagtgtgaagatgacaaggatgaagccctttatgatgaaccacttccacttaatgaatagtaaatacactttctcttatgactttttttttttaattgagatgaagtcttgctctgtcacccaggctggaatgcagtggtgcaatcttagctcatgtcaacctctgcctcctaagttcaagcaatcctctcgccttagcctcctgagtcgctgagactacaggcacccaccaccatgtccagctaatttttgtatttttag

SEQ ID NO: 37002 - DNA, 1035 bp, Homo sapiens
gccacgcctggccaagtagatgctttttattgagctctgtgaggtaggatcccagatcatccaagtaggagggggaaggtgaatgggtagggtttttgagaaaaagaacattattgtgaaaaatgagaggaaaaactgacaaggaaacaagtgctgagtggcagcgagggtccagttaaggctggaaactgtgaatttacagcagcagcgttctgtctagttgtgggattttcctctaggaatacggttataggaaccaagatgctggctatttggaagggtccagaatcgcctggtaagacacaacagtggggcaagggatctaagcctgtgggctgggcagagtttgctgtgctacgctagggttctggtctgagaagggaatggaagggtggagttctgatagggagaaaactgtcaagggctttttgaaagtgaagacgtgggaggaagtgaccaggaggctgggagcgtgtggtaaaagagtaggatgttcaattgtaagaaagatttagaggtggaaaagttttggattgtgtcaagattgtgagtgtggcctggaaaagggtggctaatttgagttctattgcctttgtacctctgatgcatttaggtgacaataaacatttctcatctcaatattactctattattaacaaacaaacagccaaaagagaaaaaaaaaatcaagtagtaagcagagtgtttattttttttaaaattacttaaaaaaggttgtttacagagatgtggatttatataacttggtgacaacatttttaaaatgtacaggctatttcatattattgcacttactctttaatatataaggcattttactttacataaataaaggttaatgtataatatcatacaaagttatggtgccaattaagtcaaccatcaaattcaatgagatgtgtgggaagatggaaatgaaacccagcctactttaatcttcatggtatattcttgcaactacggtttacttgttataacacatatttatttaccctcatagcttattgtgaatga

SEQ ID NO: 37003 - DNA, 1075 bp, Homo sapiens
ccttctgaatgtcctggtttttagtgaggcttttgctctctggctagttggcaatcacatttttcccagctctactgaactcttagaattgttcactttctggtaggtgttctttgcctagctttgtggaatttctcaccctaacacatgtagctttagctttcagcccaagactcaaggaacaccttgcagatttctagacctctttatctgtgtaggtcccccttctccagtagtctgctttgcacactgcagctgccttagctaccctgaactctgatctctgctgccttaacgtgatgggactgctgtgctctgcttgggttcttcctgcctgctctgctgcctgggacgtgcctctaggtggtaagcttaggcagttgtcaggctcacataggctgcactcaagtgtcacagttctgggctgcttttgactagtgtctgaaaacagttttttcgtatattttatggagatttctaattacaatgagagggcagctttaggaatgattacttcatcataggcctatgttgtttagtattaagtataggaaaataattgtgtctctgtccagttgaatggtaatatattttaagacagcaacttaaaattttaagatagtccgctagaactttctttgatgatgaaaatgttctgttcctgtggggtgtagccactggccatacgtcactattgtatacgtgaaatgtggctagtgccactgaagagatgaatttttaaattaatttaaatagctctatgtgggtaatggctcctgtaatggacagtgtggctgaaggttttctctcagtattagaaaatctcgaccttacaacgtttgcatttaaaaaagatgcctgtggttgatctttaacatattctaatttagaaaaatatagtttttttaagtataaaaatagttgcatgttcattggagatcatttggaaaatgcagaaagcacaaaaaaagttgagcacacataatcccaaagataagtaagattaatattttggtgtatttccttccagttttctataaagaagaacccactttagtgaaaaatcgtttggttt

SEQ ID NO: 37004 - DNA, 1057 bp, Homo sapiens
gccttctgctcgtgagatttctttatttttctctaatacttgaggagatctgaataaccgtctatttgttggagtgagcacacggggtttaccctcttcccagggaattgctacaagagaagatgatagctgggtccctttttattgcttcctttgagtcagaaatgattgccagtaggaagggccagtcataagtggaatactttatttgaaggtggtctgtgtttaggctcttctaatttttagtagaaacattaaactgtaagttagtatactttggaattgggaaatttccacaggaacttctgtaaaatttactaagcatgtatttccactggttgcaatatgtaagttttaactaaggataaggtgaggataaaccttagcataagttcagtataagagacagtagtcataaactattaatcccacttaattcccatgagaaaaaaaaatattgtagaacagcattagagggatgtgtgtataggggagggggtgttttttttgggtggggagtggaaagctgcaaagagaagtttaactgtagatctctcagaataattcgtttcttgacttttttttcccctctgttgtttggcagtagatgttgtttggctaagatgtctctggagtatagaattccttcctatttgacttgggaaggtaaaataaaaatggatagcttgggagtcatttattctgctatacttaggttttgtgacaacataaacatattaagtcagtgataccaaattagagttgataggggataatacttctttgataacaacaaattattctttacataattaattaatcttaggattgaactgtagttttttaaataggcttttatgtaagtttggctgtttattattttatgttgcattagtttaaatttccctaagtcgtttaacacaatagttacccaattccagcctagtgtcttaggctgcctaacacctgccattgacattagaaaaagcaaaactcatactagtgaaagatgcagcagttatttattggtgggacattgggtttacacaattataaa

SEQ ID NO: 37005 - DNA, 1064 bp, Homo sapiens
tgtgtgtgtgtgtgtgtgtattttatttatttatttatttatttatttatttatttatttattttgagacagagtttagctcttgttacccaggctggagtacaatggcgtgatctcggctcactgcaacctcctcctcctgggttcaagcgattcttctgccttagcctcccaagtagctgggattacaggcatgcaccaccatgcccggctaattttgtatttttagtagcgatggggtttcactatattggtcaggctggtctcaaatctgctgaccttaagtgatccacccgccttagcctcccaaagtgctgggattagaggcgtgagccactatgcccaaccccagtatcattaaaggtttagtttaagttggagacagtacatttatatactgagatttcaatatttttttacatcagcagttcagaaacacaggtacagatatggaaaaagtgacagttggattgatccggggctggagttttgctagttgaatgcagtgggaaacaatggatgtgtttaggaaactagtaagggtgtagttgaaggtagtgtactctggcgttgtttgcccatctttgaattgggattgataataatagcacttagttcagaaggttgttgcgaaggttgaaatgagctcccacagtacttagtactcagaacagtgctttgcacatggtatgtgcacagtaacttattgtgctgggtggggatgagggaaagaacggaggagactggtgggaaaaagggaggaaggctgaggattggaatccccataaggatgatgaaaagttacttgtggattgaatttccgagttggatttggttctcatcaaaaggttgtgggtttaaggatgctgatgtccaagttcccagggagtggcagataagatccctggttttgagtgaagaccatgagaatagaggccctgagggccctggctgttacttctgtgaaaaaatacattctgtgttacaaattgcttaaaagggaacttttaaaacgtaatcataacttgattactaccagtaacttacacatgtggatggcaccc

SEQ ID NO: 37006 - DNA, 1006 bp, Homo sapiens
agcctcaacctcttgggctaaagtgatcctcctgcctcagcttcccgaggagctaggaccacaggcacacaccaccatgcccagctaattaaaaaaaaattttttttttataaagacagggatttcaccacatggctcaggctggtcttgaactcctgggatcaagtgatcctcccgcttcagtctcccaaagtgcaggtattagaggcatgagccaccgcacctgtttttttttttgttgttgtgttttttggtttttgttttaagacagattgtgctgtgtcgccaggctagagtacagtggcgagatcatagctcactgcagcctcgaactcctggcctcaagtgatcctcccgcctcagcctcccaaagtgttgggattactgcgaccggctctaggatgcactcttgaagcatattattcccctgctgttttgtcatgcagccagacttgtccaatcatatgttttctttcagggctttggatcttgagagaataacgagctgtagggttttttggagacctttccagagtcatgtcagcgtgtggatcagactgttctttggcatggttctttgagctgctttctctggtctgttggcactgtttttttccagtctgattttccagtcatctttcagtgttgtgagtttcaacagccttccagtaaagttgctttttaaagatagccagagtcagttactaatgtttctaatgcttgtagacaagaactgtaatacagtaacttaactctatgtcttgaaaaataagtaggtacttgaggtaaataatatgtaatggggtaaaatacttaagattaaccaaaatgatagaactgacttttgtgtggcttttacacaggctccaaagatgttttccatttttggaataaggttcccaaggtcactactttgaagtataatagtgatgaagatgtataacttaacaaaaattgttttcctttctatacgtgtggtgatgtccaccatctctacatatcaaat

SEQ ID NO: 37007 - DNA, 1051 bp, Homo sapiens
ccgtagagatggcttggatttttccttacccctttcacagtcgctcctttcatttcgacaccctggcagtttgtatttcttcgtcgccttttttccgcgtttttaacccgtgtagaccccagggtgcaaatccaacccggagactgcccgggaaactaacagctggagccaccagcgccacgaactctttgggtttttgcaggctttaggacctgggaggggtgcccggatctgcttgctggggatgttttttttttcttcttcttcagttaaagcttactgttgggaattacgaaaaacgtaggcgaagtggtaatagagggaaaagctcttttactgagtaaagttaagttaagtttctcatgaaacctcctggtaaatgactttctaggtgaacttacattaggtgagagattatttttagtatcgcttttatattttatcagttgatgaatctcaaagtcttgccgtcttaagaaagggctttttcatcgagtgcttgaaatgtaggtttgtgagttgatcagaggcctcaaagcttcaggtgggttgaagttgcaatagataattctttgtattctgactttgaaagcgtttattttcacttcagtgtccaaaattttcacacacagaaaagttgaaaaagtgatagatacatatgcatatatactctttctagattctatgacgttttgctgtatttgttatatttgcctacaaaaatgattatttatttatgtggagacggagtttcgctcttgttgcccaggctggagtgcaatgccgcgatctcggcttaccgaaatctccgcctcccgggttcaagcgattctcctgcctcagcctcctgaggcaggcatgcgccaccatgcccggctaattttgtgtttttgttttgttttgtttttgagacggagcctcagtttgtcgcccaggctggagtgcagtggcgcgatctccactcactgcaaactccgcctcccgggttcaagcgattttcctgcctcagcctcccgagtagccgggactacagacgtgcgccgccatgccc

SEQ ID NO: 37008 - DNA, 1059 bp, Homo sapiens
ctcctcacctcccagacggggtctcggcagggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacgcggtggcggccgggcagaggctgcaatctcggcactttgggaggccaaggcaggcggctgctccaaaaatgctaattaacaggaagaaaaaaattactcggtagggcagacagcctctaacatggctcccagggttcatggctgtgtaatcttctctccttgtgtatgggtgaacctagtcacttgcttccaacaaacaggacatggcgcaagtgattagatcacagaagactgtgatacctctttcccttttgtggagcccttggtttgagaaagggaagctgtcattttgtagagctgccctatggagaagtcaatgtggcatgaaagtgatgtctccggctgacagccattgagggcctcaggcctcccaatggccgcacgaatgagctcagaaatggatcctcccccatttgaacagtgagccagaaacctggtctacagccccacaccaaaccttgactgccgttttgtaagagatctggagccagaggatctggttaggccatcccgccttacaaaaactgtcccacagaaactgtgagatcataaaaattgtttggttgttttaaactactaaatttggggggtaatttgttatgtagaacagttggctaaaacacttagtcagcagccgcctcacgttgagaagatgtaaatttcatgaaggaaggttacttcttgctgagctggagactaagctgaaagcgaaatttaaagtggaaagatctagcagagctgtgcctacacatctggtggcaggtaattt

SEQ ID NO: 37009 - DNA, 1044 bp, Homo sapiens
ctcagtaaatacatgctgaagaagctaattcaggaggttgaatttaaaccattaggttcgagatttgttatattattataaaaaatcatctttaatatttgtggatagagccatcaccagagataaaaagggcagtttgggctgggcatggtggctcatgcctgtaattccagcactttgagaggccgagtggggaggattgacgaaggccaggagttcgagaccagcctaggcaacatagcgggacccccatcgctacaaaaacaaaaacaaaattagctgggtgtggtggtgcaggcctgtagtcccagctactccgggaactgtgaggtgggaggactgcttgagtccaggagatcgaggctgcagtgcacagagatcgcaccactgcactccagcctgggggacaaagcaaaaccctgtctcccaaaataaaaaccaataaaaaatagataaaagggcagttttattaataaagaggataggaaagaaactcctcccgagccctgcggatctaaccgagcactgtcaagggaggctgtgtctcctgctcctctctccgcaccagtccaggctccatggccccatggcccaccattctcccgcagtcccacctgttccgggggaagtctcggcctccttctccccacacccaggccctatacctgtgccccccaccctcccaatccccccctccattatccctcaggaaccttttgctttctattatgttctgtctcccagtcctttggtctctacagaccccgcccgttcaatgtgccctggtctagcctatctcaaaacaaaatgaatgcctggatcctaccttcctcttcaagctacactccccacccctattccctgtctttatcagcctgacagacttattatttatttatttatttatttattttaagaataatctagccagatgcagtgcctcatgcctgtaatcccagcactttgggaggctgaggctggtggatcacttgaggtccggagttcgagaccagcctggccaacatggtgaaaccctgtctccac

SEQ ID NO: 37010 - DNA, 1043 bp, Homo sapiens
tgttgtgttacgggaggaacctaaggctcccccttccaataatggatttcatttctctcctcagacctagcttttctaatcatctcttttccttgggagatagggacagacagcctaagctccaggagttggcaggtgggaaaggactgagctgaaggggtggagaatttcaggttgcactagctaaatcacagttgggacgggggcgacaagaaaccttgaagcctttgggtaagaagaccagatatcaggtggagcaatgtgttgagcggcctggtggcctgggggaagttctgcagagactctgaggaagcaggggctgagcagcatgtggtgctgccgtgcaaatgccacacggtgggggggacccattccagtgtgcagcctcggtgtcagccgcaggcccgggccaggctttggcctgcagagctgctggcatgtcagctggtcttgagtgctccctttgcttaggagatagagagaagggggcttccaggaccaaggagagctcagtagagagcccaggctctggagccagactatttgaaccacctttggcactgagcagcagtgccttcggcagattgcttacctctgtgccttagtttccttgcttgtaaagtggggcaataatagtgactttgagaatgaggtgctcagtgaatgtgagtactgagcacagaaccgagcaggcaggaagcactgggtggtggttcagtgtagtccctgccctgcctgacacatcttcacgatggagaaaaagagaggccactgaatcctggccttcatctttcctgaccctggatggaaagtcaaatcctggtcacctccgagctgtggtcttgtggatggttttgttttctttttaatatttttattgttattccatatttcataataaggaaataattttctttacaataaagaatatctttttacaaggaagaaccattgatggaaatatgttagagagttttagagtgaacctgaaaattaagttgttatctcttcttacttcaaatgaacagtagcaaaagagctgg

SEQ ID NO: 37011 - DNA, 1316 bp, Homo sapiens
gactgtgcccccaattagataatctcagtgcttctgagcagcctcctgagggctacaggctttgcttgagctgggaggattaccaaatcccccagtgaagtaggagcaacagccctgctttcagagctcagccttgtgactcaccagctttgtgaccttgggcagttcagttttctgagccttggtttcctcaaatgtaaaattggaaaaacaacagttgcctcgcgaggctgtggaagcacccagcacagcggctggcgtgtagactgctggaaaggaagtgtccttgttcttgccctcctcccacaccaaaagcttgtagtgaataaccacaggtagcctcagccttaaatgcccatgattattcattctcagggcagagcaggagcatgcttcctggtgcctgtgtccagaagtatgtgtttgccttcctcagccctccctggaaaacagcatgacctgtgcttgttttggcagggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaagtaagatgtccacatgtctaaacccccttcagctgcccagaccccgtgcatgtaatgataaaaggtacttacggattctgtctgccagcattttctacccctcgaagcagtctgcagagttgagacttgtgatggtcaaattgtcaagggccattagaatcctttgctttcagcaaatcacctttgccctggtacaacagggccatttgccagatgtcactgtggatgctgccaccctggtcatactccatggaatcgtgcctcttgtcctgcctgtgtgtgtgtgtgtgtgtgtgtgtttgtgtgtgtgtgtgtgttagtagagtaaaaggaacattgattgtgtgggttttacttggccgataccagttcatttattataataaatagtaagacttttcttaatgagctgtgcctgtaaaccacaggttgcaaaactctgtcaagggctgcaaagtctctgtcacaactacccctctactgttgtagtacaaaagaagccttagtctgctctgcccttggagtagccattctttattcctttacttgaaaaaaaaaaaaggagccttagtaggtgaacaagtaggcatagctgtgttccagtgtttacgagaacaggcgccaggccagatttggccggaggggtggccagtttgctgacctatgctatgagccac

SEQ ID NO: 37012 - DNA, 1033 bp, Homo sapiens
ccaccacacctggccaagaatttttaaattaccaaaacagtcgtagcttttaacatgcaggaatagttcctcttgcttaagccccagaccagtacatcagaatcatctggggagctttttacaaaatcagagagccagcctgcatccctgcactataagtccgcaggcttatgggtgccagagagtgtttagataacaagcttcccacgtgatctgaccacactgcctcagagggacttggtttactggcatcttagtcacctccaatttataccatgctcaaaaatgagttctcaggaaaagccctaacattcttcttcagcctcaagataggctgtacccaagtttcttctaatgccatatttcagtctgaattaacaaattcagaaaatttcccacccagggccttctaccaaagaaaaaaaaaaatctgattttatttgttgacaaaactggttgtgtcttgtagaatttttcacagtcagaatttgactgattatatccccactgtattatttgacatgtttctctgtcccagtgtttctgatacattggctgattgctgtggaagttcaaggagactgaggttagatattttggcaagaacacttcctggatggtgtggcacactttattaggaggcccatggtgcctctctttgttatgttaacagccatatatgatcattgctttggtctattcattcattcatgtttgtaattaattatctttgaatatcccataaatactgagccccaagtagaggcatttgaatatatttttactgagaagcagtgacccagaaactggccttgattctctgttagaaatgactgtatcccttggcactgtcttgtggttttaggtaactttgaatggacaaagaatgtcccagctctctttactgagccctggtgtgctgtagattagctggatcaatactgacttgatacattcatgttttcctattcttacctttgggccttatttatgtgtccatattctttcaagaacacatcatcttttgctttca

SEQ ID NO: 37013 - DNA, 1066 bp, Homo sapiens
tgagcttcttacatattcttgttatcccctgtcagatagatggtttgtaaatattttctctcattcagtgggttatctcttcattttgttgatagtttcctttgctgtgaggaagctttttaacttgatgtgatcccatttgtccatttttgctttggttgcctatgcttgtcgggtattctttatgtctttttttgatagaaccctggttgaagtgcaactgatctttaaacttttctcttcagggaaattaaactacaagtggaaagtcttctgaaatgtggccagagttcaagaatgttcaaattcttcgtccaccaagtgcacatgttgtaattagacatgtttccctctttgcccacagtgcctgatgtatttcctttgagggataattagggaaggggagtggttcagtctaaaataagcctgaagtggtcacatttttcagatccttatagttggcagctttgttttcttgcattaaaataatgctgtgcagacactatgcctcgttgttgtagtctgactctaaacatgttttgtaacagaggataaggctctgtcctaaattgtggatggttttttaaaagataagggtaaggccgggcgtggtggctcacgcctgtaatcccagcactttgggaggccgaggtgggtggatcatgaggccaagagatccagactatcctggccaacatggtgaaaccccgtctctactaaaaatacaaaaattacctgggcgtggtggtgtgtgcctgtagttagtcccagttactcgggaggctcaggcaggagaatcccttgaacccaggaggcagaggttgcagtgagccaagatcacgccactgcatttcagcctggcgacagagtgagactccatctcaaaaaaaaaaagaagataaaggtaggaaggggtgagaaggcaatgtatttttaagtatataggttttgccaggtaatcatattacgggaaatgcaggtgagcaacatcgaggcatggcttatgtgcttctgagagccctgggtctggtaaccttctcttggcttacccagtgggaggagttcc

SEQ ID NO: 37014 - DNA, 1061 bp, Homo sapiens
tatcccttatgataggctctataacgagttctactgtaaagactatagttacccaacagactttaaactctctcgtaaaaattatgctaaattgtagaattgactaaacagaaaagtatctgtacagctactggcacttgtggcctatagagaaatacatcaaatgtaaattatcaaaattcagttgtagggaattaatgaaaagaccacttaagcgagtagactcttcatgtaactcattcttcgatctatttgattttagctggtttcatttatagagaccctgaataaagaacatactccaaactcttggtattatcctcccaatagtcataataatagtctccctggtacactgtattctctcagaggctttaaatgtttacatacagccatctctaaaatgtcaaattgtctctcttcaactggaatgacaaaaactgaaagaagtatacggccatgaggacactataacctatgaatgacatactgagatcagaaatgcaaaatggtagtaactgagagtgacgctaaggccctaaattgtggtcacacgctcacctaagtgagaacctgaccaaaaagggggaatttttaaacaaaattatgggaggccattgttttggactgaactcatatactagaccccaaacagaccaaactaaacaaaagtggagtcactcatgctaaacgtgacataatcaaactaaaattttaaggaaacacataaacactaaaccagaacacaccaggttttgtttttcttctaaaaatgggaccttccaacataggtagataccctctactcagtccttgctcctacctttgcaaaactcactgttctgtttcccagtgggtttcaaaatcaaataaatacatttatgatggtgatagtgacatcaatgactaaagttttagtcaatcttttaaaattgagaaaatgaccaaaaggagggaattgttaaagcaaactaaatatggcccgagaaggactccattcttctatatttgagtccttgcagatgtactgtaacctagcttaatagacaagattgaaaacc

SEQ ID NO: 37015 - DNA, 1385 bp, Homo sapiens
ttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttattgagtactgcatcttgttattcctgacaaatgtttgttgtctaagcacataattttcagaaaattttgtaattcaatactatattggcttaatttctttctagggtcagaatctacccccaaagtcttagagggtcagaatcttcccccaaagtcttagagggccaggaaactgtaggagaccacaggggaaatagaacaggagactcagacttttctcccagattcatcacacacagattatctaatctaaaaatctgaaaattgt

SEQ ID NO: 37016 - DNA, 1050 bp, Homo sapiens
cctgctacagtcagttataatcacaccactgctttccagtctaggaaacagagcaagaccctgtctctcaaaaaataaataaaaagcaaatattacagtggagtgcagtggcattcacttgtagtctcagctactggggaaactgaggtatgattacttgagcccaggagttcaagctcggctgcagtgtgctatgatcgtgcctgcgaataactactgcactccatcctggcaacatagcgagggcctgtctgtaaaaaaaaaaaaaaaaattaaaaaatcttttaaagcaaatattacaatccttgatttttttaatcatttaatatggggagctttttccatctccagttataataattcttaataagttattctcttatataattatagcctccaagaccctttacatcaaaacctgaagtgttgtaatccttaatttgattctatttatttttgatattatctttttacttttgaattatattcttctattttcattgctcttttaactgtagacatgtgcttggagaatagctatgttctttagaaaattaatatgttttaattgcttagttcacagtaaatggtgtcagaggtagttgattagttttattgtgtgtgtttaagtgtattgacttttttgtgttccataaataattgatttctttcttgacttttaattaatttctgcttttacctgctggtataaatcagaaatgcctgattcttaaagccaatcaataaacagattttgaaaaagctttgagttacttgaaacacatttttatgtcttgacgtacctgaactgtagctgattacttaatgctcacttttctcataacatttgctaaaagtactcagtaaaaatttgaggcatttatcgaaagttacgtattttatgacttcaattttgtgttttaatcacaacatcaatattttgctaattattactcttggtttattttatcactgaattgtcaggattattctcacattctttccaaaatcattccatgtcatcatttactaagtatttacaaaattctg

SEQ ID NO: 37017 - DNA, 1050 bp, Homo sapiens
ttcaaattagttgttcttctgtcatgaatccatggtgatgaaataaaatataggtagagttctgttgtaatgttggtctgatatcagaattgctgtgtgctatctaaacctttagaatagtataactgcagtaacttataaaaggcatgtaatttttttaatgtttattatagacctagcacaatggctcctacctgtaatcccagcactttaggaagccaaggtgggaaggtcacttgaggccaggagttcaaaaccagccttatttgtatagcaagaccctatgtctacaaaagacaaacttaaaaattagctggatgagatggcgcacacctgtagtcccagctactcaggaggctgaggtcagagaatcacttgagcccaggaggttgaggctgcagtgagctgtgattgcaccactgcacttcaccctgggcgacagggcaagaccatgtctgtctgtctgtctgtctgcctgcctgtctgtctgtctgtctctctctctctctctctctctctctctctctctctctctctccccccacaacacacaatgttattatatattttatttctagacagtgtcctatgatgagtatttcagcaaaaaaatctgttattgtgctgggcacagtggcccattcctgtagtcccaggtactcaagagactgaggcaagaggatctcttgagcccaggattttgaggccagcctgggcacatcgtgagaccctatctcaaaaaaaaaaaaaaaaaaaaaatctgccactgtattgattaatgttgaaaacagtatgctaagtgcaagaatccaggctcaaaaggtcacatgttgtgtgattccatttatatgaaatatcaagaatatataaatccatagagacagagtgcatgtctctatggaaatagggataagttgcttaatgggtaagggggtttactttgcggtaatggagatgttttggaacttgatatggacaacatagtataataatgctgctgaatcattcgttttaaaatgtttcatgttatcttttttaagacagagtttc

SEQ ID NO: 37018 - DNA, 1032 bp, Homo sapiens
taacaatttatattcccctgaaccaagagagcatttgggtatgtgaagctaatttggggctctatgaagtttttttttttttccctacctctaattcctttggaagatcttacctttattttttcttttatctgcattttagccaaatgcatttattattggaaatagttagatgtgaatgattaccatttttctgctctttcctgatttcctgattgcttctgttctttcctggttttcaaagtcttcaggatagcaaattctagtgtttttcttttttctggtgagatagaagatggtcagatggagtttttacgtttaggaaaatttcttctgaaactgcttataatgtgattcattttacctttctccaaattgaaagttattggtgaagtttttgggatttgttgaatcagctgtcatccccaccctcatctctggagagccaagcttaagcagggtaaacactctgttcttaaggaatgttctctgtcactggccttttcctctgtttgattcaagctattacattttttcctgaaatgcagtagtgtgtatattctatcatttgtttttgagacagggtcctgctctgtcatctaaactggagggcgatggagcagccctggctcactgcagctttgaactcctgggctcaagcattccttctgcctgaaccttcctagtgcctgtgatgataggcacatgccaccatacctgactaatgtctttatttttaatagagatgagatctcactatgttgccccagctggtctcgaactcctgggctcaagcgatcctcttgccacggtcttccgaagtgctgggattataggcatgagccaacatgcctggccctaatatatttcttaatcatgttttggaggcaagagatcttcagtttctgtctgtgctattgtcataaacaggagtaactttttttctgttatcaaataaatttgaaattcttatgaactgtattatgtttaattttatttagcattcagattactttgaacaaatccttaagt

SEQ ID NO: 37019 - DNA, 1050 bp, Homo sapiens
ctctaagttaataagtgtagggagtgaaaggtgaggaagcagctgtttggtttagtgactttgcagtcatgcaaaggcacagaagggaaaccaaacagatttccttaacctttcagtccctagacaaactttttagctctttactttttcttttatttctaatgtaggcagactttttttttttaagtttactgttttaaatgaacacaggtcaaggttcacaggggatcaagaaatattattcttgtataatctgtttactttgacctaaataccagcttttaaatactaaccctggcataaaatactgctgtaaatggcagctcattgaatccaattttaagtgtgattgtttttgtttttatctgagcttccattgaacggtggtattttaactttttttcatcaagggatatattcagtatttctaagattaattcaattggtttttatgttgctctcaaggctagagctaatggtctgcagtcctgtgtgattatcatacgcattcttcgagacctctgtcagcgagttccaacttggtctgattttccaagctgggtaagtagtacgtaactgtatggtgtaaaaacatgtaggaaataattctgcagcttttatcctctcagtttacatgtaattatcagccttatttgcatttactaaatatagtttttcttttctgatgaaaaatcctgggggagtcttagaatgtttaattttctcagatgtgactaattaaagaattttcattgatgtttctctttgtgtgtttttttctttttgctgttttcacagtgttttttttttaatattacagcatttattagttggcttttacatataatatacaaatgtataaagaagactttgaagaactgttaatctccttatgcagggacattttttaaaataatgtatgtggttgggaactgtaaaaattcagaaatacatattattcaaaaataatacaaaaaaaataggagattcagtaacgcagaaagctacaaaataaccaaaagccttcttatttaaaggcagattatctta

SEQ ID NO: 37020 - DNA, 1050 bp, Homo sapiens
ttagggactattctgtaacattttcaaagcttcaaaagcttttaagctgaaaagcatgatcagtgtctgcagtatgttggttctgttgttttatgggtcagataaaatttactttgtttcctttcatgtttttatacatcttgttgagtatggaataacagtctacactaatatttctttgtgatacaggttgaggaggaagagggtactacatacttaatattaaaattcatttgtataaaatagcatcagtagtctctcaattactgtttctttaaatttgtttgcttataacaaagcaattttttaagacactgggcttttcacaacccaggaaaagaacattttaccaaaaatgtcattgggagctatgtctaattttacatactttgcatgtataccataatcagatgatatttatatcttaagctttgcatcttaaatgagttttgtgtaaagggttttcttatgtgaacgtgagtttctactcaaggtctggccatgggtgttgctggagaaacagttcctgagtcaatctggtcaggtcatatacagcatatgggatttgataaaactaatatgatacattataaatgttgctgtatttagtgtaaaatgataaccatttaactttatttcagaatacattttgttcagttatatttagacttaattaaatttatacagtatcaagccattttattatgttgtaaaagtctaaagtgaatagtgtcatatttgcagtaaattatttgataacctatcccttctaaaggaaacaaaattatatttttgtctgacccagacttgagttagaattattgttctgaatttcataaatattatgatgaggaaaatggtcagtccaaaatggaaagattttgcttcaagacactgagctgaaaagttggatgtgccaaagtgtagaaacactgatagtgttccttgctgcagataactgcagtaaaccatgtctttagcttcattatgaagattgcttctttcttgctgcagaataacggtatgtattctctctcactgcagctccca

SEQ ID NO: 37021 - DNA, 1028 bp, Homo sapiens
acagaaaatgtacaatatgggaataaattgtagctcctattaaggtcaggtagctattttagcttcattcaaattatgcaaatatatgttataaatatggcagtgtttcttttatccaagaatttattatctaagagagatagacctatgtacaaataactcacaatacaaacaatggtaaatattagttcaacacagaattctgaaagtagggagtaagactaataatactggcatgtacggcagggcttcctagaaggagcagtatataatctggtcctcatatagaatggttagggtagtaagagagtgaaagagccataatgaaagtgcttttgtttgttaatacaacagatccaatttgtttcttatcatcttcattacacaggttataagccctgagaagtatgacataaaatgtgctgtatctgaagcggcaataattttgaattcatgtgtggaacccaaaatgcaagtcactatcacactgacatctccaattattcgagaagagaacatgagggaaggaggttggaaagccattaaactttctactttctattaactttttttttcatttatctactctttaagatggcattaagccctagaaggcaacatgctggcattacacgtgaatttgatagatttgacttatttagcaaccggttttgcctaagataatttcccacagagtaaatgctctttttagtgatgtatttttatataaaacactatggtatgattgattttcttgatttctttcttttcttgctaacctcagatttctggaaaaaaaacttcaaaattatttttactggcatagtcaatgcatgaaaaaatggttttaaaatgttgctagtgactagggggacacaactttaagttggattaagaagtttttgctcttgccttgtcttacaaaaaagacaagagttttcacaaacaaaattggctaagtattcgtaacacatttttaagaggcatttttatacatatatatataataatggatttggcttgtcctg

SEQ ID NO: 37022 - DNA, 1010 bp, Homo sapiens
caagttctttaccataattcccaacacccttaatgtgtccccaacagtaagactgactatgacttgccatttatcactgccttgcactgtttttcttcatagtagagacataggaaagagcatgtttctttgaggacatgaagaaaattcccaaatgttgatctgtgcacttcaggtcatttactcacagtgttggcctgcctcctttaggtggcattgggtttctaattcatacttaaagcaggagagaggtaagaaactgaggtttctgatgcctgttctttttactttttcctcaggctgaaattttctgcttttcatgctcttttctctttcatttacttcgcaatgaaagcaaacatggaaaatcagatacatttgggaagaaattttagctaggctgatgttggtggggttttttattgctttttatgtcactattgatgcaagttcttgggctgtatttttcctcatatgcttataatgtcattctttatgtttcagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcagtgagtgtccacgttggtgatacaaggggtgaaagtttgactggttcagcattagaagaaaacaattttggaggggctaatgtttagacttaataatcttgtaatcttggtagtttttttgagacagagtcttgctctgtcgcccaggctggagtgcagtggcgtgatctcggctcactgcacgtaacgtgcgcttcccaggttcaagcaattctcctgcctcagctttccaagtaactgggattacaggtgctcaccaacacacttggctaatttttgtattattagtagagatagagtttcgccacgttggccaggctggtcttgaactcctgacttcagg

SEQ ID NO: 37023 - DNA, 1047 bp, Homo sapiens
agattcacaattaacatgctattctcttggacagttagttgaagtgttaagtttaattgatgataaaaatgaaagctattatttatagtcacttctacatcagtttctgaggttcttcatactttcagtttagaacaataatagaaaatcttttgtaaataagttaaaggaaataaacagtgataaaacctaaattggttctgtttccttccctggtgggaaactttgtttggactaagtttgcagagagacctaatcattgaacttaactttttttaatttttctaaattgtagggcatgacctagatgttacccccaacttttttgggagacagggtctgaccaggcctggagtgcagtggtgcgatctcagctcactgcagcctctacctcttaggctcaagcagtccttccacctcagccccacaagtagctaggactgcaggcatgcaccatcacatccagctaatttttgtagtgaccaggttttgccatgttcccccggctggtctcaaacttctaggctcaaactcctgggctcaagtgatcctcccacctctgcctcccacagtgctgggatcatagggcataagccatcacacccaactggaagttagcagtttttaaggaacaaatactactcatttcagtcacttgccaagaaactagggctacaaacatcaattaggcttagtccttaccatttcaggtacttgctattcactttgaggggggatgaggagggtgttgggtgttccaagatggaaaagagaaaaattcagaaacgtatttcactaatagggtaaaaaagccaagtagtttatgtagttcttcaaaattctcatctgttgtatgtcagttaggagtttgactattagcagaaaagaactttatctgaagttttcgtcttatcaggtatatatatttatacaaaaataaaattttttttaactttttgatacttttctaggtggtaataagctgcagtcaacaggaaataaagcagaagacataaaaggaaccgaatgtgttaaaagtactcctgt

SEQ ID NO: 37024 - DNA, 1035 bp, Homo sapiens
attgaactaaaccatttatttcactaactgggaattgtcatgtgatcatttttaatgtagccaagtctgttcatctttctctacctcagtttcctcacctaatagtagatggaatatgtatgcatatttgcttcacagagattatcttgaaagtaatgagttttgtatatgtgtgtatatacaaaaacatatagcagaaaaaatacaacaaagaaaagcatggtttagattttcattttataatgttccaggcagacttttcaaaatctatttgagtttcctgacaaataagtgtgcttttgttttataggtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggcaagtactgatattctctgtccctgctgactctgtcaaagtgttgtttcttctccattgcagcactaacccttctccctgtgttcttggacctgcctcctcccttctctctgggaccttgtttcttcacatatctgcctagtgtgtgtgtatttttaatttttattccatcgtctactggtttcttcccttcagccatacagatatatctgtgtcttcctctagtcatttaaaaaaaaaagatctgcacacacaaagacccttttcccatttctctaatcttaaggtaacctgattggttttttttgtttttttttttttcatttttgagacagagccccactctgtcaccgaggctggagtgcagtagcacgatcttggctcactgcagcctcaatttccagggctcaagcgatccgcccacctcagtctc

SEQ ID NO: 37025 - DNA, 1111 bp, Homo sapiens
tggaaatacatagaaagcatttggcagaagatagtatatttatttgtatattctattcatattggtaataagagttttatgccttttgctaaggagaaattgctggcataaaatttatagttaatgatgtttgtacctattctttccagctttttaaggatactggtacagtaactatagtggcttactcttctaattttctgatgtctctttcctacttcagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtaagactgataaactgtgtttaaatgagtaaacaaattaggaagagacttagtagaaactatcttgattgtctttgaaattaccttactcccaataataggaattaaattaattgatagacataaatataggtacataatgtgactgttctgtaaattgtatgcttttttgggggcgtggggaggagaagatcttagaagaatataatatgttcttgggggttttaaggctcattatgagtcttgggcttagcattgcaattaaaggaagtaacaccgagttttctacaggattgtttactttcctgcttttccaaatgaaattgaaaactcaaggttaatactcagggaataccacagacaaattatttctgtttattttggctctcgaagagctatttattatcagaaatagttcatcatggaaatgttgggtagccctttctaaacatccataagatggtggttatgtaacacaccttttttggaagaacagagtacctttattttccttaaataattatatatttctcccagagaggtacaatggctaaaacctttttgtgtccactgctgttgccaatttctagctgaggaagtttgcattttcacagtgattaagatcacacattgccttttttgtagagactcagcttttgtattcctccc

SEQ ID NO: 37026 - DNA, 1008 bp, Homo sapiens
ccaacctcagccttctgttgctgaaacttactatcagacaggtgggttttcttaacctacagagtttctttgtaaactattgaagtatatgacttactgcgtttaatgaagataagcttttgagtccatctaaactcatatcacatcatcttaggaggcaggttctagacctgtcctactaaatgccttggagtcacaattcataatcatgcctttctctcctggaaatgtactccatttctggactttcagcccacagtccattcctgctgaaataagctgtgcaaaagaacctgtgatgataacttctgaacacatttttatctttgccagaaatgcccagaacatatgatactgccaacaaacagcctttgtaaccagtggagaccctttaatgggcccatatttttaattaatctttctctgatcgctaatgacagttggttctgttatcagccaccaatcatgttaaatacagtatgtagaatggttcaaatctaggaagcatttcgtttgcaaagaaacctgtatatttacagactttaaaagatggatttttttttttttagagagagacttgataatttttaaaacaaagcttttgaaaagtgggcagttcttggggtggggggagggaaagcactaggagatacacctaatgtaaatgacaagttaatgggtgcagcacactaacatgacacatgtatacatatgtaacaaacctgcatgttgtgcacatgtaccctagaacttaaagtataataaaaaaaaaaagaaaaaaaatgggcacttcctttaattatttttgaagggtgtgagggtgtgggtagagcgttggattgtaagagagtagaattggcttccagtactggctttattgctaatgtgggcaagtgattttttacctctcttatctctgttctcttacctgtaaatgaggtagttgacccaaatttcagtagggccccttctagttgtaagattttatgagtcccttaaaagtggttt

SEQ ID NO: 37027 - DNA, 1021 bp, Homo sapiens
ggaacagaacttctcaaccctcagcactattgacatactttaaataattctttgttatgcacggctgtcctgtgcattgtaggatttgtaacagcatccctggcctctatccactggatgccagtagctcacatatcaccacctcctctgcagtttggtcatcaaaaatatatgcagatatggccatatgtcccctgggggaaaaattcccccagttgaataccaactgtcctaaagcaacagaagtattttttaatcagctggtcagtagtttctaccttaaatttctttctgtaattgggctagaatagaatatttttcttatggtttctttgtagagatttgtaaaactgtacaacataataaagaacttcacatgtaactaacactaaagttcctaatttggtcagttttttcttttcttcctaatactgttttttatcctagtttttaattcctgttatgtgatacaatctatgatctgaaacgtgtgactatataatgtattgagattaaagaatgaaaatttaaaaaaaaaagaatgaaaattacagaacagtaataaatatgatattgaataggaagtttattgagttcaagtacttgaccttttgtggtccgtcattaaattacttgaaaatgtgctttttatttcagttgaatagcttttaattgaagttggttaactcctggatattaaaattgtattatatttattcttgtactccacaatgtagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccagg

SEQ ID NO: 37028 - DNA, 1030 bp, Homo sapiens
gacaggttttactctgtcatccaggctggagtgcagtggcacaatcatggttcaccgtagcctcaacctcctctgctcaagcgatcctcccacctcagcctcctgactagctgggactacaggcacacactaccatgtgtggctaatttttaaaaaattttctgtagagatgtggtctttctacgttgcccaggctggtctcaaactcctgacttcaagcagtcctgctgccttggcctcccaaagtgctgggattactggtgtgagccaccatgcccagccttcctcatgcttttggtagaagatatggttccagtccagatgatggttagagacctggctatacagagcagagttagacaatgccagggatgtgtaaatagcaattgctaaatctgctggcatctttttcatatttcatcttttcctgggactggtgactgtataatttattgttcaaactgagacatgtaggagagtgaaaagtactaaaagtaataattacaccggcagtaggcattaaccagaacatatggtcattccttcttgagtctcatggacatttagggtgacgatcagaggcagtataagttaaattggcttcctggttgactcaacattcccatcctattcccacctgctttttgtctaataggacatgttttggggacaaatactagataaggagcagtgggatgaatagaaacagtcttttatataaccaaaattactcttaggtggtttagtctggatgtatttaatcttatcctgttagtaaatgttaaatacaagtttcacagacctgttgtatttgtattttaaatagtatcttttttttcagttccaggaattttggaaaagtatgacctgttactggcattttcttacagatatggagttgttcctagaaaatgttattcccaaacaagtttttcactgttttaatgtaaacttttcctgtcatattggcatatatgtagaaaatgttagttttatatcaaaatatggaaacctcatccagatagaaatt

SEQ ID NO: 37029 - DNA, 1065 bp, Homo sapiens
atcaaagctagacagtatatgagtactctgtagtttttaaaaattcttgaaactcttgtgtttcactccttctctttccctacttcactccccaaacttaatgtatactcttatttatgataacgtttacattatattctgtaatcatagtttatcttctctaatttagattgattctaaaactttaaagcaaaaactgttttatcttatcaatagtatttattgtggagcctagtaccattctatgattatgatttctaatgtgttccattttacaatcctgtaccgcttattagaaaatcttcctaggctcaagttcaaatggattttttcctcttttataccatactgattgctcacctataaagtcttttattgggatcatgcctttcttgagcagtttacatttcctgaattcattcattaccttttttctttttcttttttttttttttttgagacggagtctcgctctttcacccaggtgagactgcagtggcgcgcgatctcggctcactgcaagctccgccttctgggctcacgccattctcctgactcaacctcccgagtagccgggactacaggtgcccgccactgcgcccagctaatgttttgtatttttaatagagacgggctttcaccgtggtctctatctcctgacctcgtgatccacccacctcggcctcccaaagtgctgggattacaggcgtgagccaccacgcccagcctacctttttttcttaatcatgttgtcatttcttaaaatttgtctaggctccctgtctactggctctgtgccgagtcctctgtttttctggatatctttctctgagaggcttctgtccttcccctaattccaatctatactcacttctctctgggcctgctgccaccacagctgctgacctaggctttcatctgtttgcaggatcccatgttttcttggtttactttttgttttagctggaatatatcttcatgtagcttcctaagaaaaggttgtagtaggtaaactccttccatccttgagtggttaaaaaatctttattctgcctccatagtttg

SEQ ID NO: 37030 - DNA, 1184 bp, Homo sapiens
ctgggctgaagtgatccacctgccttggcctcccaaagtgctgtgattacaggtgtgagccaccagcacctggcctaatttggatgccttttatttttcctgccatattgctttggctggaacttaagtactgtgttgaatagaagcagtaaaagcatgcagctttgtcttcttcctgatcttagaggaaaagctttcagtgtgtcatcgagtgtgaggttagctatgggcttttcatagtttttattatattgaggttatttccttcaattcctagttggttgaggtttttttttttctttttttaatcataaaaggatgttgactcttgtcaaatgctattgagatgatcgcttgggttttgtcttccattttattaatgtgtattacattgatttatatgttgaacttgtcaccgtattttaaactgttaaagaaaacacaaatgttgtagagagtagatgtgatggttaagagcacatacacactggggccacactgcttaggttctggcttttactctgccacttactagtgatttcatatcttgggtttagattaaacaattttctgctaggtttctattaattataaaccttattttactgtaattagtagtttttattaatgaattaagcaatttcattttcctgttgcgtgacagaaactttttgcataaagggataataaatagagaccaaggaaataaatggtgaataaccattacagactcaagttaatggtctgcatcatgaaatgaagattctcaaacttttgggtttcaggattcctgtagcacttctaattattcagaaccccagagtttttgtttatttgggttatattggtatttactatattagaattaggctgggcacggtggctcatgcctgtaatcccagcactttgggaggccaaggcgggtggatcacctgaggtcaggagtttgagaccagcctggccaacatggtgaaaccgtgtctctactaaaaatacaaaaattagccagaaggtggcagctgcctgtaatcccagctactcgggtggctgaggcagggaaaactgcttgacctaggaggcggaggttgcagtgagccgagattgtgccactgcactccagcctgggcaacagagtgagactccgactcaaaaagaaagagtaaaagtattacacattaaccaaa

SEQ ID NO: 37031 - DNA, 1043 bp, Homo sapiens
cactgttgagcattaaacttggactaaagggaaggtcagattgtgtttcatgtgccatgaaagagaaagaaatgttgtatctatcaattactttgctgttttacccaaaattgaaacatgcacacacacagtatgttttctaaggtacgaaaagcacatttaatgtgaataacagaagctgtctatgttttctttagatttttcccacttcattctttataactgcagaaatacaatattctgtttccacctggtagtggttcctctagaaatttaacatgaatatttcacttagtctaaagttagtcattagttttattcccctaaccaatagacttaaaatattttaaacttgatcagtcctcctgattttgtgttcttgttatatgatagctcagatttttttaaccccgtgaccaattactgttggacacaattacttgttttatatggtcaatgattatttaagtttaccttcatatttaccactctttttgctcaacattcattcattctgagatcatttttattctttctaaagtaaatctttgagaatttccattagcgtgggtctaaaaaaacaggttttcctcttgctttcgttttttgagacagggtctcactgtgttgcccaggctggagtgcagtggtgcaatttcagctcactgcaccttcaacctcccgggctcaagcagtcctcccacctcagccccctgagtagctaggattacaggcacgccaccatgcctggctaatttttgtattttttagtagagacagagtttcactgtgatgcccaggctggtctcaaactcctggactcaagagatctgcctgcaatagcctcccaaagtgctgggattacaggtgtgaggcaccacaatcagcctgagagttttttgggttttttttcttcatcttaaaatatctttgattctacctccttgagtagtcatcacttaatctctgtaggcagttttttccctctggctgctcataagagtttttctttatctttcatgtttacagtttcacttagatat

SEQ ID NO: 37032 - DNA, 1076 bp, Homo sapiens
aataaaaattcgggtttactataattttttaattactgtaattcttatttatagaagtttctaatcattctttttcattatcccttattttaatggaaattatttgttaaatgactaaaattaaaataatttaaaagatccagtggacgcagatgggaaatggtgatagctgtctttcctggtgagttaaagattacaagaaaattaacaattttcatacgacatttaaccacctcgctcccctgtggtctacaccattctagtgagttggtaggaattgtaggataagctgtcttattctagtgtttaagaagaaatcaagcggcagggcacagtggttcatgtctataatccctgcactttgggaggctgaagcgggaggatcacttgaagctgagtttgagaccagcctgggtagcatagcaagacctcatctctgtttaaaaaaaaaaaaaacaattagccaggcatggtggagtacacctgtggtcccagctacttagaagactgaggtaggaggatcacgtgagctggggatgttgagggtgcagtgagctgtgattgcaccactgcactccttcctgggtgacagagtgaaaaaaataaaaagaagaaatggaacctaaatttaaatttcttctaaaatctatggtaataaaattattattataataacattgcaaagataatgggagcatgacattacaacatcaagaataaggaatagccaggtgctgtggctcacacctgtaatcccaacactttgggaggctgaggggagaggattacttgacctcaggagtttgagaccagctatatataaagaactcttaaaactcaacaaaagtcaaataatccaatttaaaaattggcagaagacttaaatagaaactttaccaaaaatgacatacaaatggccaaaaagcgtatgaaaagacgctcaacatcactgactaccatagaaatgcaaatcaaaaccacaatgggccatcacctcacatttagtgagctattacctacattatagtaaacccaattttttattccgtattgccctgaaaggtatatggactgtg

SEQ ID NO: 37033 - DNA, 1122 bp, Homo sapiens
attcaggcttataaatgttgtaattgatgaagtatgttagtattatttggatggatctttagtctacttattaaaggttgcttgactattaattgtccatgacaccactctgtcagaatacaggattagagtgattgttctgagtatatcatttcttagtatttcatgaaagccatgtacagtacagcttttattcatacagagataaaatgaatgaaataaactttgggtttttttttgttttatttgaatattagtcttgtatacactttatattaaagtgcatttgtagggaataattcacttatttaatattttatgagcatctacaatatgcatagtccctgctttcagggagtttacacttctggggcatgagggtggagacagatgagtctacaaataactatgccattataattaagttttaatgaaatactaaaatgggaaattggaggattttgactatggagtttgaggtagacttcgtgttctttcattctgaaaatcaagggaaggtcattttagacaaaggaaaagtattgagccaagacaaatatctggattgcatgatataatagagactgggttggctctgaagtcagactacctaagctgaatctggctcctcctattacctgccatgtgaccttgggcaaacagtctgttgttagtttttttatctataaattgaagataatattttctttgcctcataggaaaactgcacatgtaagagaaaatgaaatgtcataaaccgagtgtacctgtgtaacttgcacttaaattaaaaacaaaaacagaacattatcagtatcccaggaggtttttacattctccattgtgttgtttcgaggattcactattatttgtaaggtggacctggcagtgactcacacctgtaaccctagcactttggtaggcctaggctggaggattttaatcccaggattttgagactagcgtgaacagcaaagtgagactctgtattattaataaaatgaagaaaagaaaacattatttgtgaagtgttcagaacagtatctggcatatattatatctctatcaatgttagccattattcagtaggtggctggtgaatatggatgaaactagagaaag

SEQ ID NO: 37034 - DNA, 1033 bp, Homo sapiens
ccacagggcctactgtgggactttatgtatggatttttgtatacgtagcggtcctggaaccaatcccctgcttatatggagggatgactgtatttatgtgtgaatgatgtgattgaattgcttcacctatcattgaatacagataaagtaaacatcctacacctaaatgtaattccagaggccaggcgtggtggctcacgcctgtaatcccagcacattgggaggctaaggcgggtgtatcacctgaggtcaggggtatgagatcagcctgaccaacatggcgaaacccggtctctactactaaaaatacaaaagttagctgggcatggtggcgggcacctgtaatcccagctactctggaggctgaggcaggagaatcgcttgaaccggggaggtggaggttgcagtgagccaagatcgcgcgattacactctggctgggcaacagagacagactccgtctcaaaataaaatacaataaaagtaattccagctcttagttttcttgattacagttctgtaagatatttgattaaatttattttagatttagactttttagcttgttaatatttgagattcataatggcacactaaagatcagattctttaagatgtaaagacctgtaataatgaatttgtcaagtatggctactagtaacttgtagattagttaccacatttttcatttgtgttcatgcatattagacaattttgtggtaagcgtttctcagtcttgtgttctaagtcccataaactatggaattttttttttcctgttttgtattttttgtttttttttttgtttttgagacagagtctccttctgtcacccaggctggagtgcaatggcacgatcttggctcactgcaacctctgcctctcgggttcaagtgattctcctgcctcagcctcctgagtagctgggattacaggcgtgtgccaccacgcctggctagtttttgtatttttagtacagacgagtttcaccatgttggccaggctggtctcaaactcccgaactccggtcctcc

SEQ ID NO: 37035 - DNA, 1044 bp, Homo sapiens
catcatatagttgggttttcatgttcatcatctgtaaaatgagatgctgggcaaactatctttttgggctgaaacttgtggttttgagaaaccaagttactgttttccatggcatcctaagatgccatttgttgtaaaaggtaccattattgtatgtagcactaaaaaaaaatgctgccagttaagacactgcttaagactccattaagagatgtcaaaatgtataaatgtgcatcatattggtgaaactagattttactaattgttgaatgccatgtggcattttacaagtgttttttcatgaggcctgcattccagaaaaagcactgagatgacaaattattacagcaaaatcttgggggcatttcaagtattagcaaatcgtttgcttataatttttgataattagacaaaaaaagtttcagctactttgataaaactttttaggacttttaaaaaattcaacagctttttggggtacaagtggtttttggttacgtggactaattatatagtgaattctgagattttagtagggctaataattttcaaggagaggaaaaaaccatctttttctcagaagagatagctaatcagcatctgtgccataaatctgctggcaattactagtattccgtctagaaaagattgtgtttaaccattaaaattttacttgttttactcaggttttttctgttttcctcatatgggctgagtgataagatttgttgaattactaactttatttactgtaaagtggtgggttctttgtggcacttctgaaatgtttttcctaaatgcagacctacagatagaaatgaagaaaggaaatgctgatttaaagataattaataattttttgataaaatatttatgtgattgttttatcccagtatagggaactgtgacagaatttctgtttctaataattttttttttggccttgaaactgaaaagtttaaactgtaacaacaatccaggttactaaattgattaagtgtacatctgatgagaaaagactagtcttttgacattacttatatt

SEQ ID NO: 37036 - DNA, 1054 bp, Homo sapiens
ctcatcaaaaccttgcataattttcaatcaaagcagaggaccttttctgcgaaagtaatgagatttttctggagcaagtgtagaatcatgcatttcaggataaaactgatggatgccatttctaaattggagaagggaggtttctgaaattccagtgacaatgactagggtaggtgatgcatcttaaagtagattgataccaggaactgcagccatctaaagagagggtccagattttgacggggtgagtgtcacaggacaattgaccgtatttccccgaggctgagcagctgtccccagctgctgtgtgtttcagagctgaagacagatgtatgcagatttcccactgcatattggaaaatactagattttcatgggcataactgccagggcattgagtctgcccctggagttttgatttattattaaattccccatggacttagaaaacagatgtgggtcacccagcacctatcagggtataaatccatgtcagtgattaatctgtagccttaaacttcctgttatgaattgaaaatccttctacagccagggaatgtaaatttgattaggttgacaatttatatctccctcccatgcctgaacccataggcagaacacagtaataatactgtggtcaatttagaatcagccccgtgtatgtcagtcctcagatgttaattggatgtttcacacagaggtcaactttggctttgaatgcctcatctgtgctgattggctgttgtcattgtgtttgttgtgcagtatctatatacttttcatacggtgagaatccctccttttgtgtgacagtagtgggattcaatgtcctgctgtccagtgtagtacttaagtttggagttttccccttctttctaccatgtggtagctatggcatgggcatatagtttagaattagccaatcagataattggataactcctacccaggaatttggaataaatgacaaagaacaaatggtcagttaagaattagttatggtggtttacaggtgtccaggagggtgtaaggtctgactccaccaatagtgaca

SEQ ID NO: 37037 - DNA, 1043 bp, Homo sapiens
ccagagcagtggtggttgtggcagactcagcacatagtagggccagggatgctaaggcctgaggtgcatccaggatctttacaggtcatagctattgttatgggctgaactgtgtcccaaccctccaccccaatttatatgttgaagccctaacccccagcacctcagcatatgactatatttggagataaggtctttatggactgaatgtttgtatttcccccaaattcataagttgagctctaaacccccaagctgatggtgttagcaagaggtcctttgggaggtgattaggtcatgagggctttgccctcataaatgggattagtgcccctataaaggagacctcagagaactccccagcccctattgccatgtgaaggcacagagaagacagctgtctatagaccaggaagcaggccttcgtcagatactgaatctgatggtgccttgatcttggactgtccagcctccaaaactgtgagaaataaatacttgttgcttaagccatctagtatttggcagtttgttatagcagcctgaaggaactaagaggtaagttaattaagtgaaaatgaggctgttagggtgggccataatccaatccaactggtagccttaaaagaagaagacatttagagacacagagagacaccagatacgtgcacacatggacgaccatgtagggactcagcaagatgacggccatttgcaaaccaaggagacacacaccctgtacaccttgatcttgggctcccagcccccaaaactgtgagaaaataaacgtctgctgtctaagcttcccagtctgtcatactttgttacagcagccctagtaaatgaatacaattgttaagaggggaggaaacctgtttggcatcttcagctttgcatctgctctcctgcacgcagttcaaaccttcaccataactttttatgtggctgtaattctctgtttctcgtcttgacctcttcctcttgaccttgagtcccttgagtagggggactctgtgttggtcaacttctattttcaacctcaaaga

SEQ ID NO: 37038 - DNA, 1045 bp, Homo sapiens
agccattctgactggtgtgggatggcgtgttattgtggttttgatttgcatttttcttacgatgtgtaatgagcattttttcatgtttgttggctgcttgtatgtcttcttttgagaagtgtctgttcatgtcctttgtccatttttaaatggggttatctgtcttttgctggttgatttgcttaaattccttacagattctagatattagtccttcgttgggtgcagtctgtgaatattttttcccagtccataggttgtctgtttactctgttgatagtttcttttgctgtgcagaagttctttagtttaattaggacctacttgtcgtttttatttttgttgcaattgcttttggagacttagccaaaaattcttcgccaagaccaattcaagaagggtatatcataagtttttcacaatttggagtcttacacttaaatcctcaatgtgattaacatttaaatcagtagacttggaataaatgattttacacaccgcaatgtagatggcctcacctaatcagttgaaggccttaagagaaaagactaggcaactccctttgggtcccctcccattgtatgggagctctgtttttattctattaaatcttgcaactgcgcactcttctggtctgtgtttgttacagtttgagctgagcttttgcttgccatccaccactgctgtttgccgccgtcccagatctgccattgacttccacccctccagatccggcagtgtgtccgctgcactcctgatccagcgaggcacccattgctgctcctgatcaggctaaaggctcgtcattgttgctgaacagctaagtgtccagggtcatcctaattgagctgaacactggtcgctgggttccatggttctcttccatgacctatggcttctaatagagctataacactcactgcatggcccaaggttccattccttggaatctgtgaggccaagaaccccaggtcagagaacaaaaggccatcttgggagcagcccacccctatcttgggagtggcccgccacatcttgggagctc

SEQ ID NO: 37039 - DNA, 1033 bp, Homo sapiens
aattcattatttgtcttttcaaaaaaacagatcattttgatacagtaggtagcttgtcaggcatgagcagggtaagggagggctccctcccccaaccaggaatgtcaagtgaccatcaggtcatggtcaggtggttgttaaagtgtctctctaaaataataattggttgcagctggcaccagcaaaaggcagtctcccagcagaaagacaaaacctgaaacaggtgatcagcagcttcccgataagatcacaggagttggacaagtgtgctcaagcatgcatgttaaaaagcaaaatgatagagtttaactggtatatgaccttctaggaaaattcagctggtaagggaataacacctcaaaagagcatacatacaactttgtatgtatttcattctttttttatggctgcatagtattccatggtgtatatgtatcacattttctttattcagtccatcactgatgggcacctaggttgattccacgtctttgccattgtgaacagcacaacaatgaacatatgagtccacatgtctttttggtataatgatctgttttccatactcagtaatgggattcctaggtcaagtggtagctctgttttaagttctctgagaaatctccagactgctttccacagtgtgtgaactatttgcattcccaacgacggtgtataagtgttctttattctctgcagcctctccagcatctgttgttttttgacttttttttttgagatggagtttccctcttgttgcccaggctggggtgcaatggtttgatttcgggtaactgcaacctctgcctcctggtttcaagtgattctcctgcctcagtctccctagtagctgggattacaggcagatgccatgatgcccagctaatttttgtatttttagtggagatggggtttcaccttgttggtcaaagctggtttcaaactcttgacctgaggacatctgcctgcctcagcctacaaaagtgctgggattacagatgtgagccaccatgcatggcctgttttttgactt

SEQ ID NO: 37040 - DNA, 1108 bp, Homo sapiens
tcactcccccttgagataaacaattacctcttgaagcctcttcctatgtgggatctagactaatgctaagtagccataaaatgccgtacgcctatggttcagcaatgtatagacaatcactaatcaatattacttctgtaaaccagtgagaattcctgattagcaattttgtaatcaccccctctcctgattcattctttgttctttacaaacttgagcctctcctttgtactccagagccctgctcaaggcaacctggactccaggctgctgaaagtgtcccaggttgttgtccttaatcttggcccaaataaagtctctatattaattttgcctcagcttttgcctttaagttgacattttcacactgtttttcatatggtatgattttttaaatttagcaacaattaaataagcaattaaatgtagctatattttctcttttaacttataaagtcattccgtcatctcagaatagttaaaacgtctttagtgatatatatttcacattaactaagtaaatatgttgatgagcattaaagaacattaaagtatagttttataatttaacatgccgtttaaaaaatgatgatccatctgttatttttaaatgttaataacagtctaatttactttcatttcaaaacagtaatttcatacaaatacttaacaagtcacatgcatccaatcttaattttagagcattaaactttaaagtctctcggtgccatttaatttacaggtttctttctgccaccaatattcatatctggaaaacatggacaggatttcttaattttctggagtaaatattctgtctaacacagttccagttaacatgtacatttgccacatatagaaaagaactaacacatactgaattctgatttccgataacagaacatagcatgtatgctgtcttacagtaacaattaaatgtttttcacaatgcgtatttttacagtgggacaatgaagcaatacaaacaaaaccagcagacacgttatctttagtagaaaatgttatgcaaatttagtgagaatattacataaaccaagtaatagtgaaacacatactcctcagatttccctagttccttattggaact

SEQ ID NO: 37041 - DNA, 1022 bp, Homo sapiens
cattcatgctgtctcatggttaccaagctgctcctctgtcaccatgtgttatgcccgcattactgaaagaaaagggccaaaagaccaaacttcatggactgctgaataaccagttaactcaaatttaatgacttgaatttgattatttattgtgattgcctagttattattaaaaattaatggccacaacccctgctaagctcagcggaaaggatcttttgtatgcaaaacctactgctttagggatggtgatgtggttttttttgtctgtttgttttgagacagggtctcgatttgctgctcaggctagagtgcagtggcatgatcatacctcactgtagccttgaactcttggattcaagagatgcttccacctcagcttcccaagtagctaggcctacagtcatgtacataccaccaggcttggctaactttttttttttttttttggtagagatggagtatccttatgttgcctaggctggtctagaactcctgaggtcaagtgatcctccagcctcagccttccaatgtgatgggattataggtatgagccactgcaccctgccaggaaagttgttgaaaaagactagcatgttggtgtgtgttggcagctcctcagatctttcagtatgggatataaaggggttgtaattgattggttggaaataatcagtgtgcaaacaacaatggaaatggaagagaatacatcttggtaataaaatctctgtctgtccatggcctataatataaattgcataaatttctagtaatttgatatcttgcaatgttgtaaaaatcaactacttttatactccaaataatagggaaacaatgatcatctagagcccttgtcaagggtctcctattgagagtccttagacagtgtgacacatctctatggcaaagatcagatataatatgttacatttacacaagtaacagacttctggctctcctccaactcaggtatactcttctgccgagagactgtacttctcagcctcccttgtggctaggtg

SEQ ID NO: 37042 - DNA, 1057 bp, Homo sapiens
atgttgctagaaaggccgggcacagtggttcatgcctgtaatcccagaactttgggaggtgaaggcaggcagatcatttgaagtcaggagttcaaaccagcccggccaacatggtgaaacctcatctgtactaaaaatacaaaaaattagctgggcgtggtgtcaggcgcttgtaatcccagctactcaggaggctaaagcaggagaatcgcttcaacctgggagacggaggttgcagtgagccgagatagcatctctgcactccagcctaggtgacaaagcaagactccatctcaaataacaaaaataaaattttaaaaaatgttgctagatagaaggagggacagtgcataatgctaagagtcaatagatttgggaatatataaaatttaagcatttaacaacagaatccaaagatactttagataaatattgacagaattgaaggaaagaatagacaattcaacagtagtagttggagattttaatacctctttcaatgagaatagaacaaggagacagatcaataaagaaaaagattttaacacacaactaactgtaacacacatctatctataggacactctatttagcaaaagcagaaagcatacttttttaaagtgcacgtggaacatttttaaaagcctcaataaaattttttaaaattgcaataatacaaattatattcttcaacctcaatgaaattttaaaaatcttcaaaaggaaatttgagaaatttacaaatatgcagctatcaaacaacagattcttaaataagcagtgggtcgaagaaattacaagaaaggtttgaaaatgctttgagatgaatataatgtacatataaaatggtaaaaagtatacaaaaaactaaagcagttttcagagtgaaacacatagctatgaacatttacagtaaaaaagaacagtatccaaaataagtaacctaaaaattactttaagtttgttccaagagaaaatttatagaaataaattaaaaacatgatcaaagatttactgcagagagtttagaattcagagaatatgagagtttgaaatg

SEQ ID NO: 37043 - DNA, 1051 bp, Homo sapiens
tggggaggcctcacaatgatggtggaaggtgaaaggcatgtctcacatggcgttagacaaaagaagagaacttgttcacggaaacacctctttataaaaccatcagatcttatgagacttattcactatcatgagaacagcatgggaaagacccacccctatgattcaattacctcctaacagttccctcccacaacacgtgggaactgtgggagctatagttcaagatgagatttgagtggagacacaaccaaatcataccaggtattaagtaagtaaatatggcatattgttcttttcccattaaatgcatttactgtcaaatttccatttgcctttttttcaaatcctcttttcaaacatacagtttgctttcccactctgaaaaaaaaaatgtgatttatgaaaatttcacaagactatagatggctatacttaaagtaagaatataaaaaactgaaactgatatgatctaaaacaaaaacgtcagttcaggaaatacaaatcaagagtagaaatatttgagttcctgaatatcatagttctgaaacatgcatgaatgccaaagtgaatttctaggtctgattagaaatctactgaatttctaaatctggaccattagaccaaatgttatttattgtaaaagcattaggtgacttaaacaggactttcacttgaggtagtattaaaattaggaacaatccattcctcaagtttaatcaaataccgatgtttctgtttagaaaaatgtgtgggagaaagtcaaaagtactgcagtaagcaaaataagaggcccccaaagatatccagctcttaatctctggagtctgtgaatatgttattatgttacatcgcttaagggagttaagggttcagatggaatttggcgtttaaaaatgaagattatactggattatctgggtaggcataatgtatcacaaggatccctaaaatatggaagagggagttaggggagttagtatcacagtgatgcgcaatgtgagaaagactcaactgtccgtagctggttttcaggataaaatgggatcat

SEQ ID NO: 37044 - DNA, 1027 bp, Homo sapiens
cttttttaaactaacttttctgctggaaaattctatctgtcaatagagttcttaaaaggatttgtattaagccttccacagatactctgatattaaaatcaggtctgagtaaacaggtacattctgtgtagttaaaattaaatactgctataaatatgcccagtggggtaatccaatttactagtcacttcagagctgatatgaaggtcaaaaggtacttggcaacatcgtttggaatcgggattacttgtaggttatttatccttaagaagtattgtaatgtctgtgtataaagtgcattattccttagaaactgcctcggtcaaataacacaggcttaagattctcattttctgtccctttatgctgtgtacatgcagagtcaatccattgttattacacagccaattataggaccaaaacataatttgcatttcttttctcctttttagtcataatcttgatgattatagccaagctctattttgtaattttaaagaaatcccctgaatgtacttccacaagccattttaattattctcatgatatctgcggtaggtaggtgaaaatagtcactaacagccataaatgataactaagaagtatgtgaccatagcaatgtgttaggagacacatatttacgggatttttatttaaattgattagcattgcttcatgcatacaccagtggttctcaactgtccatcagactaagctggcaagattgttaatagtttagatactcaggttcatgcccagagatggttctcattttctatctgtctctatctctacctgatgcccagagattgttcatgcccagagatagttcactttctttaagtgtatctctagctctctctctctttatcatgtcctacttccagatgatacaaatttgcagctaaggctgagaaacgctgatctagatgagaatgtaccaagcagaaagattaagtgaattattaatgcccacaaagtcatttcaaatgtgtatttatttattcaattgatttgactgaaaact

SEQ ID NO: 37045 - DNA, 1237 bp, Homo sapiens
tctactaagaaaacaaaaattagccgggcatggtggcatgcacctgtaatcccagctactcgggaggctgaggcaggagaattgcttgaacccgggagggggaggttgcagtgagctgagatcacaccactgtactccagcctgtgcgacagagggagactctgtctcaaaaaaaaaaaaaaaaaagaaaagcagcctttgcccagatttagtatgctcttagattgattagttcccatactttgttttatctgaacaatatatgagtagatggagaggatattggtggtaaggtccattcacaatctggatcctgaaaggtaataatacattgaaatgtagatttttgaatagctgaggcttttgagctgtgtattatttttgtattgctgaagtattgaattaccacaaacttggcagcttacaacgagaaaagttcatcgtcttacagatctataagttaggagtccaatatgggtctcactgaactaaaatcccaatgttgaaagggctgcagtgttcctctttagaggctagaagaaatattttatttccttgacttttacagcttctagaggctatcgacattccttaacccttggtccccatcctgcatcaaagccaacaaagttttatctctctgatcattcttctatagtcacatctctctttctgaccacagccaggaatgattctctgcttttaagaacccatggactatatgccaaacagaataacgaggataatttcatctcaaggtacttaatcacatctacaaaatctcattcaacatggcaggtagcatattcacatattttggggacaacaatgcaaacatctttgggggccatcattcagcttactacaatgtgtgatttcagtaatagagctacagattcatagtagggtctttctcaataatgattttgttcatactgcatcttctaaaagaggagagtcataaaacttgattatttaatcatgattaggaaagtttggtatataacacagtagccatattttatacagttgtggctactgtgaaataggaagctcagcagcagccattgggagtgtgcatgtcttggccgtgagtaatctgagtaaattctacaagtatgtttcagtaattgaaaacagaagacattcatatgaaatttgccgaaagtcctattcccagcgattaagtaattatctgttataaatcaaaattactccaatagtcataaaaattata

SEQ ID NO: 37046 - DNA, 1043 bp, Homo sapiens
ttttgtaatataggcagatgttaagatcacgtcagcactgctgtgcaaaggtttatggtagatattattttatatctttgttccactgtctgtcctaaaataaaaatcaattggttttttgtttgttttcttgtttttaacatatcaacacaaaccaaagtattctgtatgctccattgataccatctcattgttgtttggataggcaagataaacatgtcttaagtttttaaaggttacagaagggttgaaaatgatggaatccaatcactgattcaaaatgtgtgtttactaggtagtatttaagaatgaatgcatataataattattgttatttttaatttgaaaatataatagggaccttttatcaatgtggtgagagtctttctatgtccagtctggttttttgcccttctagagcactcctttttacccatagcctttggatgataatcaacaacatatatgttgcttctcattttaagcacttttcaatacttgcagaaactttagtatatcatggacatatatgaaattgtgaggactttgttattgagatttttaattaaaataatcaatcataataaaatacattttatagtaaaatattaaaatacaaatataataataaggcaaaactatagtagcatctttctctagattgcagtttaaagaaacattgacttcctaatgttggaatcaatctttttaaaaagtttatattttaggtttgcgggtacatgcgaaggtttgttatatagataaacacatgtcatgggggggttgttgtacataacatcacccagaaattaagctcagaatctttttctttcatttttagctatattatttcccttatgttggaccataaatctaaaattgtaattaaatgtccatcctccaaaaatggatatgcaagcgtgtacatgtctttaaaggtaagacacagaagctgccaatgtaatttgtacagaagttatattttttatccgtgtgtgcacatacaaggtggaatgcccattgtatgaggaacattctgtaca

SEQ ID NO: 37047 - DNA, 1088 bp, Homo sapiens
cttaatatctggcttcagatcttagacaggatcagagggccagctcaaatttgcaaggaggggaggtagatcccaccattttatgggtgaatggcaaaatcaaacagaaattatgtgggatgggagatactgatgcaggcatctttggaaacattctacttagctaattttatgctaggctttaggtcaagaaggagagagagagctgacatgctgtggtacacacttatagtcccagcgacttggaaagctgaggcaggaggattgcttgatcccaggagtttgaggtagtgtgcgatgatcgttcttgtgaatagccactagccactgaactccagcttgggcaacattgagacaccctgtctcttaattttaaaaaaaaaaaaaaaaaaaaaaaggaggaaagaaagtggtctcagtttttaatgtaaatatttttaatgggataatgatattttaagattaatgtatattgtatatcagttaactataggtcaataattatataaaacttaaggtacgaaaaacatttatttttgctaacatatctgtgagttgactgttcctggcttggtgaggctgcgagctgcagatagagtctaggtatgttttctgtgtgtttgttcccccttggatcagtggactacctgagaatgtgtttttgtcacagtgatagaatcacaaggaaactccagttctggaagtacattttaagccattgcttctatcatgtccactaacattcagtcagccaaagcacataccttgtccatggctaacattgatagtatagataaatatacctgatctctagcaggaggaactgcattgtcttggggaaaggttttagatatagggaggggtgatgagttgggaacaataatgtagtctgccacaaacatattaaagtgtaactggatatggttgctgcagaattttgaacctttgttttaattgtgatttttactctttttcccctatctagtgcccttttgtaatacagtaattctcatgatttttgtctgaattgaaatcttctgagattagattgtctacgaaaatacagtctatcctccttgttttcagct

SEQ ID NO: 37048 - DNA, 1106 bp, Homo sapiens
ttgggtcgtaggagcagttgtcatgttactatacagctactgaatgaagaagagttcttagtgaggcctgggtgaacagctcttcttagtattctgtgtgaccccattcgaccttttaacaaatccctaagtaaataaatagcccctaaggtaaactaagtttttctctgctgtttttttgcttgagagagctataactgtaatagacttatatttctgaacattttagtgcttgccaatatttggtaatatttatgtttcctatatttgtaatgaacattcttcttcaggtacattttttgttaaattattgtttcatgcataaaagttcaccttttattgtataaaattgactcagattaatttatacacattgacaatgggtaaatagagtttttcagattattaaaagctgaaggatgcccatgtaagcaaaaaaaaaagagaaaaaaccaacaaaaataaacccaaacccctcaaacaatttcgaacacaaaacattcttctcacgccggcatccctgcttgcaggtgtgaagggggcaggaatcagcgaggtgtcctgggctgagtccccggagtgggaagaggtggccggaaggggatctgaggaggagaacaggggtcctggtggtctgtgcttcttcccagacacgggagctgtagaggagacctctgcagcagatgctaggggggccactaggcccaggcagtcttgggacttgggtctgtcctgctgtgcatccatagtgggtgctttagaaacgggaggcccacccgaagcccctgttgcaagtgaggacaaagtgtgggaaggccgtgagggtctgcagtccgagatggccttgtcctcaacgtgcagtgcactgttgatgcggggcctagaggcctgggatctgggggagccacccctgggggcgagtgtctgccctggtgctgtatctgccttttcacagcgggtgtcacgcgaagagacagcctgaggtccgtcctcactcactgtgtttgaggaactgagggccagctggcagtgggatgaggctggccccctcctccgctttagttcctggaggccttccgtagagctgtgggagctggagctggcat

SEQ ID NO: 37049 - DNA, 1049 bp, Homo sapiens
ttgagacctcatcaactgggactttactgtccatatcataattaacattttggttacaaccatttaactttccctcatcttcctatcttcttctgagttctcaaaactctttcaacccgttccaaagttgcttccacattgtcaaataccattattgcaatgccccaatccttgataagattttctgtattaggacattcctgcattgctataaagaaatatccaagattgggcaatttaaaaagaaaaaaagttttaactggttgacagttccgcagactttacagaaaacgtagtgctggcatctgctcctcctctagagaggcctcgggaagcttataatcatggcaaaaggtgaagagggtgcaggcatgccatatggtgaaaacagggacaagtgagagagagaatgggagggggtgccacacactgttaaacgaccagatttcacaagaacactctattgcaaagacagcactgaggcattagagatccaccctgatgtggtttggctctgtgtcgccactcaaatctcatcttgtagctccagtaattctcatgtgctgtgggagggacccagtgagagataattgaatcgtgggagctggtctttcctgggctttctcatgatagtgagtaagtctcacaagatctgatagttttaaaaagaggagttctgctgcacaagctctctctttgcctgctgccattgatgtaacatgtgactttctactcatcttctgccgtgattttgagaccaccccagccgtatggaatgatagcccattaaaccttttttcctgtataaattacccagtctcaggtatgtctttattagcagtgtgaaaacaaactaatacaggaaattggtaccagtagaatggagcattgctgaaaagatacccaaaaatgtggaagcaactttggaattggataacaggcagaggtttgaacagttcagagggctcagaagaagacaggaaaatgtgggaaagtttggaactccctagagttccaattttggaacaattgagaaactgctgttgaag

SEQ ID NO: 37050 - DNA, 1052 bp, Homo sapiens
ttttggaaatgcaggaagttcccaccttgactatcccaaagattctgatttgatggaagcatttcattgtaatcagacccaagtcaacaggtcagttcttaatatagaggttgtcattggtgataaagaggaggttaaataccagatttctgttaaataaaaacactttcaatctgttaattaaaatgcacagcattttataaaaatgaatagtagagtgctggacttactaggggatgtagggttctaacagtgaatgaattttaaaacagaaaatattagcaaattggataagtacttgattttattcttagatttgctactttttatcctttacttgggagttctgagcagtgttcactgtgttgatataacagcgttttattttttcttctacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcggg

SEQ ID NO: 37051 - DNA, 1019 bp, Homo sapiens
ttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcagaaagctatgttcacatttatcatttaacatattgatttaaatgttgattatgatattcaaggataaatcctaggcattaatgaaaaatagtttttttttaagtagtcaaagagtccaacaaaatccttcagtatttaaaggtacctgcttatactttttgagaaaaaaactggttattcaaaggtaaaaagtgaatccatttactgttattactgatacttaaatcgtggtttatagaaaacaaaactatattagaatggaaatgtgtaataacttgttggttaaacattcttactaaatagactgtttttaacctttgtgtttaagataaatttatgtattatattttaaagcactagtgttttattgaaaagtgaacatgtttgattgcagcatgcttgcagagagttttcttatgtccctagaa

SEQ ID NO: 37052 - DNA, 1040 bp, Homo sapiens
aaaactgagcactctcacccactcagctacaagttttgcactgagcaccaagccatagtagtcaattgttggaggaggaatagaaacatggagaagactccctctgtggcatatccatatccatgcagggactactgaaatctgagagtggaaaaagaatactgagagaaaccatctgacacttgaggccctactaagtacaaggtcataggatttcattactagagaaatgtgaagtctttggggacttaaggaaactaaagcaacaaccaaatccaaactcagatcaactataggttgagtgattcaagccatcagcaatgatgatctaatagaagaggtgtgcccattctgggcataaaactatgatttctctccatcttttccttcttttacacataatgtctagcttttaacccaaaattatgagatatacaagaaagtaagataatatgagccattttcaaaacataaaatagtgaacataaccagacccagaggtggctcaaatgttgaaattatcagacagtgcagtgactttgaaataaccaattgatatgttaaatgatctgatggaaaggttggacaatgtgcatgaacagataggggggaatttcaccagagagatggaaactatacaaaagagctaaatagaaatgttaaaaatattttaattacagactatgtatgatattgtagatttctcatgacagctctgatagaaggatgcacaccagatgcagaaggaattcagcttggggattgaaaaagagggcttatcttaggaaagagtttttataatgaagaaatatttctgtaataaggacatgtttagctgagtatttaagaaggaatagtacctagccaggtgaagggtattttaattagaagggagactaagtgcaggacgttgtggcatgagagaacctttgggaaaatgcatgtttttctctaactaaagcctaagcatggggaggctaataagagaggaggccacagagtagttggggaacagatattgtcattctccaatgtttgga

SEQ ID NO: 37053 - DNA, 1077 bp, Homo sapiens
agcactttgggagctgaggcaggtggatcacttgagctcaggagttcgagaccagcccaggcaacatggcaaaaccttgtctattttttaaaacataagatttgactttgttgtggtataagttgtttcatagaatatgaaatttgaaaatttgagtagtatttggtaatgttcagagttttaagccttttgagttgtaataagtatttgttaaatcagtttaccattacacgagttttacattgcctttgaagtcgtcagtaatagaaaaatagtgtatgtactaaactacacagtattttttattatttcaacaaatatttcttgatactactgtatgccaggtactaactacatcagacaactggaatatagtatggaataaaatagtcaagtctctgctctcatagagtctctggggtaaggggagaggtgtggagagacaataaatataaagaatgtgtattatatcagatgaataaatgcattgaaggaaaatatagcaggataagagggtagagattgatgaaagaagttcaattttagataattaagaaaaatgaaaatattgacagttgaaatggaaactgtttaccaatataaaaaatagtgaagaaaattgttcattaaatgtgatttttctatgtgatagttcatgtaggagtattttgtatataaatttaaatttaaccatttaaagtacttaaattgtcttttctattattctaaatagttttagttaaagatgtttgttgatttgaagtatttcattggttctcccttattttgttatttatttatttattttgagacagaattttgctcttgttgcccaggcttcagtgtaatggcacgatatcggcttactgcaacctctgccttccaggttcaagcgattctcctgcctcagcctactgagtagctgtgattacaggcacccgctaccacacctggctaatttttgtatttttagtagagatggtgtttcaccatgttggcccaggctggtcatgaactcctgacctcaggtgatccgcctgccttagcctcccgaagtgctaggattacaggtgtgag

SEQ ID NO: 37054 - DNA, 1055 bp, Homo sapiens
tcccagtgaagtagtgcttctgctagaggcaatggggcttctgtctggggaggggtgtaattttgatagattttgatagttcaagttttcagcctttcagagcataaggaatgacagccactacaatgcttttaaagcattcctcgcctcccacatgcacccagtagttgagtcctgtgttgatgttgcatttcgataagtatgggttagattaaaatctcagccttctctatgttgcttgttaaagtcttctattatttcctgtgctctagtataaaagtctttctcacaagctatatcctatccctgacaccttcgttgctcagtctcttctctaccaagccccatgcagcttgcttgcatctaacatgttctcccctcttccattactgatgattcttttgctatgattgcaattcccattcatcttttgtcctttttgcttcaaaaaatgtaggaagagaagagaagccgaggagccagaggggctggggaaaagctgtatatttctatacattaataatttttgtttttatcatactactatctctgagcacattttttgttccaagctaattagatgatcttgtttaaattctcacaaatactctggaagtaggtgattttattttcataagtagaatccaaaaagtttcataagttaactgactttcccaaagctatgtggctaataaatggtgaagtcgtgatttaaattttaaacctatctgtaaaccatagacctctgaagaatcattggaaagaaaatattaggatagtctatttttctctcttttaattcttgatagagaggggctttttttcttgtatggaattctttaattagtctttgctttcaatatgaaatgtggaaatgtatgactcatggtaagctatttgttataaaagataaaccaccaatctcagtggcttaacacagtataagtctatttcttgttcttgtaaagtctgcagtgagtattcctgattggcaagtggcttcctgtaagtggttattgaaggagccagagttcttccatcacgtggctctacca

SEQ ID NO: 37055 - DNA, 1043 bp, Homo sapiens
ttgatagattttgggggagttagtgaaatttcttgaggggattttcaatcgaatgcttttattttctgtggcagtaatgatctggttggtttatctcataaataactgatgctgctgctttttgtgttctttgatgtctcaccttatgtttttactaagtaaggacagcaatggattggcttctgatgctgttgaaaatagtttaactactgcaggtattagaactcacttttaaagattttatgacatagaccattaggcagaaaggaaatggacatttattggatgcctgctgtgtgtcaggcactgcgtatattgtgtatgctatctcatttaatgctcatagcaagcctgtgagaaaggtggttgtatttattagtgacaaaattgagatttggagagttcaaataactagcacaaggtcatataattagctagcatcagaactgtaacataaacccggtgtttctgattctagatcctgtattgaggcttcactatgctctgaaaacttaagtgccttgcttggaaaatatgaagtgcagcaatattattcctgcctcatttataatgttcttagatttaagaacattttaaaggcccaattttgttttcttttctcctatttgttctaacctagaatgtcttattcttgggctgtagcagtggacaatttaagaagaagtatacccactctaaagggactgtgagttttattgctgccttaaaaaaataatttccctgaaacaaaaattctatgaactgactaatcttgataaatcttgcatgtgagaatgacactaaatttgctcattattttgggctgagcatctctcacctgactgtacttgtctttctctctgcctctgcttcttttctacccatgcccccttacctctaatctcttttgtttctacttgattctggcatagtagcagccacttctatggatttggctggcttgtctgtacataataggctcctaatgtgtgttttctaggaagacataacaaagctatgaaatagattaaatgtgaatatta

SEQ ID NO: 37056 - DNA, 1048 bp, Homo sapiens
caaatctgtcattgataaggaagctataggctttaggtgtttctgatataatttattcatggaataactggtaactagtttttattaactatttaatttggttaaattattataatgtctactctttaatttattctattttaacataatttgccttttcttcatttttctaaggtggttgtggaggcagagaatcaggttataccttgaagggactggcataaaccctgtacctgtggaccttcacgagcagcagctaagcttgaatcagcacaatagagcccttaacattgaaagagctcatgatgaaagtaggtggattgggcatcagatgtgtttggggaaatatttaactcatagctcctttgacctcaaattttttgatgtaataatttacttgtttttagtgtcattaatagcacttaacaaagtacagtgaattacttcagttgtaaagtttattagaatctgaagtaaataatagcatatttctagaaatgttttctaggacagatttgaaaactagctgattagggaaggattgtaaagtatctgataagatagttgatgtttgagaaaagattcttggccttaatctttgaaatgtcaaaaaaaaaagcagtagagatgaaatgagctaatctgtggaagattatgatggttatacatgttatatagttatacttaaatatatttattgggaaattttgcattccagccttaggatttgtgcttgaagtatttgtgtagcttagagaatattagcataaggtgatttggcagctttttttgttaggagggttaaagcaaattctccattttgagccatattttcccactttttatagcaaatgtaggactttattgatgcaagaatatcccaagagaaatcttaaatatttgtagactgtttaaaaagatacagttttctcctatgttttattttctggataaatttatcaggaaaagctacttttacatttttgctttctgcctctgctctctcatggtacctgatgtttatatccccttattccagagtttttca

SEQ ID NO: 37057 - DNA, 1050 bp, Homo sapiens
agttcaggtaggaatttcttacggttgttcttatgtaagtatcttaataagtatgtgccattaataatgctgttaaaaaacagaacaaatcaggcagggcacggtatctcacgcctgtaatcccagtactttgggaggccgatgcgggtggatcacttgagctcaggagtttgagaccagcctgggcaacatggtgaaaccttgtttctacaaaaaatacagaagttagctgggcatggtggcaagcacctgtagtcccagctacttgcggggctgagttgagaggatcacttgagcccaggaggtagaggttccagtgagccgagatcatgccactgcactccagcctgggtaacagagtgagactgtgtctcaaaacaaacaaacacacaaaaaaccagaacaaatcagataatgtttggattactccatagatataacagtagccattaaaagtaatgtattagctgagtcacaaataggtctaatttaccttctcctagtccagttggaattgtggagagaaaccctgacaaatattggttggcctataatataactgcatatagaaattttttttctccttcagtgagatagcaggcatgtctctactttcttaacctcgttacatgtccttatcagtttagtggaaaggtaattaaaactttggctaaaattgtttgaattttcagattttatattttttatctttatctcccatctagtaatgattgagagctggatttaatccaaccatgctgagattcctggtatctgtctcacataaaagtatttcttaagcagtggggatgggatttttaaaagtttcttttacttaatgtgttcagtggtcagaccatcaggaaaagaggaaggtggaggaaggagcatgaggttggccaattatatttgagagagctaagttggactactttttatttcctgacttggactagattttatagttggggaaagcttttcccacagatgtttgtgaagttgtattagatcttcttttcaagaatcatttcattaccagtaattctagtt

SEQ ID NO: 37058 - DNA, 1047 bp, Homo sapiens
cttaaatgtgacatacaggctgtacattatctggccctttaccagttctgtccttattgcctattatttttcccttcattctattctagccacactggcctctactttggatatatccagtggtattaaaattgtaacatgtaccaataaactctcctttcctctctcccatcattcttgatgaatgaaatcatctgtgctgaagctgtaactacctctccctcactctatcatcaaattggtcctaagttctagggaacttacttttgagtccatctcttgccatcctcgctgccactaaaaatagctcagccctttatagtttgtttaaattactgaactagcttacagtctctctccttctaactcatcctttacacattgccttagtcttctttctaaagtgcagatctaattgattatatccacttcttattaaatcttttagagtttcccatgaccttcaggatacattgtaaattccttagcataatacatattatctttcactgtctcttgcctgtttgcttttctagtttcacctgtcctcatatgtccacaggcatgacacattctttagcttaaaaaatatatttttggaaacttttctaggatcagcctgggatcctttctaaaaggctgttcttaactgcaaaatgtaactatatgagtgtccaccaacatgctggttagaggctcacacagggatgcttttactctggtggggagctttgttgatatgatgacccaaggcgtgatttgagagtaggtgaaagagttctccagaaggcctatgtccccctaacccacccacccatgcctttgtatgtgcttttgtcaaaagttcccttataccacttactcacttctgtgtttcttgtttgttcaagactggtgtttctcctgggttgtaattccctctacagaaagcacttatccctatatatttattttctgtttctttttctctttcattagactataaattccttgagtataggaccttgtattttaatttctctgtcactagcatagttttatacatag

SEQ ID NO: 37059 - DNA, 1026 bp, Homo sapiens
aggtagaaagggagtgggataggctatagcggttagcagggtggggtatgattgttaaaactactgattttcaaaatggccaaaaactagatttataacagaaatttggttatgtcttgtattttgtcttatgttccttaggtgatggcacaatgctgctggcagcgagtaaagtcttggacagacttaaaccagttataggggtaaacactgatccagaacggtaagaaagaacgtatacattttgtttgatttgtgtggtgtgctttttaagtttttttttaggttatacatacatgcatttctgctttgattgcatagtatctttttatggtctgtcttaaaatttggaagctattttttattttcttgaccatgttcacattcttgggctctgttgctacagacattttactaggtgtatggtgtctaagtggaagcatcattgttcctggccaccatgaacattagaaccatgttccagaagcattctagtaatcaaatttaggtatgtagaactgagtaggattgtcttttatgtagttgttttcaaggatatagctctagttttaagctcaggcatgaaaaatatatatacatctagctggcattggtggtaggaaattatgttataggatggaccagttctcacattttagcttcccaggtagtttgggagtaggatctgtggcataatagacctgagttcttgacccaggtgagtgttggggacctttggtattgctgaggagggacaagttaataatgatccattttctacccttccttatggcttgtatttatattcctcattatgctaccactgatttttttgggggacagtgactttactgacttaataaaaagacctatcttaataaaaagaccaataaaaacactattggcactttttgtttccttccttagcttcgtgatatttaccctcattctgttctagccacccacagccatgactgtacctggactttatggtgatctggaattccctatctctacaatcctaat

SEQ ID NO: 37060 - DNA, 1061 bp, Homo sapiens
gggattacaggcgtgagccaccgcgcctggcccattaatacattttaactgctgtgcaatatttcattgtttggataattaggttagtcacagtttttccattattaaaaaaatattgtaattagaagtacaaataattttttccataagcatttagtgggttcctgaacagcacttagtagactttaacatttttgctaatatgaaggtgaaatggtatcttttaatttcaggatgtttgaattaaatattgaaaaatacagaagaatttttatgtgtgaaggagagaacagcaagacttgcgtgaagttcatcttgtagccaaccaaaagaactcaaaactgactgtgatccataatcagagatctcttacattgtgactcagtacataaatttgaaataaaagataacagggaagaatttagccttgtatgttttataaaaacatctttaaataaaagataacagggaagaattaaaaatatattttaaataaaagataacagggaagaatttagcctagtatgttttattttctagttaatgataatgctggctgtgatcgttaaattgtgaccagcttataatgcactttaagacaatttgaaaatcatagtatattgaggccaaacaggtagagtggaccttataaaggtggtaagtctcttgccaaggagttagctttatctcctagtggttttcagactctttatggtagaacacaacccttgctcagcctgtctttctccataggaattgggtgatgagggtcaatttttctgagatttcagcattttggacgttgtatgaaaactggcttttgttttcatacgacgcccaaaatgtggtggtgttaaggttagttaggggatgggaattagtcaaagacttttgaataaggaactagtttagaaaatctggaggcaagcttttgcattagaccagataagagttggtgttgtccagaactcaagcagtggcagcatgaacttaaagtacatagattgtcaaaacacttcacagatgtaattatttgacttcactactgactggctgtggac

SEQ ID NO: 37061 - DNA, 1037 bp, Homo sapiens
aaaccaaacaaaggctggtgagaaaatagctcatttcttgtcttattccagagtaaggagtggtgacagattaggaaaagcatcaaaaaagtggcttccagtgaacaaaatcaggaagtttgagtaaagaatttctcttttgctaaaaacttaaatataaaagtttagtcaggaatttgtacccacacatgtatactgcttttaacatttttctctagacatttgaaatattttattttctctttaaaaaagcagcaccaaaacctaaatttaatagtaatgtttctgatttatcagcttctttccatcttacactgttgaattctgtactgcttctaaagcacctacaattaactctacaagaactgcacaattaacactcggcattgccttcttcctaattctaacatcgacattcatcagctttctccaatacagtcagatgattccttataatcatatctagccaaatgatgtaacttttgcttgatgtatgggaaaatagcttacattatgaatttagaagagctatagtagtatttgacaatatagatggaaaagtatttttaatttaaagaacatattgcacatctttcagaatttctgtaaaaacttttgaatgtccattttggctaggagcttagaaatgatcatgcttaagtttaattttgtgtttacattaaatcttttggattttcattctgtatacaatattgctgtaaaacatcatagttgtgaaatctggctctttaggagatgcttaccataaaactggtttgaaaactattctgactacagtgtagctattacattcactaataagaatttagtatgcctctgaatataagtaagtctctaattccctatttttttggaatattactgtattctaagaatatcagaatatgagcttcttaaagattttgaattagcatatccaaattgacagataacattcttaggtggggcgtggtggctcatgcctataatttcagcacgttgggaggctgaggtgggcggatcacttgaggtcacga

SEQ ID NO: 37062 - DNA, 1092 bp, Homo sapiens
tatatatttaaataaatgtacttacacttgtgtataggatttaaaagggggaaacttaagaaggaagaaattgtgtatagaatttaaaaaggaggcattatattgcatgagtagaatgaaaagtatctaaccagaaagcaaataagttaaggattatattatactgaaatattttaatacaatttaaatatttcattactctttcactttatttgctatttgtagatttcagtattgtaatgttggcaagtctatttaagacggcattaataaaaattttgtttttcaggcatgtgataccaagtccctttccattatagataagtaaggcctaggttggttaaaaccttagctaaacacaaaatttgctagagaatcaacatataagaagctctaactccaagcttattcaccccagatatttcaccaatgttaacacataccctattgaactaagaaaggaattatattactaaccagcagagggagccaagtcaatcatgaaaggtaggagtataaaggaacatcatatgacttcctgttttgaatttaactgtatggcccctgctcactttttgagtttaccaaaaagacagtcataaggagagaaaggcgaccaatgtatcaaataaggatacagtgacaattataacttagaattaccttgcaggaaataaattggaagaaaaattgaatgcagaactatacaagtgaaatgtctcagtattataacccaagatggaaaaaccatggaaaacagtaccttaatgccatgatgaattgctagccaaatgtaacagtgaatatttcttaataattccattttcacttaaagttgaaattaggccataaatagacacattttaaaactataaagttgtacatcaaatttatgtgcatttaatctaagaaataagggataaaatttaataaaaaattattacagtgaattaataaggacatgatttttcagcttaaaattagagaacagaattgtttccactactgtttataaacacaacaaataaagtaatatctgttttgtgagagatgtttggaggaatctagtagctaagtgattatgtcagttta

SEQ ID NO: 37063 - DNA, 1027 bp, Homo sapiens
ttacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaa

SEQ ID NO: 37064 - DNA, 1033 bp, Homo sapiens
gttttttttccaagatataaacaatttttgttaaactataatacagtgggagtaaaaatgaactgagaatctgtttctgctgcacaacagcgaagggagctcccacaaaaatgtttgcccaacatttccttcttttgttcctgcatcccaggttccacttactcttcataaaactgatttttttttgccagaatgttggtatttcaagtttttctgccttttaaaaaaattcctgtaaatttggctgcatgtacaaattcattagctggaagtcccatccttggcggcatacagggatcgtaaagtctgaacaactttattagtcagcttattagcactcgttagagcaatttttttgtaaataatgtctgactctttaatagtgtctacccaaggcaccagtttgcggccatcacggcgcttagcctcagtccaggagccactgtaggagcctgccatccactgaacactgaagccactgctggttttctgcactactcttgcaatttgtggtcgatctttgtactttggacagcaaatagcgatgacatccatgacgtcaacactttcattcatctgtgctgccaactccgtagagtctgaatttcgttttgaccttctcaatgactaaaacattgggaggggggaaaaaagaccaagtgttacacaaaagaattttagtgaaattattgtttttattgcttttaatcccttgacgccgggagttgggatttcccggcacacttccattgccggcaatgagacgcaccgtgaccgccagcgccaaggggttaacatatacttgtaaaaccatataactcttaatttgtacccgtgtctttactcttattgatatataaaattatatatacatatgaaccatatagctacataaaacttagcaacaataaaaataacacacattaatacaattcaaagaaaaattaaccctttatgctggataaatctcatttctgtttttttattgtcttttatgttaaactttctacaaaaggatgtataaacgggtaag

SEQ ID NO: 37065 - DNA, 1042 bp, Homo sapiens
tacacgcacgccagctcctctactcactatgctgctcccactttcagaattccatcccccatctccccacttaacccagcattctgattctctctctctaatgtgtctacacaaaacctaagtatagatttctttaaataagcttccacaaaataagctaagtgattttgtttacatttcatttcacacttgtttcagaaacccatggctttgtctatggctatgactatgtcttctgacttcaaagttaatactctttttcactaacctaagttttagtcttctacatcaagccaggtgatgtagaaataattaaaacacaataaaatatcacattttcccttttctacctaataggatggtaggcatcacaaaatctgagaacacaaaacgtggatcttttgaaaaggtatagaaaaaaaaatcagtaaaatttagtcattaagtagcctacattcagatcttaacaggagactgaataagaacttcccaaggttaaatcttccttatgggagataagaacccagttttgcttttgactctagcaataagtaggtatgcagcttggtgatatcaattcacctctttgagccttaatttcaccttcttaaacctgtagtcattccatagattcccaagataggccaaagacggaaatgggatggggatgtccatgaaccccttgaaattttatgcacaattctgaatatgaacttattctattttctaaggagagagatttctcggctttcattatattctcaaaggggttagtaaattccaaagtgattaaaaacttcagattatttgccatctctcatatgactgtataaatatttttaaaactatggaattggagatccattattggtttaaattttataacaaacttagaccataataacctttttctgttctttgctccaggatttaaatctagtaaggttaaggctaaattacaattctaggcatgttataatcaagaaaagcttactctggtatttcttagcagaagaaaggtcaatgtaaagggtttgataaa

SEQ ID NO: 37066 - DNA, 1058 bp, Homo sapiens
gaaaagactatctttccttcatatatgaagctcagtttcactgaatacagaattcttggctgctaattgttttgtttgaggaggctgaaaataggccccaatcctttctagcttgcaggatttcttctgagaaatctgctgttaatctgataggttttcctttataggttacctggtgcttttgtctcacagctcttaagattctttccttcatcttaaatttagataacctgatggcagggtgcctaggtgatgatctttttgcgatgaatttcccaggtgttctttgtgcttcttgtgtttgaatatctaggtctctagaaaggccagggaaattttcctcgattattcccccaaatatgttttccaaacttttagatttattttcttcctcaggaatgctgattattcttaggtgaatggtttcgtttaacattaactgtagacttcttggaggctttgttcacatttcttattttttctttgtctttgttggattgggttaatttgaagacattgccttcgagctctgaattaatttcttctacttattcgattttattgttgagactttccagagcattttgcatttctgtgtttccattgtttccctgcagttttgattattttttatttatgctatctatgtcattgaatatttctcccttcacttcttgtatcatttttttggtttccttacattgggctttgcctttctcaggtgcctccctgattggctcaataactaaacttcttaattctttttcaggtaaatcagggattccttcttggtttgtgcccattgctggtgagctagtgtgattttctgggggtgttaatgaaccttgttatgtcatagtaccagagttggttttctgattccttctcatttgggtaggctctgtcagagggaaggtctagggctgaaggctgttgttcagattcttttgtcctgcagggtgttctcttgatgtagtactctcccccttttcctatggatgtggcttcctgagagccgagctgaagtgattgttatctttcttctggatctagccacc

SEQ ID NO: 37067 - DNA, 1053 bp, Homo sapiens
tcctgtgctccctgtggtggctgctctgagagagaggactgtgggcttcccatctgatcgaggaaagctgctggcattgccccagttgcgagcggggcctggggcttgctcctactgaagttgcctgactggttttttatggggttggcgtttttatcaaatttacacatgcactgatttgcccaatgtttccccttcctacattggggacatatagaagagggttctttccctgaattaccttggtctctactatgggagcattccctcttcatatgacctggatctccgcatagaaaacaatttgggtttctctcccttttcactttaggaggccttaatgccatagccaatattttggctttgtttgtctcagttcctaccagctgacacgctcatagaagctccccaactgtggctgcctttcctttgattgcctgcattgcctgctgcacattagcgttttcaaaagacagttgcaacgataagatatcagcagcttgggtgtgactagtatgtctcttaattgcctgggttaaccgattgataaactcaacaaatggctcttgaggcccttgtcaaacatttacgaaagatccctgttgaactccacttttgggaattccgtcccaagccctgagagcacacaaagacacttgagcataggcctggggatcaaaatctagttgttgtacattggcatgaggacccctcccttggagcatatcagctgttatgtcttggccggccacctgattctggttggcttgttcgtacaactcattgtattctgccttccagaggaggtattggctaggctacaaagttgttttagctagcattgactagtcccatggggtcatatgcaagtggcctgccaaggccttaatcattcctttcgtaaatgggctagcggctccattttctttaacgctttttcttggctctttataaggttaaaagaaacaagttgtggccaggtgcggtggctcatgcctgtaatcccagcacttttggaggctgaggcgggtggatcacgaggtcaggagattg

SEQ ID NO: 37068 - DNA, 2742 bp, Homo sapiens
agcgctatcctgcccgcaaatgatcaaaggttagttttagaaccacatgagtaaacaagctatttagataaactactctacattcctgttaattacccttgctatagctcaaagaggattaggctgccttcagccataactctgtcctgaagcttttgcaaaaagcttttggccttccaagaaggtttgtgttttattttataattttccccaccattctgactgaacccctacatctctcccttttctgttttctgcattgggtcttattgattggagagtgcagatgtatgcagcaacaggtttgtcaggagtggcagtgattgctcttattctggctttgcatcctagaattagtaaataacataagacaatcatgagtataattagcaacattctctgctagtcaaagagtgacccccaggagtgggggtctaaccaggagagatgatcttgcacacccttccatatggctgtttgttgggtgtgtagatctatagtgtgaagggattctaaaattttagttttaagttgctttacgtctgctgttaaattccccagaggtgttgtttcacctcatcccaactatgcattgattgattccatggtagagaagtgacacagatatgcttatgctcccagttgcagcttaattgctgttggaatgccagtgcatcttgtggctcccccacatattttaaagcagcctcaagggcttgcagacgtgcaagaattttttgatctataccctgctataagagaagttcattagacacgtttttggccagattatctacaaaggcagctgtttatactgactcagtaatagatgccacagcaatgctagcagttgctaggatgactatggctgagactataaaggccataaatgtaactatgaatcttttgtgtctgacctgggacagggtacgctctaaggtggcaagggcagaggatccttgccaatcgcatgtcaaattgactggtaggaatgcctcagattatctccttagtaccatgacactagtaatatttagatcagatatattgtaattaatgatacatgaggtgaaccaagtctgtccctgcacccgggtcacaaatgtggagttttggggtgaaatagaaatattggttcccataaggaaaacatggatgggtagtgcaaatcagttactaatcagcgtaactgatcagtatgaataaaggttatagtatagttgttaccggaattatgatatgttccatgccaggtgtcaagggaggtgccaagatgtcccaggtgccataaagtgtcttgaggtggcatggaatttacttggggtctgggatattgcatcgccccattggcccaaatcataggggaatgggacatggctacaaaactgtgattgatgccttgacagaggaggacattagtaaggctgccctgcaaatggccatggggactccagtctaagatgttataattgcctaactggaggctatgggcttgtcccctgtgacagacctcccagctaaagtaaaatccagtactttcccagttttgtcctttagcacaggaaggaatgtttgggaaagtggcattgattgcattacctggtttgaggctacctgtagctaaggctgttaaggcattttctttgccatgatatggtcataattgtgtttgggcagatacacagtaagtgttagaacctttataacttacacacagtgggaagatagtggagtgatatgtagtgttatctggcaccttagtccaatgtatgccattactgagggaccccactgggggtaaatctatccctcctagccaagcacttatgttattataggctgggaaggggatgtctgcccaggtgacagggcgaaagaaaggcgggtctaagataagagccagtagagtgtagcaggtacagtttgcagacaaagcaagagcataaaaaggatcaataccctatgtgagttgcaatgtacaacagagagcatagcaaggaacaaattatctgaagtaaatggtgtctgtgtctggagcagaattcattcagcctcctgagttgtcctcttcagcatcccccaggtgacgtccggggcttgtgtcatccatggaagcctcatcgtctggggctgtggatcctgtagggtcagttccttcatctccggtaccaggttggatcctagccacaccatggtatggtttaatgcatcatgctggaattcaaagaggacctgagggggtatggacacaagcctaccctcttccccacattaacaattcatttggatcacaccattcattactgtttacatctttccataaaactgcaggctttatgtcttgagaggttttagcaaagtgcttttctacagctgattgaaattcgtcatctaaatttagaaaattaagggtaaataaggcttgtgccaatagtgttggagggtttttactcatactccccctcttctggctgttttctgggcatatttttaagggtggagtgggcacgttctactatggcttgtccttgggggttatatgggatgcctgtggaatgttggatattccacttgtgacaaaattgttgaaattgtgagctggcataagctggaccattttcagttttaattttttaattttttaatttttgtgggctgccccataaatgcaaaagttaaaagatgtttaatgatataccaagtggactctctaggaagggtgtgtgcactaattagatgagt

SEQ ID NO: 37069 - DNA, 1061 bp, Homo sapiens
ctgtgtgctgatgagaagaatatatactctgtagctgttagatggagtggtctgtaaatgtctgttaggtccatttggtctaaagtgaaatttaattccaatgtttctatgttgattttctggctagatgagctatctaatgctgtgagtaggtgtatgtgtgtggtttttttttttttttttttttttttgagacggagttttgctctgtcacccaggctggagtacggtggcatgatatcggctcactgcaacctccgcctcccaggttcatgtgattccctgcctcagcctcccaagtagctgggattacaggtgcctgccaccatgcccaggtactttttgtatttttagtagagatggggtttcaccatcttggccaggctggtctcgaactcctgatcttgtgatccacccgcctcggcctcccaaagtgctgggattacaggcgtgagccaccatgcctggcctgctgtgagtaggttttaaagtacccaaatatgactgtattggagtctgtctcttcctttagatctagtaatgtttgctttatatatctgggtgcttcagtgttgggtgcatatatatttagaaatgcaatattctgttgatgaattaattgctttgtcattatattatgattttcattgtctttttactgttgttgtttgctgtcttatcttttaagtaggacatttaatccattcacaggtagggttattattgagatgttattatgagatgtgaggactcattcctgaaatgaatcctctccatttttgtttgggagagactttatttctcttttatttatgaaagattccttggctgggtatagaattcttgttaggcaggtttttgttttattttcctctcagcactttgaatatatcatcccattctctcctggcctgtaaagtttctggtgagaaatcctttgttactctgatgagacgtcccttgtatgtgactaggcacttctctctgcctttaacttttgacagtttgactataatgtgacagaagaccttttggggttgttatctatttgtgggtgtctg

SEQ ID NO: 37070 - DNA, 1057 bp, Homo sapiens
acaacccagaatttcatatccggccaaactaagcttcataaatgaaagagaaataagctccttttcagacaagcaaatgctgagggaatacatctccaccaagcctgccttgcaagagctcctgaaggaagtacctgatgtggaaaggaaaaaccattaccagccactacaaaagcacaccgaagtatacagaccagtgacactatgaagcaaccacataaaacaagtctgcaaaataaccagttagcatcatgatgacaggatcagattcacacataacagtattaaccttaaatgtaaatggacttaatgccacaattaaaatacataaaatggcaagctggatagagtcaagccccattaatgttctgtcttcaagagacacatctcacatccaaagacacacataggctcaaaataaagggagggaggaaaaatggaaaacagaaaaaagctggggtcacaatcctggtttctgacaaaacagactttaaaccaacaaagataaaaaaagaaggccattacataatggtaaaggattcaattcaacaagagctaactatcctaaatataaatacacccaatataggagcactcagattcataaagcaagttcttagagaccttcaaagagacttagattcccacacagtaatactggacactttaacaccccactgacaatattagatcatcaagacagaaaattaacaaagatattcaggacctgaactcagctctggatcaagtggacctgatagatatctacagaactctccatcccaaaacaacagaatatacattcttctcatcacatggcactctaaaattgatcacataattggaagtaaaacacccctcagcaaatgcaaaagaactgaaatcaaactgctcagaccacagcacaatcaagttagaactcaagattaagaaactcactcaaaaccacacaactacatggaaattgaacaacctgctcctgaatgactcctgagtaaataatgaaattaaggcagatgtcaagaagttatttgaaattaatgagaacaaagagaca

SEQ ID NO: 37071 - DNA, 1032 bp, Homo sapiens
aagcctgggtgaagatgcccaaaacattgcttctaagaagttttcacaagactttctgtaaaagacagggaaggcccaggtctcagagttcacccaactttggtgtcaatacctctccaccgttctgttatatctgtggcctctcctccctagattttcttgtcttaaagattaattactaatagttttcaaatccaaaggctggaattcagtttccatctcgtacagtgacaggacaggaattgttcgaactctaaagtgaaccatttccagaccttgtgattcaaatattatttaaaatgtgactaccttggctttgatgataaaagtcacaattaacaaatgaatgaatgaatgaatgaatcaatcccaatgtgtgctttgttcttatcccttaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagtaagcattgttctagattttgtttgtctagtgattgctctatgttcttcaggttttttgtttgtttgtttgtttgttttttagtttgttttttgtgggatgtggaaatactgaaaagttgttaggtcagtttgaaatcgtgatgcaaagcatcttcccttttggcttagtacttcagcatttgtctttcagacttctctgtgactgtattttttaactaaaaaatgaccaaaatgtaagaacataaaatcgtactacaagtatcaacatccgttctgccctgtcttcacatctggtgccagcatctcgttgtgtgagatgatgttcagctcttgtccatctggatgtgctgggcaatcacagccctatttcctggcacatttccttcagccttttgatggatgagcaactctagaatttttggaaagcttagttcacgttccaggtttttt

SEQ ID NO: 37072 - DNA, 1290 bp, Homo sapiens
tgttttatgctagagtaggaagcttcatcaaacacgacagtgttttgtactgtttcctaaataacagaattatgtgtaatggtttaattatttggattgaacaataatgaaccaactgggtattttttatgcagctttacatgacttcaagggaaataaggctgagacaaaagatgaagcatgaaaaagacaggtgagtttggtagctgtaaccctgtgttttctctctaacttccttagctgaggcatagattaatgccttaggaattctgttttcacaatagtctcttttttgtcaataaacagagaattatgggagttatcactgcaaggaaaatgatgagactcactagccttttttcaaatttgctttcaaatattatgtgtttcattcagtttttatgacttttatttctgctgttctccctttcccaacccagatatttacatgcatttgggaaatactccagagaccataactacaagtacctttaataatactgcctaatcattttcagaaatctgatgaatagaaggatgttagaagtgctgaagaaagaaaatgctaagtgaaattagccgggcatggtggccaggcgcctgtaatcccagctactcgggagcctgaggcaggagaattgcttgaactcgggaggcggaggttgcagtgagccgagatcacgccattgcaatccagcctgggtgacaagagtgaaactccgtctcaaaaaaaaaaaaaaaccagaacatgctaggtgatcttcaaacactatattccctctggatagatgaactgaaagtgactcttaataaatgatgcttaattctttgtctacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagagggtaagacaaggtttcacatgccatttggcaagataacgtcaggcctgataagaagaaatgtagcactttcgtgacctaagttcagtgcatttgcatttaccctgcttagagttatgatgataaaggaaaaaagtagcctcataatcatgaggtctttatacattgatagaatcaccaaggaaaaaggcaaaaattgtgttatatttctcactaagcttacagagcatttaggtattccagaagtatgaaatttggtatctgtgcagtcctgttttatttagttg

SEQ ID NO: 37073 - DNA, 1051 bp, Homo sapiens
catcatcttgcccaggctggtcttgaactcctgggctaaagcagtctgcctgccttggcctcccagagttctgggattacaggtgtgagccactgagcccagccctgtattagaagttttgaaagtgatagagatagtgcagggaataagttaaatagataaagaagtggaaacctccccattttacatgatgtgtttattatgcattgcatacctgtatcaaaatatctcatgtactctataaatatatacatctactatgtacccacaaaattaaaaagtttaaaaaaagtcaaaaggagaacctttaagataattaattttgaagcagtgagcagagaagaaaggagccaatgcaggaggctatatagttttctgagagttaggaaaagactcaggtaagatagagtttaaagaagaagggaaaatcgagtttaaggtaaatgttataaagaagttgttagctttctgagtccattttcagtggagttcaggtaacaaattggagtgagttgactagagaacataagtatatactacttttgaagatggggcaaaatatttccggataaatagtgtttagtcatgatatatcttatctgcttaacaaatttaaaagcaaatgatgtcttgcttgttaaatttctcagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccagtaagtctgccatgtcaagggtaatggaattacagaatatgtgtaattactttcctggcaaaattttaagaaaaagattaacataatttggatacatttgtaatttggcatatagaaaagtaaatgttttacttaagtcaggaaaagttaataaattatcttaaaatgttgcagcatattgtgctaaccaagttatactgaattatcttaaatattttcttgtcccccaggctaa

SEQ ID NO: 37074 - DNA, 1048 bp, Homo sapiens
aggccaaggcaggtgaatcacttgagctcaggagttcgagaccaacctgggcaacatagcaagaccccgtgtctacaaaaaatacaaaaattagcctgcattgcggcacacacctgtaatcccagccattcaggaggttaaggtgggaggtttgcttgagcccggaggcagaggttgtagtatgccatgaccatgtcgctgcacttagcctgggtgacagagtgagacatggtctcaaaaaatatgtagacagtattcactatcagatagcatattcaggaagaggataaatatgctgtaaatatatatctataaaccaatttggaagtttaaaagtattttaatttaatttctggttatataatttctaaattagattaacaattgaaagcaaaaaaaaacccaaaatttttattaataatgattttttttttaggtatgaatagcagtgatgaattgtgtgagaggtaaatatcttaagagttaattcacaattttctttaaagttgggtgtagatagtgaaaattttgttcatatgtgtgtgaatttttacattatatatatctttgtggtttaaaggaatataagttttcattgggtatggaatatttttaagaaattgaggattgttatatctcttactgttttagcacaagtagttagaattcaatagactatatttactacattttcttatataaatatggattaaatttaaacagaatctataggggttttcttctggaccatatgtttcctttttaaagaaaatctaccaagtcattactttttgttgattagtctttttcactgagagatactagaattacagaaatagaaggaacagtagatatatgtttatcattttgtgttcatttgttacatgtttatttttgcttaatgtaattaagttgtagatactgatttatatttcttaaattacatttgcaaatgaagtgtttcagtacatccgctccagatgactggattgactgatattgcagacattattgatgaccttataattaaagacggagtttccagtga

SEQ ID NO: 37075 - DNA, 1045 bp, Homo sapiens
cactgggcccagcaggtttggtatatttttaaaaaatgctctcacattattataatgtacacataaatacaaacatcttcacttgcctaacttaagaaaacagcttatagtcctggaagaggcccagggatactctgggcagacactgagtggtaaatagtcttgaagacctgggttgaccgtgttatgccactaaaaaagtcattgaatctctctgggctttgttctctcatctttaatacgaatttgtctagatagtaattaaggttcttcattctaaaattttatgatacaattttcctgagccttttaaaagtttataactcagttaagctacaaataagtaaaaatttcctctgttttattgatccctaccatttagcttatattggatttaatcccatttttttcacttttgcattaatgcaagtgtttaaaacttacataaaactgtttgttattttgaaattatcaaagtattactgttgttttgttgtgtgtgttttttctacagattggaccagtggatcacattgaattctcttctggccctgaattcaaaaaaacattagcttcaaaaaccattagcatttctgaagaaggtttgtaggggctgataggggctggctgaagtcttgctttagttgatctgaaagaatgtgcattgttttgtggagtgccagaagtaggagtagttttcattatgtgagctgaagtcataagcttcccagtttttagattaggattatttttttgtaatgtgattagcttccacctcacggcctttttttttttttttttttttttttttgagaaggcagtaacctcctctggattttatactaggatggggcaagtgtggcctggagctcagtttttgtggattccaagccattggcctcatagtgctgaggattgcacagagctttgtgctgaggttgctgtttgtctgtgatcatcagctgagctggaatttgaggttctggtaaaatggccaggcagtggtgaggtattaagttttttcattttttattgaaagaatgaa

SEQ ID NO: 37076 - DNA, 1031 bp, Homo sapiens
aagtttagagttaaaattagctttctagaaatatgtacaatatgaaaatgaggctacctacatttctgcccagctgactacaaattcaagggttcctatactccacccccctcaactcaggtttgataattgactagaaaacccacagaaattgggaaagcactttacttatgattacaattttattataaaggatacgcagtggtgggggtgggcagcacagggcttccatgccctctctgggatggtcattctcctagcacatccatgtattcaccaacctggaatctcccttaacctgtttgcttcagaatttttattgacttttcagtacataggtataattgattaaatcactggccattgtgattgagctcaatctccagccccttctctttcccagaagtggcagtaggatgagtgaattgggggctggtagttctaaccctctcatcatgtggttggttcctctggtgactagggcctatgctgaagctatctaagggcttgcaaagagacacctctagcataaacttaggtatgatcaaaaggggctcgttagaaataacagacactcctatcaggaaatcccaagattctgaggacctgtgtgcaagaaactgggtctttgtagaccaaatatatatttttcattataccacaatgctccataattaatactttcttattctacctagtcttcctgggagatctcccagagaaatccacatgtaaacccaaactctcacagtagactttggattttgattttctttcctcttgagtttttccacttgtgtagaaattacctcaggtacaccatgtgaattctgaattcattatttctactctgccccaactgttttttcctcctatgttctctttctccatttgtgttgatatcagcctaagccagaaacacatgattctgaattctgtcttccctcttatccattcagtaaccaattcttacctattttgcttcctttgtaattcttaaatttaacctgtttccccatccctcaccatta

SEQ ID NO: 37077 - DNA, 1826 bp, Homo sapiens
gtcatgcatctgaaaacattttatgtgagaaaaattcctattttgcgagacaaatactataattttttcccattttattaaggaattctttcctaccattcatagactggaggattcttttacagtgtcggtaataggatgaacagtcatttgctgctcaaatatttggtacaatatcccatatgcagtagtcctcccttatccccaggaatacatgccaagaccttcagtggatacctgaaactgcagatagtactgaaccctattatatattttgtttttttctatatatgcatgccaatgataaagtttaagttacagattaggcacagtaagcaatgcacaataactagtaataaaatataacaattataactatattgtaatacaagttataagaatgtgatctctttctctctgtctctcaaaatatcttactgcactgaactcatctattttcgaaccatggttgaactctgataactgaaaccttggaaagtgaaaccatggataagcagggactactgtatcatctaatactttgaaccaatcatcttaccgtattctttagactcttacagtaagcaggagggtaggtgatgtaaattgtttcagggcactaagaaatgtgtatgtgaaaagcaaggctgtgacttctagtgaagagcacttactgtagtgttttaccgcatatattgattggtagattattactaagtctagaaaatacttttaaaatttcacatttatcagactgtaaaatctgtcactagtgctctctttccagaaattttctgtttccatctattccctcttcaaattaagtcttccctttagcattttgagacctctttcctccttgctgtaattttgctgaggtgactaagtgtgcttaatgtcttcaaatagacaaatggaggtatctgatagggtttctggcaccagcttcaaatccacagaaaagagagtttaataattacctaaggtgtgtaaacctgtccttagattccagtgactaatatagaatagtcagttcagtagtagaggttctagaaataaatttcacatttggtgttttgcttatatttgcttgtatttgcagaatatcttgccaatttaattaaatgctattgaaaataatttatgaacgtaattttgtcaactgtatccctatatagcatgataaatgaaaagcaaatgttgctatagttgtaaaagtatgttttatgctattatgtttaacaggcaaagaagaagagctgagaaagagctgcaagaaaaaagatgtgagaaactgaggagaaaaccaaatgtgacttttcgaccagagaattccataattaataatgatgattcagaaatcattaagaaacccaaggtatagaaaaactgctatagattcttccctggtttgcatgtacactgagtttggtatgtctttgtggtttatctagtctgattgctgggagcttctgactgtgactaggaggatcttcatatcattcagtatatcagtccctgctgcctccctccacagagcagtagacatagagttctgaatgtgaaaagcaacttgatggtacatgaaaaactgcagtttagagcatctgcctgtgtggcttttttatatttgaaatcaccctttgcttatttctatgacatcttaatatatatattatgttatttgggcttctcctaatacagtttcaccgttctctgagattcctctaggatttcccaaacaggtttgttgtgtaacctctattttaagtcacgtctttttttaaaatttaatttattattattttttagagatagggccttgc

SEQ ID NO: 37078 - DNA, 1004 bp, Homo sapiens
agctctttgggatgcagctgctcacaaaagtgaggtggggagtaatcaaaccagattagtgggctcctactcaaaagtatccaaggtttattttccagctgacactatcacatatttcttatccatatttcttgtgcttgagttgaaactctcagctgcatttcaaattactgttcactttgactttcatcatacctggctatcctttttttctgtttaccaacaatggttaattatttacctttttagaaacattagtttccttcagatctaaacctctgctcatttgtcctacattcacttccatatccttttatgtgatgtaatatataccatttccatattgatgattctcggcactaattttctttttaaaaattttttttatatttttattttttgagacggagtctcactctgttgcccaggctggagtgcagtggcgcgatctcggctcactgcaacctctgcctcccaggttcaagcgtcttctgcctcagcctcctgagtagctgggattataggcatgtaccaccttgcctggctaatttttatatttttagtaaagatggagtttcgccatgttggccaggctggtctcgaactcctgacctcaggtgatctgcctgccttggcctcccaaagtgctaggattacaggcgtgagccgctgtgcccagctgcactaattttctctttgaacttaggggccttgatgagaatagttgttcagcatgtccccctgtcccatgaaacttactgaaactaattttattcttattctccctagtcccttctttcctttttctgtttagtagcaccactgattctaccatcttaatgttttagagacatctctcaaactgttagatggattacttggggacttcactggtcactgtcctatatatttaacacattatccagataattctgatgcacacaaaagattaagaatcactatcttcaaaagtcatctttgccttctttcacaacccctaccca

SEQ ID NO: 37079 - DNA, 1040 bp, Homo sapiens
agtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaaggtaagcatatcaattgtttattacttacaaatgagaattctcattttagattaaaactatgtttacatttcccatcttttaaagaatcattaaataatagaaaattaatgacaatgttgattataatcagtatctcctatttttttcttccagtggttcctttaattcttaacaataaagtgctttcagagaggctgtgaggttttgaagttttatgtgtatttataaaaaagaaaaaaaggaaggagataattttaagtgatattacaagtggtattacacgtatattatttctcctttcagtttcaggttttggttcagatgaaggaggactaggtggctctgtagttttaattactgatgtctcatcaagtccgttaggggatagtttttcttatactctcaggccagaagaggttggagaaccaaacacagaaaggcagatgggggagtcagtagaggagttagtgtttaattaactattctttcttccctagtcaatggcaagtgcttttattctgaagtagtttattctaggctgaaggatgtgagtgtgtgtgtgtatgtgtgtgtgtgtatgtgaatatgtgaatttgttttattttttacttattcattttttgagacagagtcttgctttttgttttgttttgttttttgttttttttgagatggagtctcactctgtcacccaggctggagtgcagtggcgtgatctcaactcactgcaacctccgcctcctggattcaagcgattctcctgcctcagccttgtgagtagctgggactacaggcacgcgccaccacgcctgactaatttttgtagtttttagtagagatgg

SEQ ID NO: 37080 - DNA, 1032 bp, Homo sapiens
agtggcttggagtttttgttgactttgtattcctaaaatctgacccattagaggactatttcttttacccacagaaaaattattcatgttcttttatagtgaaatttctgtggacacattttaatctcttctaatacaaattttcccttttgatagtaatttttttttgatctcatagtagaaatgttccactcttgaaaacacttagaaatcatttagtcccactccctcatttgaaatgtaggtaattgaggcacacaaaatatacatgacttaatcattggagagaattttccatgtcaattctaagatcagttttagtgattaaatgatctctaattttgtcttattttatttttttgctatagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactaga

SEQ ID NO: 37081 - DNA, 1050 bp, Homo sapiens
agatggagtcttgctctgtcacccaggctggagtgtagtggcgtgatcttggcttactgcaacctttgcctcctgggttcaagcgattctcctgcctcagcctcctgagtagctgggattacaggcatgcgccaccatgcctggctgacttttgtatttttagtagagatggggtttcaccatgttggtcaggctggtctcaaactcctgacctcgtgatccacacaccttggcctctcaaagtgctgggattacaggcgtgagccactgtgcccagccatgcgtggctaatttttaaaaattattttattatttgtagagatgagtcttggtatattgcgcaggctgatctcaaactcctgggttcaagtgatcttcacacctcagcctctcaaaatgctggggttataggtgtgagccactgtacccagggtgaaagacttctgtatatgactttttaaatgacaggatagtctttatttatttgtttatttttgcaatattgtccttacgtgatttaactttcatgataagttgaacctgtagtaattcatttgttttaatttttttttttttttgagatggagtttcgctcttgtggcacaggctagtgtgcaatggcactatctcagctcactgcaaccttcgcctcccagtttcaagcagttttcctgcctcagcctcccgagtagctgggattacaggcgcctgccaccatgcctagctaatttttgtatttttagtagagacggggtttcaccacattggccaggctgttcttgaactcccgacctcaggtgatccactcacctcagcctctcaaagtgctgggattacaagcgtgagccaccgcgcccagctcatttgtcttaatttttaatgatgattgcttaaaatatattaagcatatacttactgggttggggaccccaaaattaccccctagatttgatggttcactaggaaaactcagaagatttaacatatagttgtactcatagctatgatttattacagtgaaagaaaacagcaaaatcagcaaagggaaaa

SEQ ID NO: 37082 - DNA, 1075 bp, Homo sapiens
ctacctgggaggctgagatgggaggattgcttgagcccgggaggctgagatgggaggattgcttgaacccaggaggttgaggctacagtaagctgtgatggagccactgcaattcagcctggcaacagagcaagaccctgtctcccaggctggagtgcagtggcacatacctgtaatctcacctgttcgggaggctgaggtagggtgatcgcttgggcccaggagtttgagatcagtctgggcaacgtagtgagaccttgtgtcttaaaaaaaaaaaaaaaaaaaagattacaggtgcttaaaatatttatgaagattttatataaggcattttttaatcattttattttgcactatatttaaatgtgatcagtttgtatgtatgttataccgatgaagaatacaggcaaaaaaaaaaataggctaaaaaggaggctaaactcatcattagcctgaaatttgcttttgataattacctgattttatgtgcagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggtcagtatcttatgaatattttctaactccatgaataaatgacatagttaaccagactttgaatttctaattggttgtaatgatttgtttttcaaaataatttctggctgagctccattaactggattttaaaacaaagtaaatttttatgaagtaatataattaactatgactaattgttggttaaaaactttctaggggaagaatgttttttattaggatcatatgaaaagtctgttcagctgtggaaaaaagctctacaagaaatcgaagagaaaggtaagagagtgttaaaaaatatgtgccataatattagcaggactccttttagcttgctgtagaccttaacagtaattctaaattccaaaaaatat

SEQ ID NO: 37083 - DNA, 1010 bp, Homo sapiens
aaggtctagcctgttagaacaccaaggaaatgaaagttcagccgatttcactgtccccaaattcttgcaggcagaagaaacaataaatgaaaatgcagcagattttcaggtacttagcagcagaattttatttacttggaacaattatgactttattccaagaaacatattctgtttttctcttgttaaagggaagagaaatttaagaacgccaaagtgatgctattgataaggtattaaatggtattaagtatcatttttttcccctcatgttttaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcat

SEQ ID NO: 37084 - DNA, 1031 bp, Homo sapiens
caccaggatccatgcaaaattacagagtaggagaatttcctcttacagcttctaacttccttttctgaatacttttccatgctgttctatgcattttcagagtttttaggtttatctagccctgcctcttcattttcttttactttccacaagttcctttctctttggtaaatttctcattcatattattcataatactttgaaagtattagtctcagttcagtggtctttttgatttagtgtctgtcattttctgaggaggacctactgtttgtctcattaaacattagtatcaccagatatcaacacctgtgaaaagacgggaataagggttaaaatataaaattttaaaaaataaaaataaaataaattaaaaaatcacgaaatagttaaggagtagtaccagttagagctttgggaagagggagagtctgctgttgagagggactctaacagcctgcagagaggacagatgtggccttgaaatctatcagtagatcttgattgtagactctactaggattaaaattcattctaatatgtgagtgactaaaaaactcagttctttaggaatatatatatattttttctctgtgtcccagactggagtgcagtggtatgatctcggctcactgcaacctctgcctccccagttcaagccattctcctgcctcagcctccccagtagctgggattatgggcacccgccaccacgcctggcttatttgtatttttgtagagacggtgttggccaggctggtcttgaactcctgacctcagttgatccgcctgcctcggcctcccaaagtgctgggattacaggcttgagccacggtgcctggccgaatattttcgttttttaattgcttatgaatttctaattggaatattgttgaaatagatgtttatgagcaaactcctttgttctaggaagtaaaattcatgaaatgtgtatggcaattgtctactattagtcattcttttgccctcattttttgaactttcacacctctgcttggtacagcccattt

SEQ ID NO: 37085 - DNA, 1797 bp, Homo sapiens
atatggagtctcactctgtcgcccaggctggagtgcagtggcgtgatcttggctcactgcgacctccgcctcccgggttcaagcaattctcctgcctcagcctcccgaatagcttggattacaggtgcactccaccatgcccaggtaattttgtatttttagcagagacgggatttcacctgttggctaggctggtctcagactcctggcctcaagtgatccacccgtctctgcctcctaaagtgctgggattacaggtgtgagctaccgtgcccagccaaccccttttctttataaattactcagtctcaggcattcctttacagcaacacaatggattaacatagtctctaaaatattccctaagtacatgtgcacatgtaggaatttggatggatcctttaatttttgtaatgaactacatataaatttaaaagttactataccttttgttttcaattatttcattacttttttagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggtcagtaaatatctgtcttagaaagtaatctataaaagaaggagtttattccagttttgagatttttctttttctaaatactcctttatatccattttttttttctttctggttttttttttttttttttttgacagggtctctctctgttgcctaggctggagtgcagtggtgcgatcatggcttgctgcagcctcgacctcctgggctcaagtgatcctctcacctcagccccccaagtagctgagaccataggcttataccaccgtgcctggctaatttttgtatttttttggtagagatggggttttgccatattgcccaggctggtcttgaattcctgagctcaagcagttctcccacctcagcctcccaaagtgctgggattacaggtgtgaaccactgtgcccagcctgctttatattctttaagttggtggtgtttaatccaatttgacattgtggattggtaaagttctttaaagtagatcccataactttcaaaacttggctttcagaaatgaaaaaagaataagggaaaaagaggaaagaagagcattgtggtaactaatgtttttaaggtggaacataaaagagcaaaggctaccaggggtcaatattgctttgccagttaggaaatactccctagatagtttattaatataataatagatctctgtgtcaccagaattataaataatggttacagtaaaataattttaatagttttcttgtcttttttttcctttctaggcaactcaggtattatttataaacacactgaattttgttactctctgtggtagccttaaaggatgtagtaacaagagtcccgtggttccagctacacttattaggtaagaactcttttgtctgtcttttttttctttttttcttttaaaagagatgggtctctgtcaggtgtggtagctcacacctgtaattctagcactttgggaaaccaaggtgagaggatcacttgagctcaggagtttgagaccagcttgggcaacataatgagacctcatctttactaaaaaataaaaagaaattagccgagcatggtggtggacacctgtagtcccagctacttgagaggctgagctagggggtatcacctgaacgtgggtgatagaggctgcagtgagctatgatcttgcca

SEQ ID NO: 37086 - DNA, 1049 bp, Homo sapiens
gctcagttataccttgaaaatcactgccttagaatatatgaaaacaaagttaactcaaaacagcctactttttctaggtaataaaaaatgagcagagtcagggatttatgaatttcagaagctatatctattttaatctaagtaaataatttaaaaacttgctcatactactgttaaaattgatgagagtcaggttcagtggtatgcacctgtggtcccagctactcaggaggctaaggcaagaggatcgcttgagcccaggagttctgggctgcagtgtgctataccgattacgtgtctgcactaaattcggtatcaatatgatgacctcccgagatcaaggggctggggtaaccaccaggttgcctaagaatggtgaactggtccaggtcagaaatgggccaggtcaaaactctcatgcttattagtagtgggatagtgcctgtaaatatctactccacttaaggctgggcaacaaagtgagacctcagctcttaaaaaaaaaaaaaaaaaaagattaaaaagtagataagccagttttggctagcagaattagaggacactcctataattttaaacttcaaagaaattgaaatacaactactaggtagccttacctattaattctaacgaggtattttaaaacaattcaaaatgttcaggctactatagagtattaagcttaatgttcattttatgatttgtggtacaaatggataatctttcttaaatgtcgctttgatttctgggataatttatttaggcagtaagttgaattaatttctggcacctcttgagtccttcacatgtttcttctcttaggaaaaagaagccgtttttcttttggatgataaattcataaatgaaattaatttgctatcaggaaagataaagaagaaaattcctagtctgcagcctttcttgaaggatgttattgtcctaacaacatccagtaatggttaagtagtactgatattttcaaatggctaaaactatattttttaataacttagggtgatgttaaaggaaatactagattgtaagtattg

SEQ ID NO: 37087 - DNA, 1053 bp, Homo sapiens
cagatggttagagatggttgcagtttaggacctggaagaacaaagctttatcttaaactattgatctggatgttttttctttatccctgctcatcccttacactcttttctatattcattttactggttcaccagaagccaggaaaaataattttgtagtagtcagagtgttattccaattgtatattgtttattgtgaatactggtgaacagtggtcaagaagtagttttatattcctttaaaaaatgtagccaggtatggtggctcatgcctgtaatcccagcactttgggaggccaagggggggtgaatcgttaggtcaggagttcgagaccagcctgaccaaaatggtgaaaccccatctgtactaaaaaacacaaaaattagccaggcatggtggtgggcacctgtaatcccagctactcgggaggctgagtcagaagaattgcttgaacctgggaggcagaggttgcactgagccaagatcacaccactgcactccagcttgggtgacagagcaagactctgtctcaaaaaaaaaaaatgtaactctaaatatactcctacctttttcctcaagaaattacagattcctagtgtggcattataagcactgcattttagttgagcaaaaataaaaataacaaaagtctcatgttagttttagcaaaagaataatttattggccctcaaaactaaaatgtccatgtataggcaacttccacctgactacatccccagcctcaatattttcagggccttctctagctcagttcctctcttttcatgtcactctgctcttgcaatttgtctacctgtgactcctgggagagtatgggcagtgttacatcctgttagctctaacctggagatacagttaacagagaagtcctaggaagggctctgatcaacgagtccagcttgagtcatggactagtcttggggcatagtggtcatgcaaaccatatggaataggaaagaaatgctttcctaaagaattggatgctgggcatacatgtgatctcagctatgcacatcagatatagtaggcac

SEQ ID NO: 37088 - DNA, 1039 bp, Homo sapiens
agactgagttttgctcttgttgcccaggctggagtgcaatggcacgatcttggctcaccacaacctccacttcctgggttcaagcaattcttctgcctcagcctcccgagtagctgagattacaggcatgcgccaccatgcctggctaattttttttttttgtatttttagtagagatggggtttcaccgtgttggtcaggctggtcttgaactcctgacctcaggtgatccaccccccttggcctcccaaagagctgggattacaggcatgagccactgcgcctagccccaccccccctactttttttttttttttttttttaattttttgtgtagccaaaagatctcactctgttgcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactgtttatgctatgagatactgactgatgtacatgtacatttagtgtttctttaggtatacctgacttattcattgaacacctatccactgatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaatattttaagtcttccattaaatcattgaaactcttctgagcttcgttttcctcatatataaatgagattgaagccaaataataaaactttaaaaatcaatcaagggc

SEQ ID NO: 37089 - DNA, 1049 bp, Homo sapiens
gatcgagaccatcctggctaacacgtgaaaccccatctctactaaaaatacaaaaaaattagctgggcgtggtggcgggcacctgtagtcccagctacacgggaggctgaggcaggagaatggcgtgaacccaggaggcagaggttgcagtgagccgagatggcgccactgcactgcagcctgagtgacagagcgagactccgtctcaaaaaaaaaaaaaaaatcttcaaatggaacccacctacacccaagttttcttttttactttatttcttatttacttaatcacatggtctttcctctcctgtgagaattaaagttgccagaagttggtggggaagaagtcctgcaggaggaaatgtttgtaaatgtataattaatcatgtgtctttttcgttgtaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtgg

SEQ ID NO: 37090 - DNA, 1045 bp, Homo sapiens
ttctaacagtgtttaggaaggagtaatatgtaagcccaagattttcaaatatagccaagtgattgttttttccattttataaccaaagccaggagatctgactctagttttggctctacttaagctttacttttctcatttggaaagtgagagttttggactagatctactgtaggttcttttccaactctctatgattttatgtaagttcgcaaaaatttgtttctactaattagtatattttcgcttttcaattatagagtctattaatatttaggttattttaatttattaaaataatttcattatgtttagaaatatggtatttctataattgtgatagaaaagttttatgctcctaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggtatgatactttattacctatttcattgtttgttataagaggtatcatgtatgatgaaccatcttgtttcacttaatataggacctcagtcagttagatctcttaacctctcctagcctcagaatcctcatctaagaaaggggttggaatatgtggcttcttaaaaccagtgtatactcttttaagcttagcttttctttttaaaaatatttttatttatttatttgacacagggtttcactctgttgcttaggctgtagtgcagtgctgtgatcatagctcacagcagcttctaagtcctagactcaagcaggcctctcatgtagctaggggctacgggtgtgcaccactacacccagccaatttttttgttttttatagagacaagttctgatttgttgcacaggctggtcttgaactcttggcttcaagtgatcctcctgcctcagcctcccatagtgctgggattataagtgtgagccaccatgccc

SEQ ID NO: 37091 - DNA, 1049 bp, Homo sapiens
tttttcttttttaggcaatcttgctctgtcattgaggctggagtgcagtgatgtgatcattattccctgcaatctcagactcagccgcctgagtagctggggctacaggcatgtgctgccacacctggctgattttttcttatttttctcagagatagggtctcactgtgttgcccaggctggtctaaaactcttggcctcaagttatgctccctccttagcttcccaaagtgctgggattacaggcatgacccactgcatccacccttacttgaggtgttttttggttttcttttttgagactggtctcactctgttgcccaggccggagtgcagtggcatgatcacggctcaccgcaactttgacctcccagcttcaagtgatcctcccacctcagcctcctgagtagttgggactacaggcacatgctaccatgctcagctaatttttttatttcacattttgtagagacaagttctcactgttttgcccacgttgatcttgcactcctgggcttaggtgatcctcctgtcttggcctcaaaaaatgctgggattttaggcatgagccatccgcactcagcccttattgaatatgtttaacatattcatatatttaacatattgaatatgcttaccatattcaataagtgagtttgtcaaatgtatttactgcattttacagagatgatcatatcattttcccccttacctttaacaatagagttaatacatgtcctaatttcgaccaacccttggattcctataacattagtttcattgactatggaaattttttaaacagatttttgagatctactttacataccactaaatttactcattttgaatgttcagttcagtgacttttagtaaattcatagaattgtgcaaccatcaccacagtccagttttagcacacttccattatctaggagacatacctcatgtccattagcagtcactttccattcccacttcttagccccagacacttactgatctgctctatctctgtagatgtgcctattcttgacatgtcatataaa

SEQ ID NO: 37092 - DNA, 1054 bp, Homo sapiens
ggttagattgtttcacatttcctgatattacacaaataagatggcaaaggttatttttttttttttttttttttttgagacagagtcctgctctgtctcccaggctggagtgcagtggcccagtctcagcttactgcaacctctgccctctggggtcaagcgatcctcccacctcagcctcctgagtacctgggattacaggtgtgcgccaccatgcctggctaatttttgtagtttttgtagagatagggtttcaccatgttgcccaggccagtctcaaactcctagactcaagcaaaccacctgccttggcttcccaaagtgctaagattacaggcagggggcctcagcgcctggcgggttattcttttatgtatatgtttgcattcttggacaacaaactgcttaccttcaggtttaaatctcatctctaacattgattaactgtctgaatatgagtaaattacttaacatttcagagcctgatacctcatggtaaaagaaggggcgtagtatatctccctcataaggttgtcatgagggataactcaagcaacttaatattgctcaaattttactatgtaatactttgacatatatatgaacgaaaactccatggacccagcactaatttctatgaattggcatactttacagactgctttttgctcttgttgcccaagctggagtgcagtggcacagtttcactcttgttgcccaagctggtgtgcaatggcattatctcggcccatcgtaacccctgcctcctgggttcaagcgattcttctgccacagcctcacgagtagctgggattacaggtgcgcgccaccatgcccagctgattttttgtatttttagtagaaacagtgttttactatgttagccaggctggtctcgaactcctgacctcaaatgatccgcccacctcggcctccactgagaatacaggcgtgagccaccacgcccagtccaaatatatttttaattgtgaggctcttaaagttcatgagttgggcacagtggcccgtgcctgtaaccacaatgctttggaag

SEQ ID NO: 37093 - DNA, 1048 bp, Homo sapiens
caggggttaggggatgccaaccaccattcctcaaccttcatgtagtcaaaaattcatgtacaacttttgactttcttaattactaatagcctactgtctagaagcctcactgataagtaatcaattaacacgttttgtatgttttttgtgttttctttttttaacttttgcatggtgtaggagtatgggggagtctcgtaaaaaccagaaaacctgctagacaaattctaaaacagccgtaacactgatattttgtgttatatgtgttatacactatattcttaccataaagtaagctagagaaaaaaaattaagaaaatcataaggaagagaaaatatatttactattcattaagtggcaatggatcatcataaaagtcttcatccttgtcttcacgctgagtaggctgaggagtaggaagaggaagggttggttttgatgtgctggggtagcataggtgggaaaaaaatctgtgtataagtggacccacacaattcaagcccatattgttcaaaggtcaactgtatatctacttacatatgaatgtacagtgttacaaacttccccataactcagtgacatgtgtctacagttcaacagggcagttcttgtcttgctgggctaactcaagaataggcaatcagttgtgaagttaaagagagctatgcttatcttggctagactctcacatgttcaaggttatattttccagctggtctagaatggcccaagatgaaacagcttggttgttctctacatggtttctcatcccccagcaggccagccaaagattatttagttggtggtggcagagttccttgagaaagagtagacacttgcaaaacctttattctaaactcagaactggcttaccatgcacttttccgccttattcacttggccagagggaagtcacagggccaactcagatttaaaaggtgggaaatagaccaccttttaggggagagacatcaaatcatactgcagaggggatagatatagggagggataaagaaatgtggttgtttttgcaatcagtctatcatg

SEQ ID NO: 37094 - DNA, 1069 bp, Homo sapiens
cgtaatattatgatagttttattttgtcctttaagtcttttgatctatttggaatttactctggtataaggtatgactatgtttctagctttttttttttttttttttgcctaaattgatataaatagtagcaacatgattaattaataatctaactttaattctctggtttaaggggcagctttgccggggcaattgcattaagttttctttatagatatatagatctactggaggttgagtagagaagtagatgatctttttgaccagttgtactttttatatcacctcagccattcctcctgcctcagccccgtgatgtgctggaaatacaaatgtgggccaccatacccagcctactttgtattgttgaatggttttttttgtttgtttcatttattttatcaaataaggtagagtcagttgctatcagccaatcttggtaaatctcttgttcatgttctttcttcaaatttcttaggggagccttatgtttcataaacttagacctgtagatcaactgaggcatctacttgtgagtaatgtgggaggagatggagaagagattgaaagattctttaaattacatcaggtaattatatatacttttaaaaaatgtgatgctattttaaacaaacagtgggagtcatagtttatgtaaattgggactggaatactgtaataaatatatatatatattttgagatggagtttcgctcttgttgcccaggcaggagtgcaatggcgcaatcttggctcactgcaacctctgcctctcaggttcaaatgattgttctgcctcagcctccccagtagctgggattacaggcatgtgccagcactcccaactaattttgtatttttagtagagacagagtttctccatgttggtcaggctggtctcgaactcccgacctcaggtgatccgcccacctcggcctcctaaagtgctgggattacaggccgtgagccaccaagcccagccataaatagataatcttaacaatattcctttctttgcctaagtcactgtatgtgaactgacatttgaaagcaggattaatatgag

SEQ ID NO: 37095 - DNA, 1037 bp, Homo sapiens
tacaaaaattagccaggtgtgaagtggagattgcagtgagccaagattgtgccactgcacttcagcctgggtgacagagctggaccttgtctcaaaaataatagtaataataataataaagatcattgtaagataatacttggttttctgtttttcttttcttttcttttttgagacaggctctcactttgtcacccaggctggagtgcagtggcatgatcactactcactgcagcctcaacctcccaggcctttgcgatcctgccaactcagtggcctcacacccccatgcctggctaattttttgtttcttttttgtagagacagtctcactatgttgcccaggctggtcttgaacttctgggctcaggcagtcctcctgcctcagactcccaaagtactgggattaaagacatgagccaccacatctggcctatttgctttatatgtgtaacatgtttttcttcatttattcacagaggagaccttgcctattttgatggacttagtgagactattcttgctgtggggcttgtgaagccaaaagcaggtaagaaataaaactataaggaagagattatgtttgtatatgtaaactccaaatggtatagacctgaacaacaacacacatttttttcgagatggagtctcgttccatcgagtaggctggagtgcagtggcgcaatcttggctcactgcaatctccgcctcctgggttcaagcagttctcctgcctcagcctcccgaatagctgggattacgggcgtgcgccaccacacccagctaatttttgtatttttagtagagacggggctccgccatgttggccaggctggtctcaactcctgacctcaggtgatccgcccgcctcagcctcccaaagtgctgggattacagatgtaagccaccgcgcctggctgacaacacccttttttaaacaattgtattctccattgaagttttattttgaattctaattagaaatatgtaaagtgattattaatgtttaactgtttactttaatggtataagtgaca

SEQ ID NO: 37096 - DNA, 1014 bp, Homo sapiens
attctttacctatttttttttgtctgttttatttctcccttttttttgagacagagtctcgctctgttgcccaggcttgagtgcagtggtatcatcttgcctcactgcaacctccacctcccaggttcaagtgattttcatgcctcagcctccggagtagctgggattacaggcctgggacaccatgcctggctaattttttctatttttagtagaaacaggtatcattgtgttggccaggctggtcttgaactcatggcctcaagtgatccacacgtctcaacctcccaactttacctatttgtacatatagtcaattaggtaatttttcctatataaagcctatatgtatagttcatagttactttacatttcttgtctgatagtttggattcatagctgagtctggttctattgattactttgtttcttgacactggggttttttttcttgttattttgtgtctcatgatttcttattgaaagccagaaatcatgttaagacagtagatactgtaagtaagtagcaagtggtatttattcttagaaatgggcatgtcttttccttggctaaggtatagcagatctttattatatggggaattgcctttttccaggtcaggacttgagctggatttgggttctgttgttgtacttagggtgcaagttggtttactggagattttttctcagtgttcctcttacatcctcagtcttaggctcttcctgtgattccatccttgtaagatggccctcttcttacccttatccctgccccagcagtagattgctattacttgatgtgcagccctgttgtggagatgtttggaatggggagcagcattttctatttttgtatttccctatttttctagttcatccttagccataagcaggtctggatccctgggtcttggaactgaaacagttttctttgcttgtttattttttcattatatatataatgaaaaatatttttatatattcaatatatataaaatgaaaaagttatat

SEQ ID NO: 37097 - DNA, 1025 bp, Homo sapiens
ggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaa

SEQ ID NO: 37098 - DNA, 1062 bp, Homo sapiens
ttatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatat

SEQ ID NO: 37099 - DNA, 1049 bp, Homo sapiens
tttggtagcctctgaaataggattaagggaaaaaaagtgacaactgatatttcaagttgctacagggagtttccagatgagctaagagtcatttttcagtatattttaatctgtcaattctaatgtaatatgaactctgacaagacatgctacagagagaataattcctgcattattcaaaagtaaaatgtaaatagtaaattatttcattttttaggaaattgtggaaaacattgacgtttataaaatattatgttttcagggaaaatatatgtaatcataagtacctgcattttttttctgttagatccaccagatactcctcaacaactgaattgtgagacacatgatttaaaagaaattatatgtagttggaatccaggaagggtgacagcgttggtgggcccacgtgctacaagctacactttagttgaaaggtaatgataactgggaaaagatgtcagatggcaaggagtacgttggaagtgcatgttaaatgacatagggaactgcactagatcatttatgttacaaacaagatataaaaccaaatatgctgtataaaattacacttataagcactgcagttcagccacatgtacactcaattttatgtctcctcttttaagaagcttagaatgaagaacacttgaacatgaacagagactgtttctcggtagtaaacttatggctgattaatttcttctattttctgtatcacatacattttcttctctgagtatgtaatatgcttctaattagaaatttaaactttttatacaaattaagtattacgaatttgcccgttttttcctgcaatatttatctcttgccattttgaaattatttttctgttaattaacagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaaggtaagctgtacata

SEQ ID NO: 37100 - DNA, 1027 bp, Homo sapiens
ccacaggccaaacagagaggaagttagttctggccccctgctcccctgggaggtcacaataaacaaatagtagcaaggctgtggtttttgtgcaagggagtggacactaggagtatgaatgtctagaaaggctgtcagaggaggtgtaattctggagtaggcacagtcagttttctcagcagaaaaggaataggaggacattctaccctgaaagaatattgagtacaatggcttgaatgtatgagatggcgtgatttggagaattcaggtgtttttgcattgctgatgcctaaagaagcctcaccatgtgagaggtttagaaggagatgagctggacccattcaagtccagagtcctaagcacccagccctaaggctggggctgggtagttggtgggggcaggaatgcaagaggcatggaaagtcctttcagtaaagtaaacatttgtataagaagtttgaaacatatatgaacaacagtataaggaatataagcatgctctggagagatatcaagggctgtggaacaagagaggaaaatatcattttgcctaagagataccaggggaactggaagcattttgaaaacagaactgaagaggaagttctgttaagaagaaaccatgagccaaggcagaggagcaggggagttgccagtttcatttccttcatcagcatccgttgaacatcatcctagcatgaggagcgctgtgatgcactggtccctcagtgaaggggtggagtgtgagtagtggaagtcagcctacaaagggaaggttgaggtgggattttgaaaggcatgcaaaaactccagctgtttggagtcatctatgcttattctacttttggtacaatgaggttgtttttcctacccccacattggtaaagttactatcaatctgttttttcagtcttaaaatgcggtacaacctatcatgtttttgcaacaaagagggcataaagtattttccattgtattttgtgttaaccaaatttttatgaaaattatactattaattttatttgct

SEQ ID NO: 37101 - DNA, 1055 bp, Homo sapiens
acagatgtgaaaatctttggatgccaagtccctaatataaaatggtgtggtatttgtatataacctgtgcttatcctctcatatgatttaaatcatctctagattactttaaatcatccctaatacagtgttaatgctatgtaagcagttgttaaacggtacttttttttttactgtttttttattgttgtactgttgtcttttattggttttgttttctgaatattttcaatccaaggttggttgaatctgtggttgcagaaccctgggatatgaagggtctatggtagtatttttatttcattcttaaaaaaccttaattactgatgagatgtgtgaagctattgagtactgcatagcttcccaaatcttggaaaccagcaccctcatttccatttctacattgatttgtttgggtagtacttgtgttttatcccagcaattactagtccctccctctcttcaccaaagataaagatacgatgtcacacaaaaaaatgtagcatgagcaaatattgaaactgtggactaccttgaactaacggttttcagagtgttggacagatgtcactttatttccttcaaaaacttagatattctgtgatagctctgtcagtttgctttggtgtcttggggtgcctcagtgcagtttgggagccagagctttaacttgggttcctagtgttggcagtacctgggttagcatgcagcctaacaatgaaagtatactgtgtgggcatataataatttgtgccttggtattcattcagccagctggcttagagtttttggtgtctgctttgtgccaggtactgcttggacactgagggttacagtgaactcggatgtgtttgctctcaaggatctgacggtctgtagggagaattataagattaggaagtgaagcagtagagcagaagtcagcaaactctttctgtaaagggccaggcagtaaatattttaggctttgtggaccattcaatctctatcctagccactcagctctaacattgtcatgggaaagtagtcataggttatacttaaactagtgggcg

SEQ ID NO: 37102 - DNA, 1096 bp, Homo sapiens
cctgaaataaggcttagttagtattggcctgaatgttttgtgtttttttttttgttttttttttttactgttactttgaaaaatatgtatgtataccttatcatatctgcctatatcacttactttggggagatactcagagctttgtggttatcagtatactaaaaaaaaaaaaaagtctacgcttaaatttatagtgctatttggtttctccatgatttcactgacaggtctaatacattttctttgagtacttgtttgtaaaaagtagactttatggtgaaaaatacatgcagtgccaagtgattaacttaagtgtttaaaaatattaaattatagcagaagaggttaggaatgatatcagcagtaatagaaataattgagaaaatcatctataaataatagatattacagactatagaataccaaaataatgtcaatactgtagtttttaaagattttaggattaatcttagtccatataaatttgtactattggtaattattgaataattgggaggaatctgggcagttgtgctggttgtaaactatgaatttctaatcgtaaagtgaattgttatttctaattgaactttttttcaagaacagatttcagcctcacatactaagtaaatactgataaataaggaaattagaaatttagtattcataattaaatatgctctaaaatttcctatacttttatttcctgtttattcttaggtagattggaagggggaaacagtctgttctccctaattaaattttttctaataacgattagtagaatatggacattctatatgacagtgacattaaaagaggctctttggaagtatatacattattaacataatgtgtacaagtccttttgaaatgacaactttaatgggtttcagctcttttatctagagcttgagataattcaagctgagtttttcagggcatatcacaacggccaagtgttcagcagtgggatatcaatgcttatttacattttcctactgctatttatataaaatgttattccattcagaggatgccttttatccccacattaaagcacagatcattaagcaataaaaaccaaattgtc

SEQ ID NO: 37103 - DNA, 1192 bp, Homo sapiens
cacttggttctctgtaagtatattttaagattgggaattcatttcttacaaggtgaatttctcctgcttatagtaatttaaagaagaaccactaggaatctgtagtaattgagtaagcatccatggccaagtctcctttttccctttaatttcatcctgaatatttggagaatcaaaagaaacttcatgtaacctgtgccatagtgggtcttataataatttttctttggaaataacaggagattctcataaattacataattttacattttattcaagtccaaactctgggtttcaagaaagatattttcaagtagctgaatggtttaaccgtttatttttaaattttttcctctagatgactaaaaaaaaatttcctgaaatgtgatgtcactaatagttatcatgaatttgtcattttatatgtgtttttattaattgatccttcaatcataggtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggt

SEQ ID NO: 37104 - DNA, 1025 bp, Homo sapiens
gaggcgggcggatcatgagatcaggagatcgagaccatcctggctaacacggtgaagcctgtctctactaaaaatagaaaaaacagccgggcatggtggcaggcacctgtagtcccagctactcgggaggctgaggcaggagaatggtgtgaacccgggaggcggagcttgcagtgagccgagatcacgccactgcacttcagcctgggccacagagcgagactccatctcaaaaaaaaaaaaaaaaaaaattaaaaatacagcacctatataggctacttacagtgcatggagcttatgggactaatagtagctctggatgagtcaatgtgtgagaagtgagtgaatgttaagacctaggacatgactgtacactactgtagactttacagacttgtatacttaggctacatttaatttattaaaattcttttcttcaaaaataattagcttactgtaacctttttagtttataattttcaaattttttaaacttttgactcttttgcaataatatttagcttaaaacacaaacacattgtataggtgttcaaaatttttttggttttatatccttattctataagatttttctgtttttaaatttttttactttttaaacttttttgttaaaaacaaaaacacaggccaggtgcggtggctcacacctgtaatcccagcactttgggaggccaaggcgggcagatcacctgaggtcaggagttcgagaccagcctggccaacatggtgaaacccccatcgctactgaaaatacaaaaattagccgggcgtggtggcaggtgcctataatcccagctactcaggaggctggcggcaggagaattgcttgaacccgggaggtggaggttacagtgagccgagattgtgccactgccctccagcctgggagatgagcgagactgcctcaaaaaaaaaaaaaaaaaaaaaaaaactcctcccccgccaaacacacactagcctaggcctatacagggttaggatcatcagtatcactgtcttccacc

SEQ ID NO: 37105 - DNA, 1043 bp, Homo sapiens
ccctggagcccttttataatgattcatcattagaaacttagaggggtggggctgggtgcagtcgctcatgctaaggtgggtggatcacctgaggtcaagggttcaagaccagcctggccaacatggtgaagccctgtatctactaaaaatacaaaaattagccaggtgtggtggcgggcacctgtaatcccagctactcgggaggctgcagcaggagaattgcttgaacccaggaggcggaggttgcagtgagccaagatcgcaccactacactccagcctgggtgatagagcgagactctgtctcaaaaaaaaagaaagaaacttagaggggtgggagtcttctacctttctattgaagtaagaagagaaatatcagcattataagttaaaaccttgaaagcatttgtctcgtggaaataacttcctaaataatatttatattctgtagtactgtttataagttaaataaacttttgtgtacttgtaacattatttctgtgatgtatttccagttccaaataactgattgaaaaatgatcttttagaacacattttttaatgaggtgcaacagcctgttttccatattagcacagagtatgatcttttgagactatatcttatctgtaatttctcaaactactctcagacatcaaaatttgcgaaatagtattttgatactttaagcaaataagcttacctagtatgtttcgatttgaattttgatcctgaatctaaagagaacatagagactgttcataaatatctgtacgcttagctggaagtacagggaactttggagtcctataagacattttaaagaatgttttccctaacatgtcataaaaaatttgaaacatacagaaaaattgaaaaaactatacagtgaacacccatatacttccacctagattttactgtatttgctgtattatatatctgtccatcccactgggcgttcatcagtccatctatgttattctaatatatcttaaaggaagttgcagacatagtcctcttcactcctgaacactgcagcatgc

SEQ ID NO: 37106 - DNA, 1062 bp, Homo sapiens
ctccttggactagttttcttaacaataagctttcagttgaaacttcaggtggcagggaaaaagcagaggtaggcctggtcttaccagggcaaccacctaacgtggactcaacaccatctagtggtttaacagaaagaaggctgaaccttctgtggagacagataacaccatcaaatctttgcaagtttttatatacaatcaaagactaaggagctaccaaaggacaggattacatgactagaacaaaagggaaaacagttaataacagatccagagatgatccacatcattcaggtttattagatgaaacctattttcagtaacaactatgtcatgaacatagaggacgtatggagaaaattgatgtgaaatgaagaatttcattagcacattggaatggctaaaaggattaaatggaaattcaagaagggaataatacagtatctacatttaaaaactcattagatacatgtaatagaagattagacacatcagaaaacaggttatagaaaatattcaactgaagcattgagataaaatggaaaaaaaaaaaaagaggatttacggatttgtgatacacatgagaagatctggcatacatttaattgaattaccagaaggagagtttggacagaagtagttttgaaaatatattgtatagaatttttcaaaactgcagaagtagatcaacccagagatttaggaagttttgtttaccctaagcaggatagctacaaaggaaaccacacctagaaacattgtaataagattgctggaaaccaaagataaggaaagatgtctttaaaagagtctgagtgagaggccgggcgctgtggctcatgcccataatcccagcactttgggaggccaaggcgggcggatcacctgaggtcgggagtttgagaccagcctgaccaacatggagaaaccctgtctctactaaaaatacaaaattagctgggcgtggtggcacatgcctgtaatcccagctactagggaggctgaagcaggggaatcgcttgaacgtgggaggcggaggttgcggtgagctgagattgcacc

SEQ ID NO: 37107 - DNA, 1022 bp, Homo sapiens
taaggatctgtattagtttgctaggtgaggatggaatgctgtgagctgaattgtgtctcgtcaaaattcgtatgttgaatttctaacctccaatacctcagaatgtgactgtatttggagatagggcctttgaaaaagataattaaagaaaaatgtggtcatatgggtgggtgggcctaatctaatataatctcttataaaaagtgtagattaggagacagacatacacataggaagatatagaaaatagccatatgtaaggcaaggagagagactttaaaaaaacaacaaccctgccaacaccttgatcttagatttctggcctccagagttatgaaaaagtacatttctgttgtttaagccacccagtctgtgacatatgttatagtagccctagcaaactacatacagtgccttaacctttttcttaccatatttgttgcaaatattttttactaacacattgtcacttttaattttaggtatatggttggttttttagaggtatagaagttttatctcaaaacttagaaaattttatgttattttaaatatgtatgtataaaaacgcattctcttaaatttgtaactactttcaacactgtacaagacagtaaaaacaaaagaaaaacatactctttgaaagtctgaggcctctttgttcgtcatatcagaattttaaggaataccagtattgtaatatcagcagtgttgcaatatctgatagcagctattctagtcctgtctcctaccctattctgtttgggaccccctcccctcccctcctctcctctcccctcctctcccctcctctcccctcctctcccctcctctcccctcctctcccctcctctcccctcctctcccttccccttccctccccttatttcctctaaagaaaaaattggacaggaaatttttacagttatcctaccaatagggtagtgaacttttatcagctttttcttagggtccatgcttctcgtggatgtgatgtgatatgttgatcactttggttgctt

SEQ ID NO: 37108 - DNA, 1033 bp, Homo sapiens
agcaaacttctgcctggacatgcaagcattttcatacaccgtctgaaatctagatggaggttcccaaacctcaattcttgacttctgtgcacccacaggcccaacaccatgtgtaaattgccaaggcttggggcttgcaccatctgaagcaacagcctgagctctgtcttggccccttttagccacggctgggatacagggcactaaagactacacaaagcagcaagtccctgggccctgaccaggaaaccactttttcctcctaggcctctgggcctgtgatgggaggggctgccatgaagatctctgacatgccttggagacatttttccctattgtcttggtgattaacattcagatccttgttacttatgcaaatttctgtggccagcttgaatttctcctcagaaaatgggtttttcttttctgttgcatcatcaggctgcaaattttccaaacttttatgctctgcttcacttttaaacataagttccaattccagattgtatctttgtgaatatataaaactgaatgttttaaagagcacccaagtcacctcttgaatgctttgctgcttagaaattttttccaccagataccctaaatcatttctctcaagttcagagttccacagatttctagtgcagtggcaaaatgctgtcagtctctttgttaaagcatagcaagtatcacctttattccagttcccaacaagttcctcatctccatctcagaccatcttagcctggacttcattgtccatatcactatcagcaatttggtcaaagccattcaacaggtctataggacgttccaagctttcccacattttcctctgtcttctgagccctctaactgttccagcctctgcctgttacccagttccaaagtcacttccacatgtcgtgtatctttacagcagtgccccactctctgtggtagcagtttactgtgttagtctgttctcacagtgctataaagaactgcctgagattggataatctataaaggaaagaggtttaattgacttaca

SEQ ID NO: 37109 - DNA, 1048 bp, Homo sapiens
aatggcgtgaacccgtgaggcggagcttgcagtgagccgagatcccgccactgcactccagcctgggcgacagagcgagactccgtctcaaaaaaaaaaaaaaaaaaaaaaaaagaattccagttgctccatggcctctccaacatttgatgttgtcattcttcttgattttagctattcttataagtgtgtaatggtacttctgtggttttaattttcattttcctgttaattaatgatgttaggcaccttttctcatactttttggcctcttatcctcttttgctttcacatctatttaaatcttttacctgtttttacatgggttattttattgttgatttgtagatgatagtcatatattggttattaaaatcttgtctgatgtttgtgctgtgaatgttttttacccattttgtggattgtcttttcattttcttaatagtcttttgatgagcagaggattagatacttatgtcagataattaactttatactaattaagactgctttctattgttctgtatacttagaaaaatatttaacactgatatgtaaaaatgcttctgcgggatggaagtgttagtaattttttaacattttctttggcttttttatttttcaaaatgtctacaaaataatgtaacatcagaagtactctaaaaaataaactttaacataaatatgtgtaacttatggtgacattaatatataatactctggtgaatactatatacgtgccatgcaatacatgataatgaagcacatataaaacacattacacttacatttattatatttattttaaactgctttttccatttttacttataaaagcaatgtagagagattaattattttaatctagtcacagccaggaagtcttcattttttttcagttcctctcattttgtgcatgttttttatactcatttagagaagtaaaatatagtccaagatataaaaataaatcatcagtaatttttaccacctaaaattaacttctctgaaaatatttttgaagtatatactttcctaattgcaagaa

SEQ ID NO: 37110 - DNA, 1038 bp, Homo sapiens
taaaactgacgtgacctaaactcatttcatacagcaaagcctgactggaatttgatttcttaatttgtctcagtgtgtctagtcatatgtttttcctaaaagaaataatagtttttgaataggtaatgttgtacaaaacactaattttgtataaaaacaggataccattataatgtagtctacgtaagaggttagtaaaatacatgaactaaagcaggggtccccaaacccctggctgtgcaccggtaccagtccgtggcctgttaggaacggggccacacagcaggaggtgagcagcgggcaagcatacattaccacctgctctgccttctgtcagatcagtggctgcattagattctcataggaacatgaaccctattgtgaactgcacatgcgagggatctaggtcgtgccctccttatgagaatctaatgcctgatgatctgaggtggaacaatttcatctgaaaccatcccccccacttgaccctgtccattgaaaaactgtcttccacagaaccagtccctgggccaaaaaggttggggactactgttctaaagtgtctcagtgatacttgatgactacttggatgtgagtagattccagggagtccagaatttctaatagtaatattatttgaagatggaaatttttttaagtttttttttaagatgaattaatttgattacaggacatgctaaatttgaggtggacacaccacaaaacatacagactgaggtgtgttgcttttaatcatagataaattttagaatcgaacttttgaggcattgacttaaagggtaaaattgaatttgttagagttgatagagacagggaaaagagaaacctgaggaaaaggatatagtacttcaggtaatttttgttgtctttgttgttgtttacatttaaaacattttttttccctggcaaccttcatttaactcaaagctttaggtaatgttaaaggatatggaacaggaggagggaatacaaatctttaaaccaagtcataaggaacagtgaaggatagttatgaaa

SEQ ID NO: 37111 - DNA, 1354 bp, Homo sapiens
accatgtcgtcaagtacatcaaacctaatatgtttcaaactggctaattatctcattattctaaaaatctttctgggttaagagaagtactttaattgggccaaataagacacccaggagacatcttaacctcgttccttgtccttattccacatatccaatctgagaccagatggtaatgattttatctctgaaatacttgcaaatctgttttttccatttctgttgccatgcctttattcaggcccttattatctttcctgatgattctattgacttcgtaactactctccctgttctagttctgttcttttccaatctgttttcttctctgtaaccaacaaaaagtttcccaaaaagtcaatcttccctcgcagtgttgaacatcttctttatttgggcttttataatatattgcattttacctttcttacaattggcataattttattcacatgtctgcctctctgtcacactagacaaatatttgttgacctttactgtgtactgggtactgatcttttgctgctgattcagtggtgaaaaaaatatattgagtccctacctttgatggacctatagtctaggggggagaacacagtaaacacatgagtgcagaattttaggtactgataaatgctcttaatagtgtaaaatcaggtatgtgaaaaagagtggggggggggaattgtcagagaaagcttctcttaagtagtagtgtttaattgataccgaggaggcaccatgtaagggaggaaagtcttcaagtagaaggaaaaactagccaaaaaaatgtgactatcaacgagacaggaaagaaccagtatggctagtgcttgatgaatgagagagagagtatgggaatatgagattaggagagacagggagacaagtaataacttggagagggtggtacaactgcaaagggaagtcattagagggtttcaggcaggagtgtgatatggtgagataatttagaaaaatcactctgccccttggacaatagactgtagcccttggagcaggcacttcatagcacatgccattaaattaatgttaactgaattaataagtgaatgaatgaattctttcattcatgttacaagacgggcaagattattccatttgaatcacttgaaactgaagtagtgtattgtttttcaagacgagatagcaaaaccaaacattgtagaaatgatagttgtattaatagatttccttgtaagtgatgtgtgtataaccctaattactttaatatttttgagttatcaagtaatgcctgattactaattttaacaacagctcttttcactgtgggtggaaatgctgtatttaatgagtatataacatagag

SEQ ID NO: 37112 - DNA, 1712 bp, Homo sapiens
gagagagagaggtggggttcagaagcctttctttgtttctgattctaaaacccatgcacttacccctttgcagtcttcccaaagacagcatcatgtataagataaatcatatgactaagactaaatgagtattctatgtattgtagagtattgatttggaacccccaggaaccaggttattaactgagatccgaaatgtatattttagccatttctatacagttgtttctagagctggttcctgttcttttctaacttgagaaaataccaactattaacttgagaaaaagttaaagtatgttaactttttctccttggctagggtcatcattatgaatattgatttttgtgttggggtggggtgaagacaatttattactaccctctgtaatacctcaccgctcttttgattcctgtatgcttctacgtttctttcagctgtcactttacaatgcagttattatccctatatttaggagtcctttaattctttgttttttacttttattgtgctgtagaatggcaactgttaagtgtggacttacgctaatatatgtaaaataggataaataggttgtgatgaagaattaagagtctctactatgcataacatgtgaataaacttggtgatgatacatactttgaatttttattgtcattttttggagtgcttacatttgagtacaggttttccaaataggtaattgcctcatagcatagttcagagtaggtgaagtatgacttgatatggagttggcttatacgtatgtaatatggatagtaggattatatgaagatagctaataagttacaaaatataactaatatggacaaaataacatctaataaggtactgattgcatgatatgaagacagtctagtattgactaaaagcatggtgtcgtacccagacagatctagatttgaatcttgatcctgcctttgagaagttaagggctctgctggacaagttgccttttctgagcgtgtttcttcatctccttttgagataacacttatttgaggattgaaggaaatgtttgtaaaatatttattacatttttagcacatagatgtaaagaaatagatattacatattcttatttgtatggtcagtgaaagcaaaagagatgagaatggagagattgatgtgagctggaaaaaaaatcatagaaagtggaggattgtttcaaccttggatgggtagaatgtggttaaatctagaggaaataaggcataaataaaggcatgacacattttactgaaaggaaccataagaatatagaattttagtattagatttgtaggataagggtaagttgttgaggaccttcagaactgcagggaaaacagtaaatgttatataaaaactttcctttattgaaagatagcatagatccaaaaagtctttgttataaatgtacaattctgagaattttgacaaattgaacacatggggaatcagaacccagatcaagaaacataatattgcaataccctggaagctcccattctgtttccttccaggcactactttcccagccaaggaaggcactatcctgacctctaatgccatagattagtttagccgccggtttttgaactttataaaatgtactcatgcagtagatgtactctttttgtaaagttcaaaaacaggccaaactaatccatggtgataaacaagagtgtatgctctgttgtatctgcct

SEQ ID NO: 37113 - DNA, 1048 bp, Homo sapiens
agggacctgtggaagtttgaacttgagagtgatgacctctggtatctggcggaagaaatgtctaagcagcaaagtgttcaagatgtgtcctggatgctgctaacagcccatgctaagatgtaggagcaaagaaatgacttaaagttggaatttgtttttaaacaggaagcactgcataaaggtttgggaaatttgcagcctagccatgtggcaaagaaagaaaaagctttttcaggggaggaattcaagcaggctatagagcaaccacgtgctagagatatttgcataattaaacacatgccaaagtgctgatatccgtgaagttggagaaaaggccttcaaggcattttagaaaccttcacagcagcccctctcatcataggcccagaggcctaggaagaaagaatggttttgtgggcctgggctagccgggccttgctgccttgcacagcctcaagacactgctccctgcatcccagccactcaggcttccagccttgttcaaaggggcccaggtacagttcgggctgctgcttcaaagggtgcaagccataagacttgatggcttacatgtattattaagcctgcaggtgcccagagtgcaagaactgaggcttgggagcctctgcctagatttcagaggatgtatgagaaagcctgggtgtctaggcagaagcctgctgcaggggtggagccctcattgaggatctctattagggtggggccaaggggaaatgtggggttggagccccccagagtccccagtggggcactgcctagtggagctgtgagaaggggcctaccatcctccagaccacagaatggtagatccactggcagtttgcatcctatacctggagaagccacaggcattcaactaaaacctgtgagagcattcctgggggctaaaccctgcaaagccacagggcagagttgcccaaagccttgggagcccaccctttgcagcagtgtgccttgaatgtggaacatagagtcaaaggagattattttggagctttaagatttaatgactgccctgctgggtttt

SEQ ID NO: 37114 - DNA, 1072 bp, Homo sapiens
gagatctttccttatcccagtgggaatttattgcttccttctctgcttttttacgtctttatttattattttctaaattgcagttaccattgtcttactttagttctttgtccagtttcttcccccttcactagatctttagcttcttgagggcaggaggcctgttttacccatttttaacatccgcttcccccagcatccatcagataatcactgaggcattaattgactggaagaagggagtgagagacatgggaaaaagaatagtacagtattaaggagattagaaggaaaagagtactttaagattactgtcctaagggacaatgaaattgatggtgccataaaatggagaagtcattttgggaaggatgataatgagttcagctttgcaccttgaatttcacgtgattatataaatgtgtaaaaggtggcagcaaatactggaatggaggttttagttgccctgaatttctagtctgattgttctgtgtgtaagatgttgagaaaagggatataaatggaaaaagagctgaagatttgaatgtatgaaaatagataagatgatgagggtgtatatcatagggtaggaatcaataagaagaaaggagtcaatagaagagaagagagaaaattgtgatctcttaagctaaaacagtttggatatttgtccccacccaaatctcatgttgaattgtaatccccaatgctggaggtggggcttggtgggaggtgtttgggccatgggaatggatccctgatggcttggtgttgtttttgcaatagtgagttctggcaagatctggttgtttaaaagtgtgcacctaccctcttactctttctcactcctactttgccatgtgagatgcctactcctgcttcaccttccatcttgagcagaaacaccctgaggcctcccgagaagcagatgctggcaccatgcttcctgtacagcctacagaaccaatagccaattaaacctcttttaaattacccaggctcagatgcttctttatagcagtgcaagaacagcctattacagaaaattggtaagtgggcgtggagcattgct

SEQ ID NO: 37115 - DNA, 1080 bp, Homo sapiens
gtctgtaaaagatgtaattagtgagtgatttaatttatatacaggcatatgtgttttagatgaaggtgaagggagcccttaataaacttgagtttaacttgtgcattaaaaacctgctcagatgtggtgctggaaatatatagttgtattttaaattgagttcgtcgagctcctatatatagtggtttctctgcttggtgtcaaaaatgttgagttgtggaagagcttaggtacacatctgatttgataattttggcttactccagttttactgaggcacacaggtaactgtttactatttaaaatgccatattaactgagaatttagtaagcacctatgtccataggtatttccaggttaatatagatagtgcagaaaatgctgttttcggcttgccctgacaaaatgtacttcagtttggaataaagtatacacagccatttaaaactgattgcaaaaataaagagtgagggattgtttgagatctgtatttctaaatcataaggaagtttggaattaatctgaatcagtcattttatagtgatactattgttttaaaaagttgctgttgtgacagacatttcattgttcaaagaaggcttgaagaaaattcatgaggaattaaagtttagtaataatttgagaactgtgaggcagtttgggttgcagctgaagggcagctgtttgtggattagattacagtatgtaaaaagataaagtttgggcaaccaaaaatttttttgtttaatgccaaggcagtgtttgcttttattcttattttttaaatttaatctttgagagattcattgtgtagttacctaataaagctcattataaaatagaggacatggtcattgtaatccctaaaggatccatcaatgtgtagtgaaaagagagttgactataaagtcaaatcattctggattgtaacctcagctgtgagatttaatagttgggtgatttggggcaagttatttgaccttgctttacccctgatttcttcatttctaaaataagagataacttcaaagggttaagaatgtgaaaagtaaatgagctagttcttaattaaagtactt

SEQ ID NO: 37116 - DNA, 1091 bp, Homo sapiens
aagacagtcctggtggtgacaaaatctctcagatttgcttgtctgtaaaggattttatttctccttcacttatgaagcttagtttagctggatatgagattctgggttgaaaattcttttctttaagaatgttgaatattggcccctactctcttctggcttgtagagttcctgcagagagatccactgttagtctgatgggcttccctttgtggataacccgagctttctctctggctgcccttaacattttttccttcatttcaaccttggtgaatctgacgattacgtgtcttggggttgctcttcttaaggaatatctttgtggtgttctctgcatttcctgaatttgaatgttggcctgtcttgctaggttgtggaagttctcctggataatatcctgaagagagttttccaacttggttccattctccccatcactttcaggtacaccaatcaaacataggtttggtcttttcacatagtcctatatttcttggaggctttgtttgttctttttcattctttttttctttaaccttgtcttcgtgctttatttcattaagttgatcttcaatctctgatatccttttttccacttgatcgatttggctactgcacttgtgtatgcttcacgaagttcttgagctgcgtttttcagctccatcaggtcatttatgttcttctctagactggttattctagctagcaattcttgcaaccttttttcaaggttctcagcttccttgcattgggttagaacatgcttctttagctgggaggagtttgttgttacccaccttctgaagcctacttctgtcaattcgtcaaactcattctctgtccagttttgttcccttgctggtgaggagttgtgatcctttggaaaagaagaggcattctggtttttggtatttttagcctttttgcactggtttttccttattttcatggatttatctacctttagtctttgatgttggtgaccttcagatagggcttctgtgtggacgtcctttttgctaatgttgatgctattcctttgtgtttattttccttctaacagtcaggcccctctgctgcaggtctgc

SEQ ID NO: 37117 - DNA, 1047 bp, Homo sapiens
taattccttaggaaagtaaaactacacacactttcagagaaacaataagctgcttagatttttaaaattttttatattatacacttcaattatgggttatttattaaagacttcaaaaaatttatgttatgtttttaaaagtaccaattagtgagggaaaaagttgaaaatattcaccagcatgttaggttctcctgaaatcacagttttctggataaataaatgtaatatcactaaacaattttcactatgtattttatacatagcctggaaagaacagtattttggactgtaattttcacatcttaaatagtatttttttctttatccctttgataatactaaattctttctcttaaaaatttatatctattttatagatatcaatcttactatgaattttcaactttgactcgaacttgtttatgaaaaatatctaacatctgcaacttcagctggttatactggaaggagaggggttgcgataattttattataccttgtattaacaataaaccttctcacagagaagaaaatactttaaataccttaaatcgtatgtacaacaataaaaattcacatttcatgctttagtgagacacttaaatcatccataaggcagtcctcatagtttattggaatagagcctttctaatatctgggcctctgctgtgtgccaaatacgacaaagctctggatgttatgacagcagccaaacttctaccatcctcctatctagtagaaaaacggagggtaggtcttcgcagccatcaagttgtgaccacaatcctctgtcatagtggggtagcatccgacgtgctgcaggcctcaggacccacgtgagtcaacttgattgtttgaaaagtgctcaaaagccaggatgttctctaatgtgagttgtaggatgatgatagcccttctgagcacagctaaatgtgacatgtatgtgtctattgcacaggattttataagggtccagaaacagtactgtatttctttccttgcctattatatacatttttctgataagttcagtgtttcactggg

SEQ ID NO: 37118 - DNA, 1054 bp, Homo sapiens
cccaagaacagtatattttttgaagcatacttggtattttcatactttacatattttgcaaacatgtttggagtataagggtatattattgtggtttcactgctatttcttcatttttaaaaatttaggacattaagtactggtatactgatgagtataactataacttaggtctcttgtatttccccaatatatttactacttctttcttcattctcagtataattataatttaggtttcaatctatgtttatgatgatgatgatgattattattaaattttagagacagggtcttggtttgttgcccaggctggtgtccagtggcaccatcttagctcactgtaacctcaaattcatggctcaggagatctgcctgcctcagtctcccgagtagctaggactacaagcacatgcccccatgcctggctaatttttcatggtttttttttttttttttttttttttttgtagagacagggtctctcactgtgttgcccagacaggtcttgaactctgcaagtgagaccatgtggtatttggttttctgtttctgagttagttcacttaggacaatggtctctagttccatttgtgctactgcagaggacatgatttcattcttttttatggctgcacaaaaggagtttgtgcaagcaatcctgtctcagcctcccaaagctttaggattacaggtgtgagccgctgtacctgactgtatattcattatttgatatgagtatacttattacacataatttagttcaccttgtatattatgtttattttgccttttttccacctctctttgtttttcatggagtcaataattgccttttttaaattcattagtttcctatgtatatttttactaatttttctaatagaactataacactccctttgattttgccaaacatcaaataatctattacttttccttctttttcttttttctttgtttttttgttttttttttgagatggaatttcgctcgctgcccaggctagagtgcaatggcatgatctcagctcaccgcaacctccgcctccggg

SEQ ID NO: 37119 - DNA, 1302 bp, Homo sapiens
taactgaacagtatagcccttttagttgtttgaaaattacataatgattcaaaagcttgtttcactgcctttcccagcactaagaaaattaacaatcatttcttttaatttccttgaatcagagccattctaaagtgactctggaccagcaattctgagctatgatttcatgatacatgtattaatatctaaatgagttgtgagttgacataagaaccatagttccataataattatcttcaaatcaatggatatcttaaatgtgtttttttcttccttagagattattattaaactgatgtatttgataataaagaattttaggactgagaaagttaagtttttcttaccaataataagatattgaaatatataaattataaaacagaaataaaatgaaataaaggaggttatccctaaagtcatttaccttagtcacttgcaattaaatatggttacttcggaagaagaagtgtggccctaaagctactgtaacatgaatcatgccctaatgtgcactatatatgaactactttggtcagaaggcagcggcgggtaaggatggcttcctctcacagtgcttcttaggctatccatttaccaaggaattctaatctctttctctcacttcaccaggaaaggagggagtttaagatatagaactgggcatgctagcctcttttttcccttttgtggatttgtcataactgcagagaaccgatgttgtggtctcttgccagctacattgtgaaccttgcagtgaaagttctttgcctctgcaaagggagatttgtgcttgtgcagaactgcccatgccttagtaagcaggtctgtctaattctaagttcaatatctggtggctattgttggcataaacttaaagtacatcctctaacctagcctttttcagcagtaaacttaaaatattgaatctccatctgtctgtgtctcaagtggttcagaggtcaggagaggagagggacattattttatgactccctcaaactttaacaaagactagtgcagattatatttcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagta

SEQ ID NO: 37120 - DNA, 1114 bp, Homo sapiens
aaaatacaaaaattagccaggcatggtggtgtgtgcctgtagttccagctactcaggaggcaggagaatatcttgaacctggcaggtggaggttgcagtgagctgagatcgcaccactgcactccagcatgagtgacagagtgagactccatctcaaaaaaaaaaaaaaaaatccacttgtaaatttttagtttagttaattactgtagacattgtttgagtcaagctgcattatcttttttataattgaatagtacaaattcttgaattatagtctttataaatgttgtatgttgacacttaagaattgagtttttttcttgaaaaataaagtttgtttatgagctttattattgttctgtttttttttgtttgtttgttttttgtttttttgagatggagtctcgctctgttccccaggctggagtgcactggtgtgatctcggctcacttcaacctccacctcccgggttcaagccattctcgttcctcagcctcccaagtagctgggactataggcgtgtgccaccatgtctggctaatttttgtaattttagtagagacagggtttcaccgtgttggccaggctggtcttgaactcctgacctcatgatcctcctgcctcagcctcccaatgttccgggattacaggcgtgagccactgtgccttgcctcacaattttactttttgagtctatgaatttgcctgttttagagatatcgtataagtggaattatgcagaatttgctttctgtgactggcttctttcacttagcataatgtcctcaaagtcccatccatgttgtgtattgtagaatttgcttcttttttgaagctgaaaaatatttcattttgtgtgtataccatttgctttgttcattcttcctttgatggacatttaggttgtttctacatattggctatcgtgaatagtgctgccatgaacctgggagtgctaatatctctttgagatcttgattcttttggataaatatccagaaatgagatagctttattacatggtagttctaattttaattttttgaagaaactccataatggctacaccattttgcatttttactaacaatatacaagggttccagtttctcc

SEQ ID NO: 37121 - DNA, 1007 bp, Homo sapiens
ttccttttgctctccagatcaacaatcatctgtgtttgtggagctgttgccagcttaacatagaccttgtatttattcttctttcttcatggcttacttctgtttttccctcactcttgattgcgtgggatcctatccactcaataaagatttagccagtaagctttggcctcaggctctgttttccaggtaacccaaattatcctggatttctttctttttttcactcataccaagtccaagttgagccaactgtacattttcagtgtgttgtaaatcttttttcctctttctgttttcacttctatccttatctagggttatctcatacctaaattactttggttgtctcatatctagccttcctgtgtacatttttgtacccttactgtctattcttctgggtctgactgatcttttaaaaatgtaaatcaataattcatgtctcactgttgtataaaaactctgtggattcttcatcacacatacaattaaatccacatgcataactatggcttattgtattctctgtgatcatggcttcggcccacctccctgacctctgacttcctttcctctggttttatttcctttccacaaaacatggtttggtcctgccccaggttcttccctttgcctggaatggaccttctccagattttcagttgtctgaccacgttttgtcactcaggtctcagcttgaatgcgttcctaggaagacctttcttgaccgcccattccgaatagccacttggtcactccctatcacattcctccatttgtcttttatcacggcacttatattttaactgtttgttatctttctttccctgtccccttctaacatgcatacactttagaaagtaagatctggaagaatagtagggaccttttatatcttgttgggtgctgcatccttagtacttattactagaattctacctgtcccagggtaggtgcccagtaaatatttataaagtgaataagctgttaactatatagctcat

SEQ ID NO: 37122 - DNA, 1064 bp, Homo sapiens
aaatatttactggagtcacagggggttatttcttagtagaatgactacactatccctagagggaaggctacttcagaccttccctagaaaacctttaaaaatagtttttgaagggttcaaactgatactttcaaactttactgcctgccagaatagagcctaacatttttagtcaacagtgtaacatttaaaatattcagcatctaatcaaaaattactggacatgccaaagagttggaaactgtgacccataaataggagacaaatcagtcaatagaaacattcagaaataacatagatgatggaagtagtggacagagagattaaaatggtaatacaactatattcagataattaaagggaaacaaacataatgaggagtgaaatggaagatatattaaaaaaaggaacatctagaaatgaaaaatacgatatctgaaataaaaaatatactgaacagttatgctagtctgggtccttctagaagcatatgctaagaccggcttaaacatgcaaagatttcattaggggaatcactgtatgagaggacatggggtgggaactgagtaaatctgggagagctatgcttgtctaacccccagtgaaggggagagggagggaaggttggatggaaatgtcttaggctgtcatattatctaaagaaagttggacaataccttggatagtcgtcaagtcagagttgtccctcattggagtcccatgcccctcgggaatgagctggtcttcttatttctgctacttccagttaatgtggagaaaagccatgagatatttatccttgctgcatatgtggccatggatttcggagtgtagaagctgaggtcagctggaggtctatgcaagataatggaatgacatcatttagttttgaaggaaagtaaaactgccaacttagaattctttgtattataaaaatatctttcagaaatgaaggcaaaataactttattggacaaacaaaagctgagataacccattaccagtaggcctggacttcaagaaatattaaaagaaattctttacatagaaggaaaatcatactag

SEQ ID NO: 37123 - DNA, 1045 bp, Homo sapiens
gtagagaagtagtgggtgaagtataaaaacttagtgggagctacccttaaacacagtagaggagatcagggttaggttacttgagagatttagcaaagacccctaggtagggggcacagcttcaagtaccatttactcactctgcaacctctattccttcttattggctactatgaactaatgacactatgaatgtgaccataagataaatcttccctctgcatgtcttgttagggaggtacatgttttcttatttaagactttcatagacatatatacagaaaagtgcacaaatgagtatttggcttaatgagttttcagtatttcaggtacacaggaaacatgaccatgtaaacctctaggcagattaagaaacattgccaccatcttagtgtctttcataattaatatcggaagtgataaacggtcacttctgccctcttctgtaggtaacacagaccaaccgtggtacaatataggaaggcagtgcataaggatgtgaatgccaggagtgaatgccatcttggaggctggctaccgcagtcatgcattgatcgttttcaaatactactggttcacttatgcagcctgcacaaatattgatgtatttaagcaaacaatgtaaataaaagtcacaactgataatcacttatatcagaaaattctggagatactgggaagctgccaagatcattatggtgaataccatttttccaaaatcatattttttttttgcctaaaatcttgaattttatcattggcaacaaactcaatttttttttctttcctccctccctccctatttctcttttttcctttcctttccccttcccctttccctttccttgtttttcttgaagttacagattccctttgttcattttcaagaaaggtttgtcaaatacccaagtccgaataaccggtttgtcactcatcttagtaaaatttgtgttccaggaaaaaaaagtatttacttcagtttataatgccatctcacagtagctcttctttgatacgtcatacttcaatatgcagcagaagtact

SEQ ID NO: 37124 - DNA, 1917 bp, Homo sapiens
gggaggccaaggtgggcagttcacgtgaggtggggagttcgagaccagcctgaccaacatggagaaaccccgtctctactaaaaatacaaaaatattagccgggcgtggtggtgcatgcctgtaatcccagctactagggaggctgaggcaggagaattgcttgaacctgggagacggaggttgcggtgagctgcagaggcctcacctctaattgagacacaattatatattgttgatatatatatatatatatatacacacacacacacacactatgatggataaatgcatgagtttctgtgagagcattggaaaggagtttgtcactcaataggtgaagccaggctaagatttaagctgagccagggaggacttgaaggaatcatgatgagagagaaggtaagtggctttgccagcaatgaaacagctgacataatggtaaccagtcagaggagggcataactatgaaactggacaccttggttgtcaggttagaaggatggggtgtagggttggtaagaaaagaattcagggaagagcagcgatcagattatgaagaatttgtcttgagaaattacagaggatttaaaccagaatgttaggaatagttattctagcaagatgaatgtggaaagtgttagtgtgcatgtgatgagtcttgaagctggaaactaggtaacaggttcttaaatagttcatgtgaaaatcatgacagactaaggcagtggctgtggggctgtccgggagttctctacagaaaacatctaaaacttgaatgtgcaagtgagtagctaacttccaagcttcccatttctgtataatttaagcatgaaaatgagaacactgagatttgataggcatgtagaagtcagagtaagcaagagggcttgagttcatcgatgaacttcagtaactatccttgacttagtattggtggaaaccatttgtgaatttacagactccaaaaacaaaaagataatttagagtctcaaagtaagatttggggagatgtccattggagacagaagtggagagagggagaagttcatttgttgacatatttatgtatggtgcacctactgtgtgccaagccatgttagagatacagtgggagcaaaaccagatgtgttttctgccctctgactccagtggttgcagaattagcccaggaactagaattggatggagtcacacaaaccaaggaaggggattgtttgaggggggcactcagtcacatgtggctgaggccaaagagaatgaagatatattttaaaattctggatttggcaaaatttaggctagtctttacttttcataaacctctctcatgttagagcagcaaagaaaaaccagtttgccaagaggtcacgagattgggcagtgaggaatggggagtttagtttaaaagacaacactagatacttttggaagtttacctattctgtggttcccttttattgactaaatggtgcccttcattcatgaagcaagtatctatttagtgactactatgtgtcaaaagctatctaggcccagaaacttttaagtggaaaacaaaacaaagaccctgccctgacagatttcaatcatgtatatactgtatgtatgtttgtggaaggtgacataatagacaattgcagatagtgataagtgtgtaagacaaggataccacgagcgtaatagacagtggggatggaggaacctttagaaggttggttaagttgaatgataaggagccattcttttgtctttacctgaatgacttatcattcagccctttttgagttttgggttgcttgcagagtttaaccttgcctgtaattgaaacttaattttgtaatagcataacttcatgtaagaaaagcaaagcaatacattacagaattattttactgaagaacttgtttcagagaaag

SEQ ID NO: 37125 - DNA, 2115 bp, Homo sapiens
ccatctaagatctcagctaagattcagaatgatgcagacttaactataaagctggtgctccttccgttactatgttctatttcagcaattctcagctattgatactttgggctggataattctttgtggtgggattgtccagtgcaaaattgaatattttgcagaatccctagcctctacccactcagtctccggagtgtccagttttaaagatagcaagacagttcagggctttgtagacacccataggtgtgttcatgtgctgaagcaactttctttgcatttagggtcataacgtttttgtgggcttaatgttgagtggtctgttagtacaatataggagttaagagcttgaactgaagccaggcttttaaaagtaggatagttgacctttcttagagtagatacttcttagagtagatacagatgttaaataagttaaaatgcaaagctcttggtttagaaaatgtctgccattaaacatgctaattgttttttccttgcttagtgaaagtagttgggatctattctcagtatagggaaccattttcacaaataatctgtgatctcttgccaaatatgaacaaacatactggcccaatgactagtatagccaaataagtttttgagcctttattgcagttgcagttaactatatccgaaaatgggtatctttaagcaaagtgaagaatttcagcttatcagtgatgttgtaaaaataaatgtctgaacatatgaatgcagtattgatttcagcatttaactgagataagcgcattgaaatctgtttaacaaaaattaaaatgtatgcatcgatgttgctgaagtaacttgttcttgtttttgacatcctgcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatgattattagtcacatagagcttgggagtaccactggaaacgtatgggtaggagtttaggtggcttctgtttttcaaaagatgatcttatcctagtatctgtaatgctcacttggcacacctgacttgtgggctgtgtgtaaggtggctagctaagtgaaaaaagcctgctaggtgtgagtcaacttaagaatatgtaaataggtttgagaaaaagtagggcttgggtgcaagtaaagattgagcaggaaataaaggaaaatcaagtataatccctgagatttgtagactaaaggcaatgatgtgggactacttggtcgaatttttttagccctcaacttggtaattgggtgtttctgtgttaaagcactgaaacttgctgtcgtgccttcctagttttcgtggtttattgacagggttgggggttttttttgtttttttaaaatgaagggacaaagtcaactggactgctgagtgagagggcaggggcagttgaagggaacatgaattgctggaacagctacataaaatagtgatgtagccaagtcatgctatttaaattataattctccactgtgtttagaataacatctgaggttcttaacctggccttggaagggtatcacttttacttgtaacctggaatggctttataatgtgctagctaattgctactctcatcttgtattttaactcctaatttacccttcaggtctcagcttcagaacattcacttataaagaaaccctgctgattaaatctctcttgggcttcctcccgaaatgtgagac

SEQ ID NO: 37126 - DNA, 1654 bp, Homo sapiens
cgcgatcggccctgcctggtaccgcatcctcctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatggtgagttgtgactgtggtgtttgtgaatcgcgttccatcctcgtcctttgtgcctctctgtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgcgggtagtggtctctgacttggcattcgtggaaagaggcttctcccgcagtttcgatctttacgattgcctttaaattttatcagtaattggtttcccggagaactcgagtaaatctagaagttgccaggtttcagaactatttattcctttaatgtgcagacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgtaagtaacatttttcaggccaactgtgttagcttttgtttgtattgcacttaagtgggggcataggtttgaactttatttggtgcctatcttaaaactcgtacatctgtatgccgatgaggtggcataaaactcgtgtgttaacaacacctacaaggtgtgtgggagaacaccgtttgaaatcttttctgaacttatgttttagataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttcactatgttgcccaggcttgagtgtagtggcacgatcacggctcagtgcagcctcagtctccccagcctcaggtaatctcatctcagccgcccgagtacccgggactacaggtgtgcgctgccacatgcccagctaatttttgtatttattgtagagaatgggatattgtcatgttacccaggataatctcggaactcctgggctcaggccagatgttgaaagcttttatcttctgccgctgtaaccttgacatcagttagtttggattttattagtagttttttcactaaacagtagtataaattaaataacaggagca

SEQ ID NO: 37127 - DNA, 1083 bp, Homo sapiens
gctaaagccataggagaagcagttttagctcttaaggtttgagcttcccttcagtaaacaatctgccttgaaataagtgagcctcctgccactgcaagtatctaagcagaacctcattgactatctgagaagaatgttttgaagaattcttgggtggaaggttatattaagtgacctcgtaggtcacttccacttgagttatatttctaagtgtgaaagcatgtgttctaaatcagatacaacaggtggggtctatctgctgaggtcaagccataccaattggcactaccaacacctgatgttacagaccagaatgatggaatgtttcaggtaagattggctttctggtgcttgccctaaatataagcatcttcatttgatttgcatagcaaagggagattcccatgctctctttttgagactatatgttttacaggacttaaggagaatattttaaacagttacttgcatgtctttcaggaccagggtagctatcctcttataattactcctagacacttcagagcaccttcttctgtttcctgtaattctttacccaatatcatttataaacttttttcctgtcattcatgtgctttcaccttccaaatattccctttctctctccctctttcttcattcctttctttgttcaaatcattattaatcactaattgacctttgaccaaaagtgttagacttaacaaaagggaggtagtttttaaaaaactggttgcagtagtaacaaatgccatccatggtcaatgctcatttattttctggcatcaacactgttccacaactaattgctgattagggagttggcatttatcctcaccaaaatatcatagttacagttgacattttttcactgctgatttttcttttgtcctgggtcttgtgtttccttttttttttttttttgagacagagtctggctctgtcgtccaggctggagtgcagtggcgtgatctcggctcactgcaagctccgcctctcgggttcacgccattctcctgcctcagcctcccaagtagctgggactacaggtgcctgccaccatgcccagctaatttttttttt

SEQ ID NO: 37128 - DNA, 1029 bp, Homo sapiens
tcttcactgttggattactttttagtggcttctctagggtctaccatatacatattttaatcacaatctacttcaagtaatatatcactttatatataatgtaagaattatacaatagtaaacttctgttttctgccttattgtgtgttctttagtgatagttaattctgcatgtgacataaaccttatacttcgctattatttttgctctaaacactcgactatctttttaagtaatctttgaaaatgaggaaaaatcttttatatttttccaacatattttctgtttgttgcactttttctgtgcagagatctagattgccatttgatgtttttttccttctgcttgaaggacatcctttgatgtttgttgtagcacaaattctatagatgtctctcaggttgatctttttcaatatttgcttttaagctgtgttaagattagttgagagtagcctttagttgcagtttaatttatagccccactactgagaaagttttcttcggaggactctgcctgatgctccatatattacaaaatctttcctcactgtttggtaggattgtgaattgttcctagacctgtgttagttttgggcttttttttttttttttttttttttgcctaatgcttgcttaatggttctttttcaggctttgactaatttcttctcatatatgcacatattcatactctgctaaagacttgagaccttcttcctctgcaaatctgagctctcactctgtataatgacctcctttctggtattttcagatctcaaattgtagttgcctcaggctctctgaagccaacaaaattgctgagtttgacttcctgtactgcagcttgcaaattctctccaggcagtaagctgggggaaattgtagacctatcttgttggcttcccttctttcagaaatggtagtcccgtactgtgtgtggtctaatgtccgaaagccactttttcatgtcagtttgatttttctaactgtttaatatcattaataacatgtttgaatttatgtcat

SEQ ID NO: 37129 - DNA, 1026 bp, Homo sapiens
actgtcctaatttatgatctgtagtttttctggctgtcttagaggggagataagaataatcatgtctttggtggttttatccctgctgtagtcttatcttaatgtttgattgttcagaattgtctgtcttgaaggtgctttgcacttttctagagtgtagaatgtcattctaattagcttcaggctgtgggtagctggtgagtatgagattgtggcaaggagtgtaggtaccaggagcattgaaggtattctaaggccagtgtgttagtcccttttgcattgctgtaaaagaatacctgagactgggtaatttataaagaagtttgtttggctcacacttctgtgggctatacgtgaagcatggcaccagcatctgcttctggtcaggacctcaggaagcttttactcagagcagaaggaaaaggggaagcaggcatgtcacaaggcgagagagagagaaggtgccaggctcctttagacaaccagctcgtgtgtaaacgaacagagggagaactcctgcatttccaagggatggcactaagccaattcataagggatctgcatccatgatccaacacttcccactaggccgcatctccaacattggaaagtacatttcaacctgagatttggaggggacacatatctaaatcatcagccagtgagagtagacaatggccaccctaccagaattactgtcatgatttagaagtgtctagggatcagcaacagaatagacatacagtagggtgctagagatacccactaccttgtagatatcaaacaggaagacattttataatacaaaaccagtgtcaggggcccaggaagaaaggatgagacttttgcaaacacgagccagagtttgtgtcaaagagacttaatagaggaaatagtttcctggctggtttctgggtatttctatgattcctgtggtgcatttgtggtaaaaatagtctggactttgcaggtggaaacaggcaattggcagcagcaacacctggtaaacacattctgacagccctg

SEQ ID NO: 37130 - DNA, 1032 bp, Homo sapiens
ggaaagaagctctgggactaatcctgaggaggcttatcttttttcttttcattttttttttgaacagaatatgagattaagatttgtttctcactacttttgcaaccttagacaaatgactttagaatctcgtcttccttacagcctctgttgtttgcttatttcatgggtttattttgagcatcagtgggatagagcattccagtgtgttttctaaagcttaaaaatgctacatgctcaccttaatccctcccgctgctttgattaataaaccttagatgactgttctcattgacccagtgatgatgactattgaactacattgtaaatggcagctggcaaggcacatcctctgtaacctttccctgtcttccaaagttctttatctgagaaaataaaaattccataatgcctccgattcctaaaatcttagtgcatgatcaaaaaactaaattttgttttaaaaatattgttagcttaaatccttcagaaaactaaccaatatttgaagtccataaaatcaacttaaacatgctgataccttacatcaagcaaaaactgtgatgactcttgaggggaatattatggacaccttcacgagagcaaggttcttataaatctgtcacttcatagcttgagttgtacaccctcaaattgatgacctctctctgcctttgtatttgaaatatggagcattagttaatgacccattttatctctttttatactttggctcaaaagattcacatattttggtttgggatgaagattaaagttatttcctgcttaaaacttgcttgtgctgaataaccactgtgacttttttattctttaagaaagaaaagtttacttagctcatgattttagtgggtacaaagtccaagactgggtagctgtgtctggtgagggcctcatgctgcttccactcatggcctaaattggaggaggagtgggtgtgcacaaagagatcatgtgatgagagaggaggcaagagccatatgacttcttttgaatgaaagtcacatctgttgt

SEQ ID NO: 37131 - DNA, 1033 bp, Homo sapiens
ggagtagcaaggactcttgagtcttccaaagggaactaatttggctgtttctcaggaggaatcctgttattgtgttaagctctcaactccctatgagcccctctgctagtcttctgtgtgcataacctaccatctaagtttctctggaaatggcctatttctgtttttttttgaaggagcctgtaatagaaaacctatggggagggatgagagtgcttcactcaggagactgttgatgctttgtctcctgcaagcagcctggcatgcacgtgctgtcagaaaaggtcgtctgactcagccactgaagctgctgaggctgcctgtgactgaaataacctcactgctgtggatttctttgtgctgtcaggcttgtgccatggctagtttacgagacagcaaaggtttacccaaggccctttcaactattttagttaacttcagctttcagtcaaaacaagtacatttatcatgacataaatataattacttttattgtatttatattgtggtatgtttgcctgtaaaagaattgcttagatgatacgatatttggtgcacacaaatatttattgtagcctgtgtggtttatgaatcacaatataaattgaatatcggtgaacccatctaatataagaattagaggttaatggacatatagaaaattattttcaaaagtgatattctaagacttatttataagagccaggcttcagggagctgtatcttctgtgttctatactggtgcctggcatgtgccattgttttaaaatttttaaatttttgtggatacatagtaggtgtatatatttatgattattgggctgttcagattcttaatttctttctggttcaatcttgataggttatatatgtctaggaatttattcatttcttctagattttccaatttattggcatatagttgctcctagtagccactaacgactctttgaatttcttatgagttttaatgtcccctttttcatctctgattttatttgggtcttcatccctacccccacccccaccgttg

SEQ ID NO: 37132 - DNA, 1050 bp, Homo sapiens
cacacattagggtctctttcaatacagtaatgtgcgcaaccactcctaattcactacactctccagtatggtagccactagccacatgtgacttataaaattaaaattatggcacagtggctcaggcctaatttatcgcagcactttggaaggctgaggcaggtggatcgcttgagcctagatgttcaagggcaacatggtgaaaccctgtgtctacaaaaaattagccagacgtggtggcatgtgcctaagtcccagctacccaggagctgaggtctgaggatcgcctgagtccaggaggtcaaggctgcagtgagctgtgactgtgtcactgtggctccagcctgggccacacagtgagaccctgtctcaaaaaaaaaaaaaaaaattgactgagaaattgaatttacctttatactagtcccatatcaagcaaagctacatgtggctagtgattactgtattgattagcacaagtaaacattatcattgcaggaagttttattggacaaagctggattagaaggatcaagaataatctgttatactagtacaggaacataagcaaaacagctctttggactataggattattgtaagcctacccctgacacctgttcatagtagaaacatatagtatacatagtagaaacatgaccatagattgaattgtaagaactgtgctctcaaaagtggaaaataatttggaattggggttagtgcctagattgggcattttctgatgtgaaactctgttttggctttgtgatttgtattttgagtccagtgagtaccctggacctccagccccctgttctgtgctataccctatgcactccgttacctgcgctggcctccaggttgctatgacttttcaagccctatcttgctttcttttatgggagtcatagtgggatggatgattataagctggtctctgaagtgcaacatttaagaggaatcttcagggatcattaagttaactgcatattcttctgcatgcaaaatgccaataatgttagctactattcaggcatttatgatgtatta

SEQ ID NO: 37133 - DNA, 1031 bp, Homo sapiens
ttctacccatggtggatgggaaatcttatcagattcagcatttgaaggctaggggtgcaaaacacgttgagtaggaggttgacagttacctgttacctagacactttgaagtgttcattgtgtcaggagtgccgggggtaggaaagaggtttggaaatgaaattctgagaattgggaaggaatcagctgagctggagtggtcacttgtcggtgtgaggagtatgagagtggagagtggaatgaagttgggagaacaggtggcatcaggagaaatgtcagtggtttgtcacatacttaacacctttccagatcaagtaagtaggcgtcactagtgcttgttaatttcccccaaccaactttctttatattccatcaccaaagccagaattctggagtgggtctgcagcttcatcaggatgggcaacaagtcttatgaattatttcccccaaagaccctcttgatttctcccttctccattcccattcccactgctcagactctcactgttggttgtttggactacttcgagcctcttcattgatatcccggcctttcatctttcaagctttccagctaatcatactgttatatttccgcttaaaactttttacagggacttcctgtctttcaggatgaaatcccacaaggctgatcacaactggtcctgccttctcccctcccacatgctgttgccctcagtccatactccaggaacactgaacatgtagtttcctgagtgcatctttgcaaagctgtctatctgtctgtttttctctacacctccaccccacacactgttctcgagatgttttcttttttcctatgtctgtgtaagtgccacctcctgtaagattttttctgctatctttctcctccccaaaagttgggttctccattttcagaattatcacaatttgtgcctaattcccttagcatgtctctccctctgttgtaattataggttacgtgtttattttctcagtttcaaagctgcccaggaccaggtcttattcatgattgtagctccaga

SEQ ID NO: 37134 - DNA, 1045 bp, Homo sapiens
tagccaggatggtctcgatctcctgacatcgtgatctgccagcctcggcctcccaaagtgctgggattacaggcgtgagccaccacacccggcctatccctttcttcttggaggatagaaagaacagtcagaacttggtgtgtctcaaacaaaagttaggttgtgtttgcagaatgttacataagtcacagacttatttttataagccacagtctgaacataactttctggagacagaattcatgggctaggtatttttaggaagtggaattatgtctgcaggatttatagaaattcatagttaggactgtgaagttaactatgaagaagagtgacaggttttctcttttacaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaagtaagacagtctttctgtggcttaaaataccttaaggggaaggctattaaatacacacacgcatatagacataaaataaaagtgtaaataatgtattaagtcacacttttagaaaaactatgtgtttgcatagaacatattagaagagagaaactaggatgatacacaccaaaatgtttacagtgggtttcctagggttatggaaattttttcttctttttgtgcacctatattttataacttcctactaaatatgtattacttgtgtaatgaaaatgctctaaaatgtacttctgcaaatagaacagttacttcaatacaagaggcagagaagactgttttgtcagagtagaaagaacactaggcttgctatcaaagtcttgggttatttaacaaataaatataaaaaatatttgttgagttattcaccagatattcactgggtggaattctccttacagtcatccagtggtat

SEQ ID NO: 37135 - DNA, 1047 bp, Homo sapiens
acagtggatgaccctgaaaatattgcaaacctggattttcctagtgtggggctggcagaagcagctcatgctcccttgcctgaagaccctgccaaggcttccagtgaggcagctcttgacctccacattctcttccagaacccttattattctccaaaccaagaaccagggtgacttctcagtagagcctgagtggagaaatacaacctccgtctcggggaaaatagtgtagatactgaaggaactgcagaacctgatacatactgtcaggaaccagggggaaatgtgtgtgaatgattttgagggtgttaagccaaaggtggaagttgagggaagactataaggcgggataagaaagattactataggagccgggcacaggggctcatgcctgtaattccagcactttgggaggctgaggcaggcagatcacctaaggtcgggagtttgagaccagcctgaccaacatggagaaaccccgtttcaactgaaaatacaaaattagccgggcgtgtggcacatgcctgtaatcccagctactcaggaggctgaggcaggagaattgcttgaacccgggaggttgcaatgggccaagatcatgccattgcactccagcctgggcaacaagagtgaaactccgtctcaaaaaaaaaaaaaaaaaaaaaagattactataggaatgtttacccatgacttagaagtgaacaacacctgaatttggtcataatattctgttgggatggctgctgaggcttggctatgattgtggcacacagtaaatgaggtgaagatggtggaactgccttggtatggtattgaagaaagagttggaaagttccaggaggtgcgaatgttagaatggattcattatgtgagactgaacaaccgtctaactatgttcctcaggaagacattgccttcactaaggcaatgtaaaatgcactggtttgcaaactgttcatccaacaagggactaatatccagaatatacagggaactcaacagcaaaaaataataataataataataataataataatctcatta

SEQ ID NO: 37136 - DNA, 1035 bp, Homo sapiens
gtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcagatacttgagtattctttttcactcttga

SEQ ID NO: 37137 - DNA, 1141 bp, Homo sapiens
acaagtttggtaaatggatagtcttgctttttgctattatacaaattaggtagcaagtcaaaccgccactgtttgagttgcaaatacaagacgtaacaagtaaaatactgttacgtggtgggtctctgtggcaggcttcctctcccccccatatggataattgtatactaaattcaccataaggtgaaaaatggatattgagttcccttcatgaaaagttatataaaatatatatttagcataaacttctccagagttgtcctttattaagtttctttacagaaactttaattggtgccatgattcttgtgggggaaagaatcataagagccatcaacttttttcctttcattttagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagag

SEQ ID NO: 37138 - DNA, 1305 bp, Homo sapiens
actgtaaaactgtaaaataaatctttcagggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtaagtataaatttcacctactacttaactccccttatttgggagatgttagatttctaagaccaaatctagtgtcaagcatgttggtggtagatcacagaaaattttatcttgaggctctctaatctgctattgtccattgacttgaaagatgtatgggttgaggctacagttcttccagaagtatttgttaatttcatactggctttcctggcttctgttttcatggttttttaattcttgacctacagttgaaccataaatacctggttgatgaagtaacttgttttgtggcatgactttcacaagctctgtcattccccacaagatgaaaactcacatgctgcaatattaaaactaagttatattccctactgcaatattaacactttgagttagatccttaaaactttaagttagattctacttttacttatagcctaaatttttattgctacttttatagcttcccacacgctgtagctttggatcagttaaacttctgaactattgttacaccctacataggtactcacctcagcaattagcagggaagagaattggagtgttttcttatggttctggtttggctgccactctgtactctcttaaagtcacacaagatgctacaccgggtaagtgctgaatctttcaacaagaatgtattgagaactgagtccaggcacagtggctcacacccgtaatcccagcagtttgggaggccgaggcgggcagatcacctgaggtcaggagttcgagaccagtctggctaacatggctgaaaccccatctctactaaaaatacaaaaattagccaggtgaggtggtgcatgcctgtagtcctagctacttgggaggctgaagtaggagaatcacttgaatccaggagagggaggttgtggtgagccaagatcacaccactgtgctccagcctgggtgacagagcgagactctgtcaaaaaaaaaaaaaaaaaatgtattgagaactactctggggaagttgatttagcagtcttctcaagtgagcacctgaatctgtcccacagatcattacaatattttagtcttcattacttctttcagtaggtttttactctctgcccta

SEQ ID NO: 37139 - DNA, 1071 bp, Homo sapiens
aggacccacagtaagaagtacatgttacattgtatgtgtatgccagactgaaacaaaaatgtcatgacattacttacccttgctgcaagttattcagtttgctatttttctactgcattttgttttttaaaatactcttttatttaaaaaaaatactaatcctgacccactaaattgattatgtaacctgctaatgtgtatgaatcttaaatttgaaaattagtgacatagtacatattgtttcatctttgagtgtctttttaaatgtatactttaaggtatagagaggtttcattatacagtgtatttgtggttgctgtttaaacatatacaaatatcctagctttattctaaagtcaaactttaaaatttcatggcttatatgaatttcatagtttccttggacttctctttcagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttgggtaagaggagctattatgagttttttccttctatattagagcatttttaatatctgttaagctgttatttgtacagacctgagaaattgagagtcagaagaatcttagaagtcatccagtctaatctgtgtgtctcagtcagtgaagaatctaagtccagagaggtggtagttaacatgcacaaattctttagacatttctattcagattttctgatttatttctttcagctccattcatgttgtcacgataaagtaactgcacaagggcctatattcactacagcagcctcttaactccttacctctctcagcacccctgcccccatgcccttttccatcctgcacactgccacagctaaagtcagcttttgtactccacctgtctttttctcactttaggctccctagcatgctatgtgtgttcaactcgttctgtttctccctgtgtctcttgtgtgtcctttctctatctgataaaattatact

SEQ ID NO: 37140 - DNA, 1033 bp, Homo sapiens
caatgtagaaaatcttatttgagtgttgtttacctctaataatcatgttttaaatctagagatgcccaattttgaataaaatggaagcctttctaaaagactataattttaaatgataatattccattcatataataattgctacttcacatgtacacaattgagtgccctaaatactaaacttaaagaaactaatacttcaggtgattgctaaactcttaatatctatttctcaatttcaaagttgaaaaccagcaacttataacctaaaacaattttttttctgtttctcctttctaaagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggtatgttacatgcctattccccgccgtcccccaaaatttttttctaaggttcaatagacccagatgacactttaattaatgcaatacgcaaacttttgtaatttgtccttgtttggatatattaagaaagatattttacctgtctgtcattatccgaattgtgaattggttatcttatcttgtaggacaaatggtctattcaaaatttagtcagatggatgacagagccttggcagatgaattttaaaaaaaaattagagcattttctttctt

SEQ ID NO: 37141 - DNA, 1050 bp, Homo sapiens
ataccatttgagcagccctaatctggaaatccaaaatccaaaatgttccaatgagcatttcctttgagcatcatgttggtgctcagagagtttcagattttggagcatttcagattttagcatttttgtattaggaatgctcaacctgcagcatcttgacaatggttagacatgcagtttggaaaaaactgttggcctatgacagagaagagagcagaggcagagctcacttaggagagactgatgctgaagtccttccccaacacagccattgaggagctaggttaggacttcccttgcaccagtatcatcagctagtttccctcccccttttttcccctttccagttctctttcatttccagatttattctcagaataactatataggtcttttatgtattctaggcaggaagcattcagaaaacattaacaaggcttccttatcttgctttactgattctggaaatagcatatggagtttcttttgtccaccagagggagtgagccttcactttaatgagacttatttaagactttagtcctctgttggtactactttgttggaagacttgaaaggtttacaaagttctctgaaagttgccttttctcgccttttttaaggatagaatttaaaaagaaaatgtgtgtattttattataaatacagagtcctcattattctctttagacttattttatggtgaatatagtactctgaaaataataaaatgcattatctgtaaaaaattaaaaacgtaatttttttaaccatcagatttttaaaattatgttctacttgaaagtttttgtgatttatctctttttttaaattttttaaatttttttttttttttttttgagacggagtctcactctgtgacccaggctggagtgcagtggcacgatcttggctcagatcttggctcactgcaacctccgtctcccaggttcaagtgattctcctgcctcagccttccaagtagctgggattactgttgcccgccaccaaaaccagctaatttttgtatttttagtagagagggggtttc

SEQ ID NO: 37142 - DNA, 1993 bp, Homo sapiens
gtttggagccataggccacatcatttgggccttgttttaattttgtttttcatcttaaatatccctccagattgcttttacatcttgtttcttttaactgtggattgattttgagattttgacttagattttagatagcttttctcagaagaaataaacgcaaaaacccgatattgttgtaacatcagtttcctgtgtcctctagaatcatttaaaacctggttggatcttccataatccagtggaattggatatgagatgtagctggagaagtttgttttgctacatatcagaatctccaattagtttcatttagaaaggaatatagccttataattttatgctgggttactgtggaaccaaatatcatagaaggatgtgtgatatttttatgtttttcaagaaggtagtatagatttaaaaggtgggatacatattacctgtcctaatgataggactagatttttttttttttttttttttggggagacagaatctcgctctgtcgcccaagctggagtgcagcagcgtgatctcggctcactgcaacttatgcctcccagtgattctcctgcctcagcctcccaagtagctgggactaccggcatgtgccaccacacccagctaatttttttgtatttttagaagagatggggtgtcaccatgttggtcagactggtcttgaactcctgacctcaaatgatccgtccgccttggcctcccaaagtgctgagattacaggcgtgagccaccatgcctggctagaactagactcttaatctcttcatcctaatgcatggcgtgtgttgatgttcacttaatgtctgtcaactgggtgtagttacaccagtagcggagaggctaatctttgaaagcctgaagtgttgtcttcatctttgcagggtttttagttgtgggtgcatatgggaatgattgtaagaccaacaaatgttttctgattccatatgggcttcttacatttttcaccttggaatctgggaacaattgaaacctaccatatgccttgaacagtagcagtaaagagccagtttctttaaactagacattatggtgctgcagctcatctcaaaactgatagcaggctactctggacacactacatatagagtagccctgctctgcaaggagcagtaataaattaaaaaaaaaattaaaaagtgatagcagaaagcacttactactgagggctgctacaagtattaaatctaaaagatttgtcctctagtagttataactccaaattcagccactgaaaaatgtgacatttgagtaccctttacttcaaggtctcaaagggatttcaaaaaatcaaaatatatagcccctctcccaaaagaagtgtaggaatcctgtatggataagaagactgcccataactagttttccatagagagtaggctatgtagacttgggtatgaatgacctacctctgtagaagtgcaggtccctgattagaaaacttattttctgtgtgatttatcgaggaaagcttccaggaagaggtgacttagaacagggccttgaagatgagtagaatctctgatacgcagaccagtaactctgggaggaggcagggatgtccatgctttttacttggagaactataccagagtgtacaggtttgagcaagtctttcttaacattagtttttacttgcttgctcctaaggaggaaaggttgccaacttgttcttaatttcctagatttatctcctgtaacaatgagaaagatcaataggtaactgtttatattttatagtttacataccaaaatgtgtaggcaatgaacttctccaaccacttctttgaatcaaggctaaggagggagccagaaggaagtattcagaacactgagtaaactccagaagaaactaccattgcataaatctggttggccctaggcagtcttatcattcttgtgttttagtctttgccagactcaaagtgcctatatttcatcccatgagtctgca

SEQ ID NO: 37143 - DNA, 1033 bp, Homo sapiens
ttcttatgttttatgtagtttaaaaaaaatttttttttgttttgtatttgttactaggaacagggttcaagagatagttttttttgtgggggggggttgttttttagacagagtttcactcttattgcccaggctggagtgcaacggtatgatctcagctcacctcaacctccacctcccaggttcaagcgattctcctacctcagcctcccaattagctgggattacaggcatgcaccaccatgcccagctaattttgtatttttagtagaaacggggtttcttcatgttggtcaggctggtctcgagctcctgacctcaggtgatcagcccgcctcagcctctcaaagtgctgggattagaggcgtgagccactccacctggcttgatatttttattctgtttctgattttcctcctatactagctttttatagatttgttctattttatcacttcatttcatgatattacatgattctttattctaacatattcttggttaaggcagtgttagcaaaaggaccaatgatgaacttaacatattgtggatatagaatttaaaaacaaaggtgaagacaaaagtagaataataatatagaaatggtacatgttctgatgaagtagaagtaaaacaaaatgtggaggagaaggcagggaaagaggagcgtaaaataaactctttgatgttcagaccgtaggtgagaggtaaagaatactcgtttgaggagagggtttataggattccttgttcaagggtggtctgatttgacagtgggacaaggtagagtctctttaataggtaactttttttcatgtggtcggaacattgtctgatttttgtttgtgttttttggacaggaaactacatttcttccttttactacttcttttccttttcaccatccagtctccaaagagtgtctctccctttcttaccatcgtctcccccagaatcaatacctttcagagtcttgaaggtccactcttaagtcctttccctgcagttagtgctgtgacctactaggacactc

SEQ ID NO: 37144 - DNA, 1051 bp, Homo sapiens
ttttaactttttgcctactttacttctgtaaaattgttctaactagacacccgcccccccactccccttcctaaaccaaggtatgaaagttaatcaagccccttcctcagggccgagagaattttgagcattagctgtctcttggtcactggctaataaaggactcttaattcgtctcaaaatgtggcatttttctaactcgctcaggtacaacaaatcaataagaagtacatcagttccatccagaaaggcagatacagctcaaagtaaggccccccccaactgagggcttccaggtcacaggtaggtgagagacagatggttgcattcttttgagtttctgataagtctttcccaagaaggcaatcagaatatgtatctatctctgtgagcaaagggatgacttgaatagaatgagaggcagatttgccctgagtggttcccagcttgaaaggacccaggatgttttcctttcacagtctgatgtttctttgttgattttctgtctggaagatctgtccaatgccaaaagtggggtgtcaaagtatccaactattattatattggggcctatctctctctttagctctaataatatttcctttatatatctgggtgctgcagtgttggttgcacatacatttaaaattgttatatcctcttactgaaattacatctttgtcattatacagtgaccttgtctcttatactttttgtcttgaaatctattttgttcagtataggtatagctattcctgctcttttttggcttccattaacatggaatatcttttcccatcccttcactttcagtctatgtgtgtctttataggtaaagtgtgtttcttgtaggtaacagataaataggtcttggtttttcatacattcagccagtctatggcttttgattagagaatttagtccatttatatttaatgttatcattaataagtaaggacttactctttccattttgttatttattttttggttgttttatggtcttttcttccttcttttttttttttttttttttttgacagagtctctc

SEQ ID NO: 37145 - DNA, 1008 bp, Homo sapiens
ttttgatggggttgtttgcttttttcttgtaaattggtttctctgtagattctggatattagccctttttcagttggatagattgcaaaaaattttctcccagtctgtaggtggcctgttcgctctgatgatcgtttcttttgctgtgtagaagctctttcgtttaattagatctcatttgtctattttggcttttgttgccattgcttttggtaacaaaagacgaagtctttgcccatgcctgtgtcctaaattgcctaggttttcttcttgggtttttatggttttaggtcttacgtttaagtctttaatccatcttgagttaatttttgtataaggtgtaaggaagggatccagtttcagctttctgcatatggctagccagttttcccaacaccatttattaactaggaattcctttccccattgcttttttttgtcagatttgtcaaagatcagatggttgtagatgtgtggtgttatttctcaggcctctgttctgttccattgatctatatatctgttttggtaccagtaccatgctgtttttgttactgtagccttgtagtatagattgaagtcaggtcacgtgatgcctccacctttgttccttttgcttaggattgtcttggctatttatgcatgctgttttttggttccatgtgaaatttaaagttgttttttccaattttgtgaaggaagtcaatggtagcttgatgaggatagcattgaatctgtaaattactttgggcagtatggccattttcatgatattcattcttcctatccatgagcatggaatgtttttccatttgtttgtgtcctctcttatttccttgatcagtgagtggtttgtagctctccttgaagaggtccttcatatcccttgtaagttgtattcctaggtattttattctccttgtagcaattgtgaatgggagttcactcatgatttggctctctgtttgtctgttattggtgtataggaatgcttgtgatttttgcgca

SEQ ID NO: 37146 - DNA, 1035 bp, Homo sapiens
caacatgctggagccgagtgctaacatgccttggctcaagggatggaaagccacccgtaaggatggcagtgccagcggcaccatgctgcttgaggctctggactgcatcctaccaccaactcatccaactgacaagcccttgcgcctgcctctccaggatgtctacaaaattggtggtattggtactgttcctgttggccgagtggagactggtgttctcaaacctggtgtggtggtcacctttgctccagtcaacattacaacagaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaaacagctgacttcattgctcaggtaattatcctgaaccatccaggccaaataagcgctggctatgcccctatattggattgccacgcggctcacattgcatgcaagtttgctgagctgaaggaaaagattgatcgcggttctggtaaaaagctggaagatggccctaaattcttgaagtctggtgatgctgccattgttgatatggttcctggcaagcccattgttgagagcttctcagactatccacctttgggtcattttgctgttcgtgatatgagacagacagttgcggtgggtgtcatcaaagcagtggacaagaaggctgctggaggtggcaaggtcacgaagtctgcccagacagctcagaaggctaaatgaatattatccctaatacctgccacccaactcttaatcagtggtggaagaatggtctcagaactgtttgtttcaattggccatttaagtttagtagtgaaagactggttaatgataacaatgcatcgtaaaaccttcagaaggaaaggagaatgttttgtggaccactttggttttcttttttgcatgtggtagttttaagttattagtttttaaaatcagtactttttaatggaaacaacttgacc

SEQ ID NO: 37147 - DNA, 1027 bp, Homo sapiens
tgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaatttttgaagtagcatctggtattttaaataatttgctgttgaacttaaatgacataattaatttacttaatggtttgaaatcaaagaaatcatattagaagatattttattcattctctgaataagaattcagtaacaagtctaccttgaaaaactagcaaatataaaacattaaaactttaaaattccttctataaaggaaataatgtacgtaattgtggtttttggaagttgtagtaagaaatgtttttcaaaatggctcctgtaacatggcagctattaacataatctgcagttctctaaagatagcactgactataaatattggagggagaggaggtgtagagaagagatggtacattagaccagggacaaggaatgctaactgcatatacttgaaacttctagcagctgctctgtgaataactgtccagtatttgtctactagctcattgtcaccaactactgctctactcacagtagctaccgacaagatcaatatctgttcccggtattatgcttaataaaaaaagcacagaaatctagcatcttaaaacaatcattttattatgctcatggactctatagttcaggaacttggagagggcacaatggggatggctttattctatgatgtctgaggcctaggcaaggaaaactaagggctgagggtaatttgaatatctgagagctataatcatctgaattcatggtactgagatgacttttaaagccaagactagattggaatcgttcaccagaaccatctacacttgtccatgtagcttgaacttctcacagcatgttgcctggattctgaagggccatttcaaaagacccagaaagcagctgcatttggaagttacacagcat

SEQ ID NO: 37148 - DNA, 1122 bp, Homo sapiens
atatttgaagtttatagttcagtataccagtcttttttctgtaatggtctgtgaatttggttttgtgtttagaaagatctttccttttccaagatcttaaaaataaacacttatgtaattcttattactttggtagctttggtttgaataaggatctaattttatttagattagaataaaagtgaataatccatttttccttattgatttgaattgccacttttatcacacttgcattatttgggttttgattctggattttcattccatttatcacttattctgttcctttttattaccatacaattcatacaatagctattaaaaagctttttttttttttttttgagatggagtctcactttgtctcccaggctggagtgcagcggcacgctcttggctcactgcaacctctgcctcccacaggttcaagtgattttcctgcctcagcctacccagtagctgggactacaggcacccgccaccatgcccggctaatttttgtatttttagtagagacgggtttcaccatgttggctaggctggtctcaaactcctgatctcatgtgatccacccacctcagcctcccaaagtgctgggattacaggcatgagccaccctgcactgccaaaagctatcatttttaaaaatatcttagggtaattagttttttgttcttttgtgggatttttttttttttttccgagaccgagtcttgctctgtcacccaggctggagtgcagtggctcagtcttggctcactgcaacctctacctctgaggctcaagcgattctcgtgcctcagcctccccagtagctgggatgatgggtgcgtaccaccatgcccagctaatttttgtatttttagtagagatggggttcaccatgttggccaggctggtctcgaactcctgacctcaagtgatccgcccacctcagcctcccaaagtgctgggattacaggcgtgagccaccacgcccagcctgtcaaatattctttgctatgcttgtttcgtctaatgaactttagaatcagtgtttgaaattacacaagtcttgctagtatgttagatattttggagataatactcaatttataagctaatttagagaaaactagt

SEQ ID NO: 37149 - DNA, 1021 bp, Homo sapiens
tggactaggtcagaaggctccaggaaagacttccgtaataagatgagcacacatgctgtaagacataagaagaaatttacagagtagtgagtttagggataaatcaatgagaagaatataaaagtgtagtaaaaactgaatctagggaagacaaagttgtgcaaaagtaaaagcagtgtaatacatggttcagctataaatgaaaacacagcaaatgaataaaatcataaccatactgtgataggaggaaatagtagagtggggtgaaattaagcagggtgaaagctaaaagctcatcttccatgatgggaaactgtaagttgagtatcccgtatctgaaatgcttgagatttcaagcatttcagatggattttttcagatttagcatatccagtatataatgagacacctcagggagggtacctaagtatattacagctgaagggggttgacagggtcttttttcctttggggatgctgaataaattatgtgttgtacacctgtgttttgactgacctgtcacatgaggtcaggtgtggaattttccacttttggcattatgtggacactcatattttctgtttttggaggattttagatttttggacagggatgctcaagttgcagtaagaaataacatctaaactgaaaaattacgtagtgcggagatatggggattaaaacatttttggctgaagaagtcaaaagtggttgtctttgggagtaaaaccgggatgtaagtaggaaactgttgaatgacaagccttatagaacttgtctttaaatcgtgttataacactaaaaagaagctaaaggaaaacatgcagtgccaataatgggaaaaatgtaagggtgaaccaagtcttgggtaccagctaaacatacatgatgtcaggagaaatcactctttctcccttaatgtgacatatactggccccatgtgagcaaggaaataattagaaataaaagttagtaagtagacccaacatatagagtcagaggggtagcaggacatttgtt

SEQ ID NO: 37150 - DNA, 1022 bp, Homo sapiens
agttttgaaacactatttttgtagaatctgcaagtggatatttggactgctctgaggccttcatcggaaacgggaatatcttcacataaacactagacagaagcattctcagaaacttctttgtgatctgtccattcaactcacagagttgaaccttcctttttatggagcagttttgaaacactgtttttggagaatctgcaagtagatatttggagcgctttgtggcctatggtagaaaaagaaatatctgcctataacagctagacagaagcattctgagaaacttctttgtgatgtttgcattcaactaccagagttgaaccttccttttgatagggcagtttggaaacactctttttgtagaatctgcatgtggatatctggagcgatttgaggcctatggtcaaaaaggaaataacttcctgggaaaaatagacgaaagcattctcagaaactgctttgtgatatgtgcattcgactctccgagttgaaactttttttggatagagcagttttgaaacactctgtaggatctgaaagtggatatttggagctctttgagggctatggcggaaaagaaaatatattcacattaaactagacagcagcactcccagaaacttctttaggatgtttacagtaaactcacagagttgaacatacctttctgtagagcagttttgaaacactctgtttgcgggatccgcaagtggatatttggaccgctttgagacctttgctggaaatgggaatatcttcacatatgaactagacagaagcattctcagaaacttcttcgtgatgtgtgcattctactcccaaatttgaatcttccttttcatgaagcagttttgaaacactctatttgtccaatctacaatgggataattggaacgctttgatgcccatggtagaaaaggaaatatcctcatataaaaactagacagaaggattcacagaaaatgctttgtgatgtgtgcattcaaatcacggagttgaatctttcttttgttagagca

SEQ ID NO: 37151 - DNA, 1094 bp, Homo sapiens
tctgcaagtggatacttggaccgatttgaggcctgttgtggaaaaggaaatatctgcacataaaaactatacaacagcattctcagaggcttcttagtgatgtgtgcattcatctcacagcaatgaacctttcttttgattgagcagtttagaaacactctttttgtatgatctgtaagtggatatttggagcgcttagaggcctatggttgaaaaggaaatatcttcacataaaaactagaaagaagcattctgagaaacttctttgtggcgtgtgcattcatctcaaagagttgaacctttcttttgattgagcagttttgaaacactctttttgtagaatctgcaaggggatattttgttccctttgaagcctatagtgaaaaactaaatatcttcatataaaaagtagccagaagcattctcagaaacttctttgtgatatgtgcattcatctcaaggagttcaacctttcttttgactaagcagtttggaaattctctttttgtagactctgcaagtggatatttggagcgctttgaggcttacggtggaaaaggaaatatcttgaaatacaaactaaacagaagcattctgagaaaacactttttgataggtgcgtttaagtcacagagtggaaactttgttttattgtgcagtttggaaacagtttttttgtggtatcagcaattggatatttggagaggtttgaggcttatggtggaaaaggaaatatcttcacagacaaactagacaaaagcattccgagaaactactttgtcatgtgtgcattcatctcatagagttgaaagtttgttttcattgagcagttttgaaacactcattttgtggaatctgcaagtggatatttggagtgttttgaggcctatggtggaaaaggatatatcttcacatgaaaactacacagaagcattctgagaaacttctttgtgaggtgtgctgtcaactcaaagaattgaaacaatattttgatagagtagttatgaaactctctttttgaagaatctgcaagtgaatatttggagcccttttgaacctatggtggaaatggaaatatcttcatataaagacta

SEQ ID NO: 37152 - DNA, 1001 bp, Homo sapiens
cttacagagttgaacatttattttgattgagcagtttggaaactgtctatctgtatcatctgcaaatggattcttggagcactttgaggactatggtgaaaaaggaaatatattcacataaaaactagacagaagcattttgataaacttctttgttatgtgtgcattcatttcacagagttgaacatttcttttgattgagcagttttgaaacactctctttgaagtatctgcaagtggatatttggagagctttgaggcctgtggtggaaaaggaaatatcttcacataaaaactagacagaagcattctgagaaactccattgtgaagtgtgcattcatctcacagagttgaaaatttattttgattgagcagtttgaaaactgtctttttgtagtatctgagaagggatatttggagcgatttgaggcctagggtgaaaaaggaaatatcttcacataaaaactagacaaagtagaattctgagaaaattctttgacacgtgtgtatgcatctcacagagttgaacctttcttttgaatgagaggtttggaaacaatctttttgtagtacttgcaaatggatactttgagctctttttggcctatgaggaaaaaggtaatatcttcatataaatactagacagaaacattctgagaaactactttgtgatgtgtgaattcaactcacagagttgcacctttcctttgattgagcaatttggaaacactctttttgtagaatctgcaagtgaatttttggagagctttgaggcctatggtggaaaaggaaatatcttcacataaaaactagaaagaagcattctgagaaactacttggtgatgtatgatttcatctcacagatttgaacatttcttttgattgaccagtttggaaacagtagttttgtagaatctgcaaagggatatatgggggcccttgaggcctatggggacatacgaaataccttcacataaaaactaaacagaaacattctcag

SEQ ID NO: 37153 - DNA, 1035 bp, Homo sapiens
cattaaaatctcaggatacaaaatcaatgtacaaaaatcacaagcattcatatacaccaataacagacaaacagagagccaaatcatgagtgaactcccattcacaatttcttcaaagagaacaaaatacctaggaatccaactggcaagggatatgaaggaactcttcaaggagaactacaatccactgctcaatgaaataaaagaggatacaaacgaatggaagaacgttccatgttcatgggtaggaagaatcaatattttgaaaatggccatactgcccaaggtaatttatagattcaatgccatccccatgaagctaccaatgactttcttcacagaactggaaaaaaccactttaaatttcatatggaaccaaaaaagagcacacatcgccaagtcaatcctacaccaaaagaacaaagcaggagacatcacactacctgacttcaaactatactacaaggctacagtaaccaaaacagcatggtactggtaccaaaacagagatatagatgaatggaatggaactgagcccccagaaaaaacgctgcatatctacattcatttgatctttgacaaacctgagaaaatcaagcaatgcagaaaggatttcctatttaataaatggtgctgggaaaacttgctagccatgtgtagaaagctgaaactggatcccttccttacaccttatacaaaaattaattcaagatggattaaagacttaaacgttagacctcaaaccataaaaaccccagaagaaaaactaggctttaccattcagaacataggcatgggcaagtacttcatgtctaaaacaccaaaagcaatggcaactaaagccaaaattgacaaatgggttctcattaaactaaggagcttctgcacagcaaaagaaactaccatcagagtgaacaggcaacctacaaaatgggagaaaatttttgcaaattactcatctgacaaatagctaatatccagaatctacaatgtactcaaacatatttacaagaaaaaagcaaacaaccccatcaa

SEQ ID NO: 37154 - DNA, 1041 bp, Homo sapiens
attatctttgttgtgttctctgtatttcctgaattttaatgttgacctgtcttgctaggttggggaagttctcctggatgatatcctgaagagtattttctaacttggttccattctccccatcactttcaggtacaacaatcaaaggtagatttggttttttcacgtagtcccatctttcttggagactttgttcttttcttttcagtgtgtttaatcttgtcatctcactgtatttcattgaattgatcttcaatttctgttatcctttcttccacttgatcaattcggctattgatacttgtgtatgctccatgaagttctcatactgtgtttttcatctccttcaggtcatttatgttcttctctaaactgctaattttagttaacaattcatctaaccttttttcaaggttcttagcttccttgcattgggttagaacatgctcctttagctcggagtttgttattactcaccttctgaagcctacttctattaattcgtcaaactcattcttcatccagttttgctctttgctggtgaggagttgttatcctttgaaggagaagaggcattcaggtttttggaatattcagcctttttgtccttcccggatttatctacctttggtctttgaagtcggatggtgtctctgagtggacgtcctttttgttgatgttaatactattcctttctgtttgttagttttccttctaacagtcaggcccctctgcggcaggtctgctggagtttgctcaaggtccactccagaccctgtttgcctgggtatcaccggtggaggctgcagaaaagcaaagattgctaactgttccttcctctggaagcttcgtcccagaggggcacccaccagatgccagccagagctctcctgtatgaggtgtctgtcggcccctactgggaaatgtctcccaatcaggatacacagggatcagggacccacttgaggaggcagtctgtcccttatcagaggttgaacactgtgttggtagatctgctgctctcttcagcgctaccaggca

SEQ ID NO: 37155 - DNA, 1062 bp, Homo sapiens
gttgcagtattaattaaaggcaaagtgacctacttgtactatattctgaataaatacttattgaatgaatgaaaaatagaagagtgactcaattattttagaatcttaagttatacagatttatgtaatgtctattttgatttttattaattaaccatgaatttatcctactctagtattgagaaaaagaaaatggaactatagacccttctttcatatgatacttaggaatgtatctgcactgtatccagaaagtcagttacatgccctgtttaccaattgaattctgcttcactaaggataataataactgacattgagtgcatggcatatgatgggcactgtgcaaattgctttgacatgttttgttcatttaatccacacaatggtcctatgctataaaaacagttaatatctacttttttaatagatgaggaaactgcagcttagagagattaggtaagctgccttaagtcaccctgcctgtaagtgtttagagctgagattcacattcacggagtcctcctgaagaacctaggattaaccaccacgttgaacagctttggcctgcaagttacatgcttcttagaaaatgaggctattatctataatctgtattttttaatatcaattttattcctttcaactggtcagttatatcataaattccatggaatttttatggaatccatgctttgccactcttgtatccctatagtggtgctggggaatcaagacacatttatttgccttagcactctttctttctttctttttttttttttttttttgtaattttacttataaattgggagggtggccataaaatttatcatccaaccactgaaagtgaaagaaggtgctatttatgatttccccaggacaacaggcagaaaatagtctctggtcgtacatttagcctgcagagagaatttaagtacattatggatagtctgccatagacacagcagtagcatctgcaacaagtaaatgataaacaaaaatcaactttcagggaaatagccatttttagtagtaaacatagggaaatagccattttaa

SEQ ID NO: 37156 - DNA, 1036 bp, Homo sapiens
atgtccatagtatttggaattcattgtattgtttgtattaccacaatatattttttttgtttttttcctctctgcatattagtgtttagttgctcaatcagtgtgttatagtttaacagaagagattgaaataaaaataaacagctgacagtttccttgaccaacttgttaacgttggaatcacctctcctgtgttgacccaaaggcacattttatttacatgttgagatgtgagcagctctcccacaaggtccttgtgagccaaggagataatataggcagacattagaggtgcagatgtgcaaattaaggcacaatgtaagattcgggaagattagtcaagataaggaaaaacaaccacattgtctaaatctcggccagcaagaggtctaggttaggaccactcagattctaggggcaggtgattgagaagattgagaagaagaaaagaagtgaaaatactttattgcagaaaagattctagcatgactccaatgctgcaagtgttaggatattttttcagaggtactcatcaaacttgatatgtagactgttgatgcacagagaaaaaaactgaggcctaacattcatagagagtcagagaaagtaaagatggaagagggatctacccatagcaacacaagtggcagtggctgcgatcaacttttgtttttttaatatcagttttttttgtttttgtttatattaacagaagtattgatgtttggggctggatgattcttggttataggaggttgtttgcagaattgtaggttgtttaacaccattcctagccattacccactagatgtgagtgacacctgctaagttatgacagctggatatgtctccagatattgtcaaacattccctggggtacaaaattttccccatttgaaaattatccccactgttctatacattaaaaatgagagtcctgcatgtttcccatccccttatcttgggaatacacatgatttaataatcttgtgattaacatttagtaaagaatctcaccataaagttagatgatggt

SEQ ID NO: 37157 - DNA, 1058 bp, Homo sapiens
gctgcggctcgcgttcctgcgctctttggggcgagtcttgaacgaacagcgccccgcgagtcgggcgcgtaggtaacagggcagagtctggtttttcctaggaagaaggcagtggggtgtgtgggtggttgcagggaccagctagcgacttggcttgggcaaatatggcatgaattttgaaagccacatttccccaaggcctactcccttttcttgattcgagagtaaggctcgagtatcacctccttccctcctcttggcaggtgggttggctttgaggattttttttttttttttttttttttttttgagacggagttttactcttgttgcccaggctggagtgcaatggcgtgatctcggctcaccgcaacctcctcctcccgggttcaagcgattctcctctgtcagcctccagagtagctgggattacaggcatgcgccaccacgccgggctaattttatatttttagtagagactgggcttctccacattggtcagtctggtctcgaactcccaacctgaggtgatccgcccgcttcggcctcccaaagtgctgggattacaggcgtgagccacctcaccttgccgaggatgtttttttagagctgagtaggggaaaaaacatcataaccaactagccaaccaaagatccacaacttacaggataacgtgtgtgtatcttcattttacaccgtggtctttgaaaacaaaatgtgtgtgtgcatgtgtgtgtgtgtatgtgtgagatttttgcttgttgttttattgtttaagacactttgacagagggattacgtgcaaaacattaacaaagccaacacgaaagttgccattctaccttcacctgtttataattacttttcatattgaaaggattccatccaacctattgcaagtttctgtgtcataaatgttaccagccagtaagggtaataaaagaccacctctcaagctggtaaatattggccaccagtaactaaaattgggacattattctgcaaaaagttttcaaactctcatgggaatttattttcatgggcttgtaagatgtgga

SEQ ID NO: 37158 - DNA, 1047 bp, Homo sapiens
gctgtaacaaactgcagttgtgccaagacttgcaggccctatgacaatctgtgacagattctttttgatataaatgcctcgaaagtcattagagtggtttgcctttttgtacccctaaaaagagaagagttcttggctttaaaaagaagccagtaattgagactgtatctatcatactctgttagttactagtttgttattaataaccagtagttttattaatggttattatcactcctattacttgatatgtattattttaaattttgtattatactcgttaggacataactttgtatttctaggcattacttggcactgtgccttgttgagtcagatgtttgctctatcaatgaaaggattttccttggtgcccatcaggagggtttagtggatagattctaacaaattagctgtagcatcagcctcatctactgcctctgctgaatgctactgcaattaattactcttttctaactgtatgtttacgtaaaatagaactacagtataattctaagactgcatacctggattttttttcatctgtctagcagattctttaacacgtagattcagagatgatggtgatttttttttctcttcatcttgttaaagcttggttccagtgtcagaagcaagcataatcattgctgtgtcctcagcccacagagctgcatctcttgaagctgtgagctatgccattgatactttaaaagccaaggtgcccatatggaaaaaggtaagttaagaaaataacacattttagcatgtggacctgatttttctcaggaatttttagataaatccccccatatttatggactttttactgactgtagtatcttgttttctttatctgtgaaatatcttctttccaagatttgttaagcatgaaaaatatgtgccccaaagaatgcatggcacacagtaagcctcaatgagtgataacagtgagaattcctagtctggactgttggaggggttcatacatgaagttattttccttggattataattcccttgaattagagggtctttctgttggag

SEQ ID NO: 37159 - DNA, 1044 bp, Homo sapiens
tcccctgattcagcctccagaccaaatttttaagtaaaacagtaggatccaacgaagtcatataatatcagcgattaatcaaaatgtgtggttcgtaattgggtgtctgctcctaatgaaataaggggcagtggtcatcagtgtctgctaatgtcacagaagcaaccaggcatagttacatgcttccagatagaagtgtgaaataccaccgaggaagtattcgtaccaaaaaattgaacctgaatctgatcaaccctctggatctaacaatttgtagaatatacagaaacagaggaataggttaaatgacacatggtgacacaataatcaaaatccagactattggaaatttaaacaaatgagctggtttactaaatggcaaggtggaaaaaagaaatagagggaggaaatctgtagattaaaagagtatgaagagctccatcaaccaattgcagagtatggggcttatttggattctgtttcaaactagcaaaatgtaaaagaatacaatttgagacagttggagaaatgtaagcacttgttgaatattttatgaattaaggaatccttgattactaagctcttttaggcgtgataatgaaattgtggttgtgtattttttaaaggagtccttatttattaggggcacatactgagatctttatggatgaaatattatgatgctcaagatttacttcgaaataatctattaggtgaagagagaaatagaagtaggtggggattagatgaaataagattgtttgtgagtgacagctgttgaagccaaatcatggtgaagggggatagtgatactttgttttctgtctctaaatgtgtaattgacattcccccacccccttttatgcctctgaatatgtaattgacattttccccaaaaagttttaaaagaaagaaagaaaagagaaaatgaagagagtaaaaagacaagccacagaatagaagatattttcaacacaaacccaagactgttaccagaatatttattcagagctcctctaaatcgctaagaaaaaaaaaaaatcc

SEQ ID NO: 37160 - DNA, 1051 bp, Homo sapiens
ttgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggccttgctttccctgcaagttcattaaatgtagaatgttgtctttttaagacaccgtggctgagtgctcctaagccatctgttaaatgacttcccgtggtctgcgtgtgtgtgttcatgtgtgcgccagtgatgggcctctcctcaaacccacgactgtctgcagcgtctcagccgtcagaatgaaaacattatcaatcagtacccaacaacagctgtttttgacaagtttctgtctgacgcctaatgctttacaactgtcaataaggctccctctttgtctagcaggtcggagctcgctgtcttgctgcttccgcgcggcatcctgtccttgtaaccctagaatttgccatgttttggaaatccacgtgggggcggggtggggcctgaacgggtggggatgggtgggtgggtggtggggtgggtgggatggctgggggtgggagtgtaagtcccttttcctactttcatgtaaagtgccacaggtgtcttggtttgcatattcaaatattatataggaaaaacagtctgttatgtat

SEQ ID NO: 37161 - DNA, 1014 bp, Homo sapiens
gagtgtcttgctatattacccaggcaggtctcgaactcctgacctcaaacgatcctcctgccttggcctcccaaagcactgagattacaggcatgagccactgtgccctgccccaaacctcacttaatgtatgaaaggccaggcacagtggttcacgcctataatcccagcactttgggacaccaaggcaagaggatcagttgagtccaggagttcaagaccagcttgagcaacatagcaaaaccctgtctctacaaatagtaaaaaaaattagccaggcatggtggcatgcagctgtggtcccagctacgagggaggctaaggtgggaggatcacttgagcttggacattgaggctgcagtgagccatgattgcaccactgcactccagcgtcggtgacagagtgagacaccttctcaaaaaaaaaaaaattataaaaatagaattatgaaactgtaggtttttaaatggcccaagttaggaagtagcacaagaaacaaataaaaattcaagaaaaaagttgaagtgtctgcaatataggacaaatgaagaattttttttttaatgttgaaaattgaagcttgggaggaaacagattttattaaaggcagtagaaggagacttctgtgaaaatgctaaaagacgcttataagcaccttttgaaggagttgaattctttcttgtgtctaatatgtctaacttaacagttttctaatttgaatgtaattccttcccttctctgtaaatttataaatattgattgaggtatttggggctcccaaattacattgtatttgataagaattgaaagaaagaccaggagctattaaaaagaagagagccaaatgaatgtatatacctcctccttgggagagaaccaaagtccctgtgcacccttgttaggccaaagacagtttggttgctgtccagagttgggaggaggggcatggggagttacggtgagcagcctttaagtgagaatgaaaaatgaaaaacagtgtggaactggcactg

SEQ ID NO: 37162 - DNA, 1183 bp, Homo sapiens
tgaaggatccttttagaaagatcatggctaggacggtgacactgattttctaccaaaatgcctacatttactttgcagttaaaagaaaacattaatccaagtgctaatcctaaaatactgccctcatttaatatctaaactacctaagcaaccataaatcatacccttctccaggaaccttttctggcattcaaagtcagctatccgaatcttaactctaatcaaaagtccatctcaaatcctgtctcctccatgaagactccagtaacgttagttaccgtcagtctggctctgtgctgagaatgagtgtggagatcaataatattcactgacatttatgcagtgcctcctacctgccaggcactgagctaaataaattccttacctctcacctagtccacacaatagccttaaagatacatgttattattagcaacatcttacagatgaggaagatgaagcccggggtggttaagggaaacatccacggtcacagagttagtaaagggcaaagtcagactttgaacccagcctgccgggagtccagagaccacttccctacaggctgccttgagttgctgcagccctctttcaaatcatacatttttgattcagtgatgctcagttttcacctcactatacttgatccttcatcctcaattttttatgttatttttgatgtcccaaacacagctaccaagaccctaagctccttgtccataccatttttcagaaagcagaacatggtcctagacacatacatagtacgtgtgtgatcagtacttgcagggctgcactgagttgatatggacagtgccaaaaattagggaaggaaatttgatgcggacctagggaaactttattccaaaggcttcaagaggtgattgtagaggaggtgaattgggacccagggcaggtgcttaagcaggaaataacagagccaaatgtataaccacttacgaatgagagcttttagctgaaggatgaaaacataagggtggtgcacgtgtgtctgtgtgtgtgtctctgtctgtctgtccatcttcatttgtgacttggcaaggcacagagctgggcaggagtgagatggacagacatgcaatataggtaatgtcaaggctccattcttcagaaacatgaagctgatgaagttaccaaaagagaaggatttagaaatttgagg

SEQ ID NO: 37163 - DNA, 1030 bp, Homo sapiens
gtatctcactgtgggaatacattttaggatttactatgacctactggtttacatgaactttgctgagaaaaaaaaaagcatggagaagattgggatggaagatctctttattgtgtgtataaaagtagtaataggctattttaatttgtggcctggaatgggtagtgatagagcatgagttgaaatcttgcttcacgattaccctcaaatggagaagtaatctgtttcaaatggtaatcaaatgaaaaaaagctgtgagtagattgtgttagcttagccaccaaaatagagaatttctcagattccccctctgtctccagtccttattttctcctactgttaacagaaattcaaaccccagctgctcccatagttaaccagccgtcatgacatcgtcgtctttctgttcttagcaatttccatctggcttagtagaagtggttcctcactaccttgagcatagtcgtttttttttttttaatttttgtagaaacgaggttttactgtgttgccctggctggtcctgaactcctggcctcaagcatttctctcacctcagcctctcagagtgctgggattacaggcatgagccaccatgcccaggccgccactttaaacacttgaatactacatactttcactacttgattgatcttgcacataatcatcaaattacaacattcatgtttatggttttacttatttgtttttcacatttatgtagtgcctttttttctgcatcgcttaacatttgccaacaaatatctgcacgtgaactaagcaagtcattctgttagcacaatgaccttgagcaaaggcactttccttcttcatatgcatttgttagtctttagtcctaagtttttgcttttgtttagtttgttttttcactcttcacatacgagcagtcttttggaaagagttacttatagtatttctaacttggagaaacctttcatcaagttgaaaaagttcagtgttctgagcgattatgatagaatctcctgtcagaatatatgttccctttttg

SEQ ID NO: 37164 - DNA, 1057 bp, Homo sapiens
ttttatagactttcctttctcctgacactgtgaaatcccagtgctgtttcttatttgaatgttttatcatctgacacctaataataaaaagtcattggcacaataacagagtttcatctttcttaaagtttaaaaatgtttagaaattatttcatttcttaaataaaaattgcagtagaattaagtatttccctagagagataaagattgaaatttgaaagtaaattgctactaactttgagccaattaaaaaactttcatggaaatgatttttttcacattcattttttttaatgtagtgctaaaaccaaggagtatcatataaaacaggcccaaggcacgttttgtacctaagctaaaaattacttttgtggcctttgacatatcaaggaactttgctattataatgcaagcataagatgaaatttattcaaccttttgaaagtttaaacataaaaagtttaacataagaaactaaaaagtttaaacataaaaaacagttattgtctgtgcaaggactcaaattctttcactctcttcttttttgtttgtttgtttttatttttgagacagagtctcactctgttgcccaggctgaagtgcagtggcgtgatctcaactcactccaacctctgcctcccgggttcaagcaattctctgccttagcctcccgagtagctgggattacaggcacccaccaccatgcctggctattttttttatttttagtagagacagggtttcaccatcttggccaggctggtcttgaactgacctcatgatccaccctcctcggcctcccaaagtgctgggattacaggcgcgagccaccacgcccagctactctcctctttcacacacaatttccaaaatcacagcacagattgtccagaaaacatttgtactaatagttttgtttatggaatttgagttattccccaaagcacaaaatgtaaaaaaaaaaaaaaaaaaaaaaaaaattcttttatgtaaagtctaagagaacagtaaaaatatataatgtggtagctggtaaggaagaaactggttataattt

SEQ ID NO: 37165 - DNA, 1025 bp, Homo sapiens
atgtgcatttcagtgctggaagaagtatagagactttcacccaaagaactatttcttaggcagattccagaaagtgatgttggagtatggcacatatgttaccgaagagctggtgcaatgtggaaacactggagtggaggtcagaaattagatcgatgctctttccataaaatagtttccactttaagaacagtgtttttaaaaggaatatgttctttcctatgcaaagaggcagtgtggtcctagttagcagtatgttggaagcaaactttggataatgatgcctaattttactgaccgttttgagtattaaatgagtctatttatgtaaaatatttgatctagaggcctaacactgtgtggattctcaataacctaacctgtttacatgagttcttaaagttgaatatgagtttctactcacttttcaggttatcaagcatttggtgtgaaaggaaactgttctgtggcagacatgaaatggctgggaagtgggaaacgcagggacatgatgttcaaggagtggacaggtgatccagtgaggaattgggctatggaacatggaaatattcttagaaagtaattaccttatttttctccttttgttgtattaactgattagcttaatcacctccaaataatgagaaatcagtatacaagttctacaccttggcagagggcttggatcccaagacagaggaaggtatttgcagatgatggatggagaggatatatacagcaaccttactgaagtagctgggtcttccttgcctgtatgtcataccatgcttcttcaaatgttttatccagactaaaggatgccaggactgatttcccaaacattaggataattctaccacttagaggaatgcaagaaagctcccctgtctttggtgatttttttttttttttttttaagtagaagatgagaaatagcttgtatggaacagagaagtctttgtaccgatacatattcaactaaagatctgaaaatcaataatctcaggttttgaaaatagaatgct

SEQ ID NO: 37166 - DNA, 1056 bp, Homo sapiens
gcctcactcacatgcagatgattcctagatctgtctcctgaaggcagctctgtgtatccagcaccctactggacacctcacaagtcttaggttaaatgtacaaaactggatccatttttacctattgtttttctacctactcttcttattttctcagaggcagtgaatagcagcaccaacaccaattcttattttctttgtgatccctttgtctcctcccatatccagtttctaaattttatcaagttcactatagccttcatatcctcaaactaaccacttttctctccatcttcattgctgaaatctctcatctgcttttgccttctcccatttggcttgatcttatcattcaatacttttacatgcttttattgtcattctagtgaaattttgaagagagaagagataacttgtgatgaattcattgtgtgtacacggaagtctaagccagctttaaattaaagcattaatgttttggaaaagttagaaaatacaaataaacaaaaattttaaactaaaaaaacctgaaattataatatactgaacactgactcttaactaacatttgtctatattattgcagatttttccattccaatatgtatgtctattttttaaaggggattataatatatgaactgacttatattccagtttagtgtgtacctacttctttgttggtaattatacacctgcagtatcattttttcatgacattattatatggctgcaacacagcttattgaactagtgccctaaaggtagatgtataggatctttccaacatttcattattataatcaaagccttattcatacatctttctgtacttgtacatctagtttctgaggacagatttctgcatgtggaatttgtctcacatatttgcggggatgcattgttttagggcttttaaaatagattgtcaaatagctattgtttgggaaaaactctcaaaccaccttttctctcttctcttacaccaccacagtaacagtcgtcaacacggaataagacttctttgaccaaatgtgtgtgggttgctttccacca

SEQ ID NO: 37167 - DNA, 1050 bp, Homo sapiens
cctgatttttttaaaattttttttattttactgatttgatggagtcattgttgggatcaataaaataatgcgataatttcttcagaaaccattgtcatctttagatgtccttggtgttggacagtcttgggctttgtattgcaggttattattattttttatttagctggcggttattcagagccaagtctggtgaatattttgaatcatgttggttcccttccagatatggtcaaagatgaggtgatatctactaggcattgagactgtttgtcttgaatgtcttgttaactaactctctagataattccagtggaaatactaatgtttagcagtgacagtatcaattggaatattgcctatcttgacaatttttttagaccagtgttttggaagtcttaaatttgtagctcatttattgaaaaatcaatctacttgttttacttcattgtcattgctttgacacttataaagtaattattaaatgtaaggtgaatgttactactatgcatggattgtttagcaaatctcctgttcaaggagcagatttttagtcctgttgagcctgcccttcaggaagaaatgaagtgagtggggcagtgtttttgtgtttttcgggagggctttccttttactcaggtctgctaaaagaatgcaaatcgcttcaaaacagtcatcattctccctttctttgtggccttatgtgttggtcttaatctcctcctttctgtctttttgtttttgtttttttcctcagtaaagagagtcaggagcctgccctttcctccctttctctcacctcacctccagggtggcctgagaattgaggaagaaccttaaattctgctctttgttaagagctctgataactggaactgttggaatattgctaaaatgggttttggagatgttccctactctccctgcctgccatttccacagattactgaggattggctctgttgccaaatgaggctgatattgagcctcaaattttgacccatttttcatcaagtttgtcttaatatagaagttgcaagatttagtagt

SEQ ID NO: 37168 - DNA, 1042 bp, Homo sapiens
tgaggacagccagcctgtgaggttagaagcaagatggaatcagtcatgctagacttctctcactgtcataatctttgcaaaggtggtttcagatttttcagattttctgactagggatgcttaacctatatgagataaaacttaccaacttaaattcattggcttgcatatttttaacttgtaaaatgaaattagctttctatactcagttttcaaaactaatagagatgtcttaaaattgaataaaagaaagtaggaaaaagaaagaagtccgggcgtggtggctcacacctgtaatcccagcactttgggaggctgaggtgggtggatcacctgaggtcaggagttcaagaccaccctggccaacatggtgaaactccgtctctactaaaaattcgaaaattagccgggtgtggtggtgcatgcctgtagtcccagctattcaggaggctgaggcaggagaattgcttgtgagtgagccgagattgcactactgcactccggccttggcgacagagcgagactccatctaaaaaaaaaaaaagagtccagcgtggtggctcacacctataatcccagcactttggtaggccgaggcgggtggatcacctgaggttgggagttggagaccagcctgaccaacatggagaaaccccatctctactaaaaatacaaaattagctgggtgtggtggtacatgcctgtaatcccaggtacttgggaggctgaggcaggagaattgcttgaagctgggaggtggaggttgtggtgagctgagatctcactgttgcactccaacctgggcaacaagagcaaaacctcgtctcaaaaaaaaaaaaaaagaaaagaaatattattttttgttgtttgtttttcaacttgcatagcctgggttaaatgcagccagtgagtaataatgcaagtcctcaatcattcaagacaaaactaaattgttgtctttagtgatacaaaggagagtgaccaaataagagctagggaactgagagacttcatgggatgcatacaagcatggaacccataa

SEQ ID NO: 37169 - DNA, 1082 bp, Homo sapiens
tcccaaagtgctgggattataggtgtgagccaccgcgcctggcctgggtttaggaatatttgtatttcacttatataggggcaaagggaaaaccttcccttcacccttggaaggttcactgataaatcaattcaaaaaggcagatgaagagaaaaggcacacaaatatattaacttgcacacagggcagaaccacagagtgattacatacaccctaaaggggttcaggagctcagaagcttatatacgatcttgaggttaaaaaagaatgggaggccgaggcgggtggatcacctgaggtcaggagtttgagaccagactgaccaacatggcgaaaccccgtctctattaaaattacaaaaaaaaatctagccaggtatggtgacgtgtgcctgtaatcccagctacttgggaggctgagacaggagaatagcttgaacccaggagatggagattgcagtgagctgagatcatgccacttcactccagcctaggcgacagagcaagactctagctcaaaaaaaaaaaaagaatggggacttgggtcctggcaaaacaggttatgggatgggggacaagaggaattctgatgaagggcaataaatgattacttgggagaattaatggatgaagaacagagattaacttgtaaatagttctctttgggtctgctcaggtgtccttacattcttggtcttcttttctgcaataggtacaagataacagggaggagaagaaaaacagttgttctccttgtgattcccttggatctttaggtagagtgggaaaaaatctcttccagtgtctgttgttctccaagagcctttaattcaaaatactcattataccagggagtagtgttttggggtgaagttccctatgatccttcatttgtttgttaaacatctctaatctgagaatttgaaatccaaaatgctccaataaccattaactttaagcatgatctttgagtgtcatgtcagcactcaaaaagtttcagattttgaaatatttcagattttgtaatcacctaatgggttcttcttacccactgtgcagatgaagccaattcactgagacagc

SEQ ID NO: 37170 - DNA, 1035 bp, Homo sapiens
actaggcaacaagcctagtgattatatgggtatttcggtacttctaaatgctgctcatttaaaaaaaaatgtttacccctttttcttatttttagaattattcttcaaatcctgattgtttatggtatctatctagtaatgtggtggtttattaattttcctcttcagatttgccttagccatactgaagtccattccgattttcttgacgtgtaaggaagtgagagtgtcttttgtctattgcttaagttctggggaagggagcaagaacaagaggctctgggggttaatggaagggttagagaacagatggaatgggaaggaaaaggaggccttttaaaaactagttttcaaaagaccctggttactgcctctggctcatttttctagccttccctttgggagggtttgttgtgggtttttgttgttgttgttgttgttgctttggtttggtttgggtttttttttttttttttcttccacaaaggcactgattcccccagaaactctgacagaacatgctccttctgggtggtgtgggaatgtcaacctgagctggtaacaatgcagctagtagtgaagttatcataatagcctagagaatcgtggctgcagggcccctgataattctgtggagctgtatttgggactggaggtgagacagctctgtgtcaatgccttagaaccaggagagcctggcagagacataccaagctgaaaacaccaaagcacattcagacctcactccacttcatgacagttcatttgaaggtaataaaaatgactggccagggtgcacatgtttgcatgtgagtgaacagacacaccattttagggaaatatgtcaagcctaagctctctcttgtgctcacgggtggattctaaggtcaaatatactgatgaagattccatacacactattatcctcattgttgttatgatgtttcagtttcaacagagagctggatgcaacacagggcagaggcgacaaaggcggagcaaatccaatgccagaacttgagagaaaagtagagg

SEQ ID NO: 37171 - DNA, 1028 bp, Homo sapiens
ccttcactgttagatgacaaacttaggtacgtctcaactgggttaggaacataaaaagaaaaaaaaaaaacctgtttatctttttcagggtgtttcagaaagtcttatactttatgataataaattcatcaattttataaataaattaacatacatattttttcattaaatttagtagttaagatgccaatgcatttcattgacaaaaaactgtttaacaataaagaactcaatagtaccaaattcgtaaagaatctgatcttgttccttaatttagcctacatgcattatcttaaattgtgcagattatagaaaaaaacaacaacattgggaactataatagattattcactccgggtgtttagttctgttttgttgaagaaaagggagaaactttcttacatgtttgttacttctcttccccaagttaaggctagactttacggtttgtttagctgtgaagggatgacagacttgggggatggtgaggggagcttagttttggaatgtaaatacatgtagagcttgcctccttttgtttagcatctctttaaactaagacaaaaaaaatcagtgaatgaatgaatagcagcatggtgaaatacctaaatgtttgagttaaaatttttggatgtttgaaatcctatttggatccttttcccagatcacggtgcattcatatgcactcagcaggaaacttcatggagatgcacatttgggcagaaggtctttgacggtgcctttttcttaacttgtgccttttcttctttagaaaaaagtaatggcttaagtctgactgaagaacaatcttttttgtatgttccttataagaatttacttatggttcacagatttttacccaccatctatgtctgcaatccttggatttaaaatagcatatatcctactgcagactacaggaaacaccaaattaaagacttaatgacatactgttgaaaaagacaaaaggcaacaaattataaatcaatccactaaacctttaaagtgaaattcacagaaaaaaaaat

SEQ ID NO: 37172 - DNA, 1034 bp, Homo sapiens
gtcttctaaccatgatcttagactccccctggtttgggggagtttatcttgtcccaacctgtacacatgtaccatctgtacatagtagcttccacgtgtatagaaataagcagactctaagtatgtgctacttgcatttacagtggtttccaggtggctccttgtttgtgtcacattctcttcttaaatttaacatgttgacctaaatcatcctaatcttttcaaccatcattactttctagttttttcattagcttgaatggcactttcaacgttaatgtggctctaatattagaactgattttccttccattttagtgctctttgccctttagcaggtaggagattccttctaattctcatcttgatatcatggcacatctctgctgaaacccatcaaacccaactcaagagtttatgtaatcttgcatctgcttgtttgcctgcctttattttatcccactggttctctctctgttcttggcacaagccaaactcactgctgcctcgggacctttgaattagctggtgatgcttcccagaattaccttgcttcagatctttgtatgtctggcttcaactctcagctcaggtagctttctcacactcctcagtcactccctatcacatctctctgtttcagtgttcaaaatgtaaaaatccaaagacataaaattgaaaagacttttaaattctgatcttatgtccttccaacatttccattaatgtcctttctcttaagaaatgatagttacaatatgtagtaatgtgttatttctatggagcagtccacaaccttttatttattttttaaaatattatcccccctccaaaaactctgtgttgaagcccttatgtgtcttatacataactgctgctttggctttgcttgtcgtatagcaggtacttttccacttatatcctgactcactttcagaagtccttttttgaaacagggtgttgctctgttgcccagactggaatacagtggcacgatcatagctcatggcagcctcaagctcctgggttcaagt

SEQ ID NO: 37173 - DNA, 1048 bp, Homo sapiens
ttgattctgaaataattaggtttttattagtctgaaaatagagctcatcccatcccttttatccatctgccacattaagtatctgacaatctttacaagtgcttctcattcagcttatacaaaaatatagttttttttttcccccaagtgagttcacaggaacaaagtatggatttgaaggaaaacagagtcctacgcttggtataccctcagcgtttttatcagaggggagtaaacactgaaggaaatgaggtgtttgccttcagtcagtattggaatatgtagaaatgtagaagtagaaattggatggactatatcttttaaatctgattttaaataaaaagcatttctatttaacatattgatattattactggtgccagaaatgagactataaagtaatttattggataaattttatttgaaattttaaaaacattgcaaataatgtgtagtcacttttaaacatgtaatttacatgagggatatttcattttgaataatttgatgtttttctttgattcccagaatgtttcttatatctgatcaaaatccctttttttttttcttttttacgaagcggggtctcactctgttgcccagactggagtgcattggtgtgatcttagctaactgcaactttgaacccctgggctcaagtgatcctcccacatcagcttcctgagtagctgggactctgtaggcatgcaccaccatgctgagtttttctttttttagaaatgggatcttgctatgttgcctaggctgatatcaatgtcctagcctcaagtgatcctctcacctcagcctaatattaattttatttttctcactttataagtaagtagttgggagactttagctaattttttcaagtaatttttcttaactcactgtttaatggacttgggttttaaaaaatagtcaatttctattgaaagaaacatagttcaaatatgactctattaaaacaaaaaatgtatcggaaatagactctgtattggaaatagacactgcattggaaatagctctcatatttaaaagtggg

SEQ ID NO: 37174 - DNA, 1034 bp, Homo sapiens
ttaagttacctaaagtcaggtagctaggaaatggcagagctgagctaagaagtcaagcagtgaagtgagctccagaactcattttcctaattacgctgccatttggtcttcaacaaataaaaccaatattaacatattgtacttactaagagcctgttcagggtatcattacattgagatggcatgaccctgataagcatttcaattttttgtacttggaaaattccaattaggataaatttactgcagaatctcttgtctgctttgttttggctaattctccagtctgacaatttgctgcctattaataggatttatctcacctcttttatctgttggtcactctacaggactgggatctctttcactagggttatgtcatacagtctttcattcttccaacaaattataagttagagataaagaaacagaaaagagattcagttcttccccctcaaaaagttcacctagattggtccaaatggttgtggtcgattttccataaatgttggatacgttgactttctagagactatttctgaggtctctgcagttgtccatatcagtttcttgaattgtgctttctgttccttggtgctggtgcaatagaacccactgattgggtcttacttagcttctaaaacttctttgttctgctttgttttgtcttaattcacagtcttctcattccacactctgccttcactctcattttctctatagtctgttaaaatgggaagaagatagtttggagtgagccatcctcagttcaaatcatggctctacgacttttaaattatgagactgtaggcaagttcttggaaccattattttcttatcctccagctctttattgaagattaaatcagagaacaaagtgtcaagacatggtctctgtctttgaagtgctgacactttagtgggagagatagacctacaaacaaataattaaaacagcagtgataagtatcataaaggtggtgtgtgtgacatgctataaaaacttacaggtgagtagtaagtttttggtgagt

SEQ ID NO: 37175 - DNA, 1831 bp, Homo sapiens
tttttttgagacggagtctcgctctgtcaccaggctggcgtgcagtggtgcaatcttggctcactgcaacctccacctcccaggttcaagcaattcttctgcctcagccttccgagtagctgggactacaggcgcccagcaccatgcctggctaatttttttgtatcttttagtagagacggggtttcaccgtgttagccaggatggtctcgatctcctgacctcgtaatctgcccacctcagcctcccaaagtgctgggattacaggcgtgagccaccgcgcctggccggtagctcttattttctaatcagcttccactttccctgacacagttcagtaggaggttctgaacattaatgtaccaaaaagtgcttctgaacaatagtgtaccaaaaattcctttgagacttccaggtttcctacttgaatgcagaggttgggtctggctttgcgggggggggggggggaaaggcggtggaagagagagagcatctatacttgaaaaaaaaatctgatttagactgaactgtaactgttatttatcttgcctgtgattacctgtcactttgaaatcttatgggagtgatttgctcttctcctttgaaatttgagatgttcaatgtgtatattttcaggcttctcatcattttttctaattaaaaacatttatttattggtatatctaaagataccattttaagcagacatgcacacataatcatacttagtccacttgctgttgctataattgaatacctgagactgggtaatttataaacaaaagaaatgtatttctttttttttttttgagacagggtctcacgttgtcatctaggctagagtgcagcggcacgaacatggctcactgcagccctgacctccctgcctcaagagatccttgcacctcagcctcccaagtagcagggactgcaggcatgtgccaccacccctggctaatttttgtgttttttcatagagacagaatttcaccatgttgcccaggctggtctcgaattcctgagctcaggagatcctccctctttggcctcccaaagcgctgggattacagacatgagccattgcacctggccaagaaaagaaatgtatttctttttctttttttttcctttgagacaaagtctcaatctgtcacccaagctagattgcagtggctctgtgatctaggctcactgcaacctccacctcctgggttcatgtgattctcgtacctcagcctcccaagtagctgggactacaggtgctcgccaccacactcagccaatatttttttgtatttttagtatatacagggtttcaccatgttggccaggctggtgttgatctcctgacctcaggtgatctacccacctcagcctcccaaagtgctggaattacaggtatgaggcaccagacccaaccaagaaatgtatttcttatagtcctggaggctgggaagcccaaggtggaggagccacatctggtgagggccttttgctggtggggactctttacagagtcccgaggtgacccagggcatcacatggcaagggggctgaactgagagccaaaccaacttttttttttttgagacggagtctcgctctgtcgcccaggctggggtgcagtggcgcgatctcggctcactgcaagctccaccttccaggttcacaccattctcctgcctcagcctcccaagtagctgggactacaggcgcccggcaccacgcccggctaattttttgtatttttagtagagatggggtttcaccgtgttagccaggatggtcttgatctcctgacttcaggtgatccacccgcctcggcctccca

SEQ ID NO: 37176 - DNA, 1028 bp, Homo sapiens
actttgagcccttgacattttaaaataaatgtacatattgttagtgacagattgctaaacttggctttagacacttagctatgtttcttgccaaaagtaatccagatgtgcataatttatccgactgccatatgtgcactgacatgtcgttctataatcaactgttcagtatggttacagttatatgttcttttttatcaacaatcttttgaaatatcactgacttgataacttattttaagttttaacaacttctcaaaaagtaatgcataaccaatttggctttaaacctgagtgaccagacatgttgagtgtctagaaaagacattgacaatccacattccctgagggccatatgtatttcaagggggaaaatctaggataccatcttcagcgtgattctattttgatgagtgtcttaggggtatagaatagaaggtgtacccaattaaattttgttgaaacaaaaacaaagtaaagtctctaaccaagtaatttgttttggaaagggagtgggaaaaggaaattttgatacatatgaaataaatatgtggaaagaggatatttcattttttccctaatgcagtatcttctgtgttgtgtgcaggcaatgcttgtgacattcacatggggtatggcactgtgctgattcccaagctttatctttttgtttaagaaaggcatttttttccctagagaatttgagagaatgtatgtatgataggaaatattgcttgtctattaccatttcttaaattgatacttaaatatctcggagacatttagaccacatgatgatagcatttgtaccagcgctgagagatagttaccttgaaactatgtccttgttttttgtgcttagtgacactgagccaccatcaagtctagacaggggtattgccaaccatgtgtgtccttgtttgtgtttatccacagctgcaattaggtttttcacactgtccccatctgtggaggctagctgtgcagtgaccttggccagttcaaaatctgttcaaccaagcccgtgt

SEQ ID NO: 37177 - DNA, 1815 bp, Homo sapiens
atcatttatttttatataaattgtaatttaaaattgtaaaattttaaatacttgctattaatctgtaaatatcgtttactttttaaaaataacagtaaattaaatctgatgttttagtgaaatgcacaaaccactgaattcttttgaattaaataaggtattgatagtaattcatttaaataattatttcccccttttatcactttagttaagcgatactttactactaaaacaagcatgttatttataatagcacttaattgtaataaaatttaatgattattttaagctgatttttatgctatcaaggtttagtaggatagtgagttagcttatatgtgattatttttatttatgatttaatattttgcatctattaagatgtttttggtagttgagaatgatgctcataattgttttgtttaggaaatgttcagtcaatgttactttagcgagaatagtcattttagctattaatgttagggaggtcagaaattttggaggatactcctgtcttatgccatcccatgaagtaaggatagagtcagggttgaatatttgccatgggccaatgcttttaaaactaatgtgtggagtactagtatgccttctcatatgtgtctaaatagaaatttaaaataaaatttaccccgaaggagttactgagcttcctgtgtgtatcatttagtgacttgaaggttttgtgtgtggtcgttcgtgttgtttcttcactcatatggtgttggacaatgaattatatacagagagtgtggtactgctactgtctgacttgtcctgggttctacactttgcttttattcagaccagcctgtggagtaagcacaacgtatatcctaagcaaaagctattctgagggttttcagttgattacaatgtaagcatacttaggagcagatgagattcagtaatgagaaaaccccatcaatttgggtgttaggaataactcattgtgcttgctttttgttaaacttaagagcatattataagtaatagacaaattaaattcaattcagaagactcttgtggggacagttcctttaaatactggaaatgctgttatttgaaagaaataattactttagaatttacttaaatttattgtaatcaaattagcataactcaagaaagacattgtcatcacacatctttcccataacgctttattaattacatatttccaaaggaatggcgtcttaaggtcccagaatccaccagagtgttcacaaaaacattgtaaaatatcccttgaaaggtagttaaaaatcaggtcatgttagagctgccttacatacctaccctttcctgagaaaacctcacatctttgccaaatgacagacagcttacctggattaaggttcacaacttaaaatagaatattagaaaaagagactgacgcgacttacctattattaaggctagctgttgttgtacacactccagattttatgtgtgcatgttaattaagtaatgagaaccccagggcaacatttagtatacatgtttgaacatttttccccttagaacagtgagcatcatgtttccccgtataatggctgacatagacaaccaaattccttcagaccttttcaacacttgtttggaaggtagattgcttccttttgagttctttacatttatggctcagtgtctgcgttcatttttctgggggaatgcttccataaatttcatagccactgctataatctctctagtgattaatctctgaaaagtttaatgaactgtctaaagagggtgattttctacttgggcctggtaagacactttttacgttgc

SEQ ID NO: 37178 - DNA, 1045 bp, Homo sapiens
tttcattatttgtttttatttatactctagttagtcaaaattttgtcatatgtttctttagcctggtaaagccgaactgaaaaatatatgttatttaaagttgtatcatatttttaagatgttaaaggaagagttgtggctgtaatttgtgggtttactttcaccacaattatttttagaataacaactcttctctcactcattttgtttacaaatatgcatacatttgtaaagaattgtagttgagattgcttgatccatcctctgtcaattaagattgtatgactaactaaggttctatagaaaatgtatttctatcattttcatttggatccccatgtgatattacataatttttaaatcttcaatcttattttaataatcagcctgaatgattaataaagccatgtggtacaattttacaaaaaggtatacagtgaaaagtagttcacttttctagtcaagtgccctgttcagctctaatttacaattctcagtctgaaaccaggctgctttattactaaactttgaatgtcaaaaggttagaaatgccaacttaatgaattttctttagcaacaaaatgaaacatagactatatattaatatagtccgtatttgaattcattaaattccttcaaatttagtgattttcttaaagatggtacttctaaaacacttttaagaaaattaattttaatagtttaatctctaacttgttaccaaggtatgaatttttagcagtttactgagtcaaatgagggagaggacttagaggaaccatgtgcagtaatttcacaatttatttgtgattgcatgaggtaaacatctaagcagtcataccgtgtttattatgaaaaatttcaaacatataggtaagtatagaaaatatcagacaaacccatccaacccattacccgtgataaaatgttaacattttatcatgtttgtttcagatcttttctttaatgaaacaaatcatgaaagctgcatttaaagccccttcctttcccttcctcatcattttcccatcctttctccttcaga

SEQ ID NO: 37179 - DNA, 1026 bp, Homo sapiens
atctaatttaaatgataaagctataaaatgagagaaatcttaagggtaaataggttggtttctcatttgtattgaattgtaattgtaactaatttgttttacaactcccataggagagcatacttcagttctgaagttatttaatagatcaggagggttttatgagaagttaagttgatatagtagccaataaatgtaatcctattttccttctacacagttgctgattgtgattcttttacctcctggtttttaaaatcttattttcattttactggacattgtgtcttataaaagaacacgttttgttaacatgaaacagtctatattttctagcaatgtcatctgatttgatgtttgtctatatccttaatccaaaagtatttaactttttcagaaatagtatatcaaaagtacagtgttaagtatttgttgaatattttctattaaagcaaatactaattgagaaatatgaagactgtgaaacagagttttgaggcagaattataaggttgaatggctctatttgttccacggctcattaacacaggaaaatacagcttctaaattagggtgtcaacattaaagttaaaatttgtgatcaggccatttctcaatttttatgcaattttaattcagtttgttattatgacatgcatagaactttgtgttatgtttgaaaaacaagatataaatgcgagaaaagtatttgcaagtatttttgtaatgatataaacattactggttttttagaccatgttttattttggttataaatattcagatttttttgaacaatgcattcattactctgtgcatgaagagtttatttaattttcgctttttagtattagacatcttctggaagagggtgctagtgtgtttctatggtatttaactatcacatttaattataactacttatttataggtgattatttctaccttgtgtactttttttcctttctacaaaggatcagacagagttttgaaagactgaaattcttgggcaatctgtgtctctag

SEQ ID NO: 37180 - DNA, 1034 bp, Homo sapiens
ctgaaggatcacttttcaatctaattatcttccatttcttcaactatttttcctatgatgtggtctccaggtctatcacgatcctccttgtctcctggagaagtattaaattgtggggtcccttgtaaaatatgtgcctagaagcatgatgctatagatgtggtctgaccagtgatattcatctctttttaggtttgctttttcttttcatgccaacaacacgaatcatagcaccctactggcccatgttggataagctgtcaaaacatccagctgtttttagtcatgtctttcccattgtgttcttcagctgattttttttttattccaagtaccagacattacttatatctctattaaatttcattgtgtaagtgctggctcattgttccagcttgtcaagaactttttggctttttttcttttatcatccaacatattagcaattcctttcagctttgagacatctgtaaatattaaaataatttcttcaactttttaattcaattaaaatatgtaaacatgtatcagactgtctactctgtgctaatctcaggctccctgctagaaataacaagatggataaaatgtaatcattccagctgggcgcagtggctcacgcctgtaatcccagcactttgggaggccgaggtgggcagatcaccatgtcaagagattgagaccatcctgtccaacatggtgaaacctcatctctactaaaaacacaaaaattagctgggtgtggtggtgcgtgcctgtagtcccagctactctggaggctgaggcaggagaatcgcttgaacccgggaggcagaggttgcagtgagccgagattgtgccactgcactccagcctggcgagagagcaagactctgtctcagaaaaaaaaaaaaaaaaaaaaaaaaaaaaaaaaagctaatcattccttcagggagctcacaggctatagggaataatagacatgtaattataaaactgtaatggagtgtgataattgctatagtagagttacgtgtgaagtgctgtgaaaacca

SEQ ID NO: 37181 - DNA, 1062 bp, Homo sapiens
cagtcgaagatgctgataacaattctcttgtttaagtataacgtaactagtttatttttatcttgaaagtcatagtatctatcttgctttggcccctacaaatcgtagatcctacctctaacctctgtacaggattatgtagcattgttcactctatttttctttcatcctgggttcttcaattattgttttttgttttttttttgtacagtaaacatttggataagtctcaaagctctttgtgtgtatggtgtgaggcagggtatatacataaaataaaaaataactaatactaacttgacaaagttcctatcactctgatgttttccttgagaagcattacagtctggtgtggtaagtcctgtaacaagactgagtataagatgcagttaggatcatataggaaggagaaaggagacttcacagaggaaaagagtctacgaaaagggacagatgagacaaaagtcatggagatacactaagtttagtttacagatgaaacaagattggagatttatgaatcattgaaaaacaaaccataatcttaagggttcactgtactatagtataaaatatctcagcagtttcaagctggagggaaatttgccaaattatgacccaagatgcaagagtaatgctagacacttcacaagcaaaaggttgttttgttattgttatttaattcacttcagtgaatatttaatgaataccaactccatgccaggccctgaggatgcaatccctgccatgcccaggtgtgggtgaacacacacacacacgcacgcacacacacacacacaccatcctctgagactgtttctttgtatacttcggtgggagagtgatgttggccataatgattatggaagttctcagaaaaacataaaactagattcccataaatggaatggcaactcgacaactgttgaagaggtaatatgcttatagctatttatcacttaacagactagattgattctctgacacgttcaaagctgattaaaatagatctgagtagtgttcttttgaggaatcaaaaatttgttgcatttaatttcttgc

SEQ ID NO: 37182 - DNA, 1049 bp, Homo sapiens
gctggagatttagatttttctgagccagttaattgtggacatcaagacccttcacctctaaatacttagaggtattataaataattagaatattttctcagaacaatgatttttcttacataaccacagtacattgattaaattcaggaaatttaaccttatacagtactcttatctaatatgcagtctatattcagtgttcacttattgtctcaataatgtcatttatggctttttttttccccttttgatctaggatccagtccaagatatattgcattttattattatgtctttttagtcttctttaacatggaacagttcctcagtctttctttgacttttaagacattgatattttggaggagaacaggccagttgccttatggaatactccttagattggctttatctggtttcctcatgcttagattcagattgtgtggttttggcaggcaagctgtgggatgatgtcatgctttttgcagtgcacctgccatagcaggaagggaggcatgaagtagaaaaacatttcataactaagaatgttaactttgatcacttggctagagtggtgtctccaggtttcactgttctaaagttaccgttttcttccttataggtaatactttattcaattacctcttaatacttactcagtcattttaaatgtgactatggtttatttccatactgtcatttaaaggaacatttttttccccttcttttggcagtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggtgggtactgtgctggggttctgtcccttcttctttctcatcccaagatgtcctagtttcctgtgcaatttatcccctcccttctacttatagtttaatgctttaatcagtttattttaattttaaacactatctctttttcaaaaaagatttgaaatgaatttaatagc

SEQ ID NO: 37183 - DNA, 1032 bp, Homo sapiens
gattttaagaaggccacagtctggagttaatgtaattgccaaggggataatggagattcatatttaggcaatataggtacagatgagcaattcgaagcagtgtgcatctgccaaaagtcttaccttatttatgacagtttaagactggcttctcagcagaaacgtgcagagggaaggaaaagtcaaagtcctaatttctgaaaacatgggcagtgcagaattcctgcatgtctcctgtgggaattacagcaaatagaatggagtctggcgtagataatagttatatgtgatttgtttttcatcatgtgtcttcatggatggaaaagttcagtcttgtcttcaccctcactgttattaatataattatcacaaaaagatattttgtggtttggttaacattttacaaacacagacattgatttcctctctcgaaaagaaaattgtatataacttaacactatgtcctttaccactcaaattttcaaagttgtttaggtagcagcttccagatttttggattttatagaaccataatattaaaaacaaacaaaaaaaccttggcggggtgggcaaaggtgggacttagtttgccaataaggacattagaaaaacaaccctcagggactattactgagttcatttcatgaccttaataccctcctgcccctgcctgtaggaacattataatctttgaataaataagtccttttaaattgaaaaaaggtagttttatgggaaaccaaccaaccaaccctttttgttcttggttttcctcagttcactttggattactgaaaacattattgaccaacagtgagtgattccttgtatggaatagtactagctgatggttctacacatacataaaaatgttgtcatgattaaaattatcttcaagaatcttaaaaccagtgttactgaggggaggtagaagcttgtgtatgtgacatggagatctcccaaaatataattttataaaattgactttagtcattggatattttctcatactttcaaagactttatataagg

SEQ ID NO: 37184 - DNA, 1032 bp, Homo sapiens
tatttagcctctctctctctctctctctctttctctttttatatttaccaccatcattctagttaatgtacttatatagctacttcttgatttttcaggtttaggcattgtctattggcttctgctttggaaattgaggatttcgctcttttctctctccattcaccccaacacacatctttacctccccctactccttcattctgcccatatagttaatgttctcattttgggtaaatccatgtgtttacattattatgcctttataaatgccattcattgctgtcatattatgatttcttctttattaaactctactttctcttgagttagtcattgtcctattttgtcatttacttagtttgctacgtcctcatcattcagtcaatattctgtctctcttgagttgtataaatctcctcttcataatttcaaataggtgtgctataaaattgtatctagttcatcttcttggtgacattctctcagagcttctgatctacgccaatctggactggttgttgaccagccctgctgcatggctgtcgtcactggggggccccctgaattatcatgttgaggggaccctttcttctgtaagatgcttgctggcttccaggtctttgtgttctttagcttactccaaagttcatgggaagtcggtttttttgagattttgcttattggactcatgactgatggtttagttggtatagaactctagcttggaaataattgtccatcatagttttgaagtcatgatgccatttatttctaagcttctagctgttgctatccagagcagcatcattgttttgatcctgaacattttgtatctgaagtactttttctggtggtggtgatgattttgtttttaatcctgtttggcaattccagtcttctgaaatttcatggtgtgctttggtgtgtgaatatgtgtgtgtgtgcgtgtgtgtgtgcgcatgtgcatgtatatatgtattagattttcatctcattgtatagttctgcataccccaagtttaaaaaatt

SEQ ID NO: 37185 - DNA, 1050 bp, Homo sapiens
tgaatgcagccaacattcaaggtgctgctcaagtgccacagcattcttataacctgctcctgacatgcctccagtactcaagtcaaggaagctcttcccaaccccggcgctctcataattgccatttattctcagtattcagtccattctgccttgtgttaagtttgttgttcagacagaccgtggaggtagattgtaaatttttcaagatgaccatgttgcaagtatttttatgccatttgattgatacatagtaagttcttagtcatatgctatttggatctattttcttaaagctctgatttgagaatcataaaattgattgttattttattgttattttcatatttagataatgctgttaccaaggttatctgtgaaagccccaataatctatctaatagaagtttatgcctagtgggccaaatagtttgtcaattgtcaatcaacctgtagacccttttctatctctaaaatgacctatttaaagaaactctgggatcgcattcaactttagctcctaaaccacagcctactgtgtgcgaactctaaaacgccacaagaaagctaccattaaattattgaaaatattctttaataaagaattttagttctttaaatctctgcattttaacaaatctgaacacaaacatatcctaggtggtcttttttaaccaagccgttttggacataatttttttacatgatgtaaattttaataaaaaatataagtagttttttttttacatggtgggaggatggtttagtgttctcatgaaaggaggagggaggacatttacccttccatggtcactgccttttaataacatgatgcgtgataattttaaggcccagtttgactatcaagtaacttgtctccttgccgaggctggcggatcatgaggtcaggagttctagactagcctggccaatatggtgaaaccctgtctcttaaaaaaaaaaaaaaaaaaaaaatccaggcatagtgacgcgtgcctgtagtcctggctgctcgggaggctgaggcagaagaatcactagaacccggga

SEQ ID NO: 37186 - DNA, 1019 bp, Homo sapiens
tttccactctggaggagtgactaaagcataattgacagacgcgacctttactcagaaaggattcgacccacgcggcactttagcgttcccatgtaccttggaacgggtcgtcactctctgtatcctccatttattgcatctttgccttcagcccatttgtctgctattgagaggaaatgctggatctttgttaaccttatttggaaatagaggacccaagctagggcctcattcgaaggggttttactgctcccgtatgccctttcttgttttaccagttttaacatactgcttgcaggactctgaagaactggcttggctgttttaactttttaattttcatcaagcagaattatagaggagaagataatataactgtcatcttgctttgtatcaggatgagggattgcacaggacatcaaaattagaactgtcaattatgttaagtataaaaaatagctctctaaaagaatattgtgtttattagccctctgatggaactcaaattataccttgataccattttttggactgtatagtaaataacgtttattttctgccatcttgttgaagttttgttttctcctttattttcatgcttacctttgaaatttcttagggaaaacaacaataaactgtaagtaatcacattaatttcaaatttagtattctttttctgtcttaggcattctttttctatagacctctcttaaacagattgtaaccaatctgtcttgtttttgacatcttttttgctgttttattagatgaggcagcaaagaagatgagattcatctttgaaataatattctttagttcttcctcagggaagtctagatgtagatttatgaatattactgtagaggctaccgggtcagagtttatctgagatagaaactcattcttttattggaaatagttaactacttatccttcattccaagttatgccttatgtctcatgggtttacagttaaaatagtttcttgcaaatatagcatctatatagggaaataatat

SEQ ID NO: 37187 - DNA, 1026 bp, Homo sapiens
aattcttaggtttttggtttgagcattgttttggttatctgagtaatgaaccaccttaaaacaatagtttaacacaataacaatgtattttactcgtgaatcggggtttgactgggttcaactaggcagttattgttcaggatccctcatgaagttgtaatcagatggagggtggggtcacctcaaggcttcatacacatgcctggcatctgagctgggtacattgcaacagctgggtgctggacaagggtggccccctggggcatctctcttcatgtggtctttctatgtgatggcctcaagatagctggacttctcatattgaggccgaaggcttacagagcaaacgtaccaagagaaactggcagaaactgcctggtcttttctacccaatcctcaacagtgattcagtgtcacttttactgtgttcttttcatcaaggcagtaaaaaaggcattgctaggttcaagggcagaagggagatatctcttggtgggaggaaggttgaagaatttttgggcatgttttaaaaccactgtaggtattgaggtgggtaatggggtcatgcactatgatctgtaaccctgaagaaatagcaggtttggtgggaaagggagaagtttgactttagagtgactgagtttgaactgcttgtgcagtaattcaacttgagatttcacataggtaaatggaaactcagaggtgaggtttggagatgtagttaaaactaatacctagggccaggtgcggtggctcacgcctataatcccagcactttgagaggccgaggtgtatgtatcccgagatcaggagatccagaccatctggccaacatgatgaaaccccatctctactaaaatacaaaaaattagccaggcgtagtggtgcacacctatagtcccagctacttgggaagctgaggcaggagaatcacttgaacccaggaggtggagattgcagtgagccgagattgcgccactgcattccagcctggcgacagagcgagactccatctcaaaaaaaaaa

SEQ ID NO: 37188 - DNA, 1104 bp, Homo sapiens
gggggctatttcttcaatttagccccttttcctttatcttcaaattgctttccaccccttcttctgtgagccttttcttcacctccctgagactacaaagttttagatgtcttcaccaaccctgtggtgttatggcagctgtctgtttggtcttttctctcctagaatcaaagtcccttaagccccaaacttaaaacataaaggatatcctaaaggtaaacatcaccttttaattgcttgtatcctgtgtactttgaaaaatgcccacccttcctgtgctagttttgctgatcagcacatattaaacatagaaaaacattttaggcaacaattttagattaaatgaagttgccattaataaattctttcaaagttctttaagaaattaagatgagatttccagaaacaaataaagaaggtacttgcaatctaggatcaagatttctgtcaattctttctcaatgctgaccatcctcattgagtaaaaatctccagagaaaaaggagagctactatggaagtagatgtagtgaatgaaaatgtgttcagacacatttttctggctctcaaattttagacattcttatgttttgaggcacctgaagtctttgggtgaggagaatagctgattctaattcttgactttccagtatcttttttttttccctaaggtaatttgggctatcgttagccaaataatcattagcatcctgtcaatttttataggaagcagtaatataaactacaatgttatttggaaattcctctaatcaatttgattatttgtgtttttaacataaaccaatctaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttatacc

SEQ ID NO: 37189 - DNA, 1033 bp, Homo sapiens
actcgaggtcaggagtttgaggccagcctgggcaacacggtgaaaccctgtctctactaaaaatacaaaaattagccaggcatgatggcaggcgcctctaatccctgctacttgggaggctgaggcaggagaattgcttgaacccaggaggcggaggttgcagtgagctcagattgggccactgaactccagcctgggtgacagagtgagactctgtctcaaaaaaaaaaaaaaaaaaaaaaaaaaagagtgaatgcaaaataaagatatttcaaatgaaaacagctaaagatgtatctgttttgtgctttttaactttggagagtagggaggaggaaaggaagaaagtcaggtggtgggaagagatcagagatgatcagctgggttctttgtgatttaacctccttctgagccccaaaatactaaattaagatatgctttatatgagttgattgcttttgatgctgatgaaggatggatttgattgtgtctttgcgatttatgaggctgaacatggatgtggatgttggagcacagagatagaagaatgctcagtcgaggagggaactcacatgcatgggggcaggcggatgcaggcagatggctatgaatgctctcaatgccatgatattggggatcaggccaagtttaatcagctctgagaagggggtgccctggctggcaaatgtgaggaaaaaaacatcataaagttgccatttgaaatagaatcccaggctaggcgcggtggctcacgcctgtaatcccagtactttgggaggccgaggcgggcagatcacctgaggtcaggagttcaagaccagcctggccaacagggcgaaaccccatctctactaaaaatacaacaattagctgggcgtggtggtgcgcacctgtagtcccagctactcaggagggtgagacaggagaatcacttgaacccaggaggcagaggtggcagtgagccaaatcacgccactgcactccagcctgggtaacagagcgagactccatcacacacacacacacacacaca

SEQ ID NO: 37190 - DNA, 1024 bp, Homo sapiens
tagctttgaacttcataagtattgttttacttctccaaacatttttatttctttgataatttatcatatcccagaatctaagtaaataatgcattataaatagtctcagtttaaggattaggccacacttggcttaggtgtaaacttcatgaaaggttaagaattggcataaatggctcaaaggttagggtaaggaattaaaatgaaacaaaagaatatggttatcttgtgtggatcaaatgggcagacacatctctgcatttaattcagaagaattgatttagaacttctttattgtctgcttctctcagcgatgtgagttgacctagcatttgctggctttagagactcccctgcattcccattattaatggttaagtttcagcttacactacttctgaagatcagcttttaatctgtgcccagtattctgaatattcctagcaaactcattttctgtcatcactggcaagagccaggatttgggtggccataaactatgatgattatgactgggaagactcacaaaacatactacctgtttctggaaaatagttcagtgcctaagaacagctcatacctgagatgtggaagtttcaactgctgaaactgtggttgattaatatacttgatatgttttcaagaatcaaagattaattccaaaatgaaatgttagataagttctttctggctgctgatctgtgaggaattactgggaccccttaatggcctaaggaggcaatgtgtactgaaatggaaagggttcctctgttggcagtcagggataaccctaagcaaaactgtaaaggaatgacattcttggaagtacatatagtttacctctcctgtgacctgttctcagaaaagaatctgactaattcattcatgttaaggactataattagaactgtatttttatggggcttaacatgtataaactaagggcatttgctgtttacccaaggcagcacctttcactaaaatttattgaccacctactttgtttaggtcactctggtgatat

SEQ ID NO: 37191 - DNA, 1051 bp, Homo sapiens
gataaacgaagaaagggaactctttcacttttgccttaatcttcagtaaatgtcaaagttaacatcaagtatctatttaaatgtttgcatttctccacacttttgtacactgtgtctggtgaagtaagttgatggtgtgcactaacccttttggaatagtttatcaaggatttaatgtttgtatcttttaattccacatacatatatatcttaaggaaataactagaaatgcaaacaagaatttgtattcagaaatgttcactatagcatcacatagggtaatcaaaaaattaaaaataacctacatgctctcaaagtaggaggaatggttaaattatagttgattttgctttgtctctcttggtttcaaggagtagaaattctaactagattaagtaaaattgggctttgttgaaaagggtaaaaggtgctctaataaccccaaacagcaagatcactgaggccttttggcagtggggagccagagctactttcccatttcacccggttcagggaccaggctagtcactgcttcttcctctgtagacctgctttgttctcagcttcttcttcagccagtcttccttgtacatggctcagtgttgtttgccaccttggacttactcagtttttgttaaaattcacatatttccagaacaggaatctgaaagagctgttctttttgagccttaggtgggtcagtgaacaacctgtggtttggtctttttcttcatccccttccaggggtctgtatttaggtttagatagttagtgaaaatgaaatggcactgggtaatgacattgattcaatacatcttggctaggcacactggctcacgcctataatcccagcactttgggagactaaggcaggtggatcacctgaggtcaggggtttgagactagcctggccaacatggtgaaaccccatctctactaataatacaaaaaaactagctgggcatggtagtgcacacctgtaatctcagctactctggaggctgaggcaggagaatcgcttgaacccggaaggtggaggttgcagtgagcc

SEQ ID NO: 37192 - DNA, 1055 bp, Homo sapiens
gcaagattatgcagggcatgttattaggtggtaattagggaaagggaaaaatggaaattatattttgcagatacaacaaaggctgaagaggtgtgtgtgtgtgtgtgtgttttagatacacacacatctatatgtacacagagacacgatccacagttgtgtaggaataacttcctaaacatctttaggatctacctctttttcctgttcccactgttatttctttgtttcaggcccttaacatctctaatatacactagtatttctgtcttcacactgttttttttctttacacagctcttttcatagcccctccattagcacacagattggaattgtgtctccttgttacccacagaataaaacccaatgttcttaatatgtagtcttaatatagactctataaatagcccctttgttaatctatcttgaattactcacttttaggtttcagctccctactgagaccccaactggctttaccttctgttccctcctggttctgcttatcttccattgcccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagtctgtagatgatagcagcttcaggaggttgcactatcttttgactgtgcccacacccttcacaccttgtaaatagtccctttcttaaactctccttaaattacccagtttgggggtgctatctgtttcctgctgggatcctgatggctgtgttgcccaaacctaaatgtcagtcatgcttgcagttacagctgtgttattttcctgtagtactgatttccctcttttattaaaagttctgtggtggctgggcatggtggtttatatgtgtaatcccagcactttgggaggccgaggcaggaggattgcttgagtccaggagt

SEQ ID NO: 37193 - DNA, 1027 bp, Homo sapiens
agcacaggcatgcgccatcatgcctggctaatttttgtgattttagtagagatggagttttgccatgttggccaggctggtcttgaacacctgacctcaagtgatccggccacctcagcctcccaaagtgttaggattacaggcgtgagccactgcaccagccagttttattaatttctaatgcaggaatttaagggtttacaattttcatgtggtattttagctgtatcctttaagtttcgacttgtggtattttccttgttcacttttaactattttgtcattgaccttttgacttttcttgacctgtgactcattgactcttaagttttcaaacatagatattttggggagacctttttttttctccgttacagaattgttaagattagagataatatgtgggcaaatatcaggcaaatagtagatactcaataaatgttttcatttttccttaaagaaataaacctctgctatttgtttttttttttgcgtgtgtatagatgtgtagagatgggagtctccctatgttgttcaggctggtcttgaactcctggcctcaagtgatcctcctgccttggccttccaaagtgttgggattacaggtgtgagccactgcaactggcctaacgtctacttttgaaatgagaatgggaaatacacaattgccaataagtgtaaataatactaaaagtgactttagttctgcatgatagccaattgagtagatgaagtatagaaaatatagggggatgataagaagagggtaaaattgggaggaggtaagggagagaaggaaatttagcccttccaaattctttctctagaatttagagaggatggctcacacctgtaattctagcactttgggaggccaaggcggacgcatcacttgcgaccaggagtttgagaccagcctgggcaacatggcaaaatcctgtctctacataaaatacaaaaattagccgggtgtggtgatgtgcacctatagttcaagctactcagaaggctatggtgggaggattac

SEQ ID NO: 37194 - DNA, 1008 bp, Homo sapiens
tgtgccaaatgatcaggaatgataatcaggatggagtctgtatacttgacctacagaggaaacaagctgtcttatctggcaaactttttagttttgcttattaagttggtaaaattttgaatgactttctttactcttggacatctaatgatcttttgtaaagaaggggaagagaaccctttctgttcagaaataacacacaacttgattagtaggagaatttttcatgtgattctggaaagaatttgcaacacctgtttccaaagaaagcaagaaatatattgcatatttttctccccaaaatgtattttgtccaaactgaattggacacagagaacattccttaagtttggaataaataaactttctgaaaactgctcaggtaacaaagtagtaaagagccaaaaaaaattttatttacttctaacctttgactactaaaaggagaaaatgaaagggttcatggaagcaaacttcacaaaagtaactgtagacttaacttgtcagatccaaatatacatgtagaaaaatgtacaaacatggttaaatttacatatgccggaattttggggggaatggaatgtgtttcttacatattagttttatttattacctttttggtaaaaaatcagctcctagaagcaactcccacactgtttatttttcttatacattttgctgaggtttcaacatttctcttccatagtttgcagcaggatggctacttaaccaaatttaatagggttaagatttattgtgtgtatcacatagagaccctggaagttaggctcctttcctaagagagaggctgtgtaatgtggtgaaaagaagagaaactttttgttaaagttttggtttccctgcttaccaactgtgtaatactggattatctgccttagtgttcactcaagtgctgtgcacttgggtgagttacttagtgtctctgagtttgatgaaatttagcccagagatacaattagtgccttttttttttttttttagtaattt

SEQ ID NO: 37195 - DNA, 1047 bp, Homo sapiens
gagaatggcgtcaaccctggaggcggagcttgcagtgagcagagatcgcgccactgcactccagcctgggcgacacagctagactccatctcaaaaaaaaaaaaaaaaaaaaaaaaaaaaaaactcaacacgtgttaaatcgctaaagtctgaagagcccagaaaagaaaataaatatcattagtaatattctcaccatcatccaaagattaccccttttaacattttggttgcttatctttccagtgctttttaatgtccatatacccacatttttttaaacccatgctttaaaagaaaaaaaaacttgtgatattactgcatgtatacatatattttgtaattttcaatataattgtctgaaattttaatggttatatggtatttcactgtatgtatttggtagaagtcactttgcccccatttttggatatttaggttatttgcaattgtgctattatgctgtgtacaacgtccttgtggaaactttggcaaaccttgggttgtccatctcaaactctctcattgtactctgtccttttcagcctgcttctctctcttttccagtaactcctttaacaacaagatcagatcaggtggacagattattcttcaaacaatttactattaggcaatgaatatgctggtttctgtgaattctgggattaaagagatacatagacacattttatttgcagagataaagaattacaataataaactaagtgttgtgataggtttatatatgtataaggtccatgggggctcggaaagagagcaggggttgtgagggcagtaggcagggaagaaagatcagggagtaagcatttattaatcctcttaatgtgccaggcactaagttaggcacattactaggctcttagtttgcagcagttctgggaggtatgtacacagtattattcttacttaccagatgaggaaactgagctcagacaggtaagtaatttgcccaagctcccacaagtagtaactgggagaaagccagaagtaaacccagccagatatacttgactacccaactctgtc

SEQ ID NO: 37196 - DNA, 1050 bp, Homo sapiens
gcactttgggaggccaaggcgggcggatcacctggggttaggagttcgagaccagcctggacaacatggtgaaaccctgtctctactaaaaaaagaaaaaaaatacaaaaattagccaggtgtggtggtacctgcctgtagtcccagataccctggaagctgaggcaggagaatcgcttgaaccctggaggcagaggttgcagttagctgagatcatgccactgtacctccagcatgggtgacaaagcaagactctgtcttaaaaaaaaaggagtcattatagtagtaatactatagtaaacacatacttgatattctttggaatatgggccttactatgaaataggagaaattatttctttcccagttactaataagggagacttcattggttaagggaattttgtgggtagaattgctaagactagaaatctcattgttggttcaaagagagaaataagttaaccacgtgttctcacctgaatataggatgctttgctttacaagcttaaataatacccggacaaaactctacaggtcacaagttctttaaagacttaataaactctgtagaaactatacttcaaaggggaaccttctccttgattcactatcctgccttgtcttctgaaatttattggtttttgacaagcgtttgaagaaagaccactaaaatacagtgttgttaatatttggtgaaatgttcttgtacatacatctgttatagattttccaagttaaaaattacttttccattagaggagctccccataccttgtttctttccccaaaggggtgtgtgtgtgtgtgtgtgtagtttataatgtattttactcttttgactttggaaatacatagtatttcattgtataggtttggcacaatctactttttaactctaatttttagacatttgaaccttggatgatatggaatactgtcattagtaagttttatgttacctttctttctttctttctttctttctttctttctttctttctttctttctttctttctttcttttcttttcttttcttttctttcttt

SEQ ID NO: 37197 - DNA, 1059 bp, Homo sapiens
gatttagtcctcagttgtcactgcttggaaatgtttcctgagtctttttcagggtggggtgtccaggaaaatgacatataggaaacgtgtagcagatgagcccttcagttaattggcagcttgtcacggcagattctgccttgccttttggttcatttgcatcagtagtaggagagatgggtttgctgcttggtgctggagaggtaaatgagtagagaagaaagctattatctattgaatgcctagtatatgcgtttggtaaatgtttcacatgaactcatgtaatcatcacaaaactctgaggtacatagtattagcctcattttatgccctacctaccactggagataccaaaaataggtatgcatttttcgatcaagggaaaaatataacccatggatttttactagcttattacttatggtagaagacagactcataggaaaaatgataaaactgtataatgttattgagtgcctgttagcactgagattactaagaatgagtgagacaaggtctccatcctcaaaaggtacacagagctttggaaggtgagataggcaggtattttaatcaagttttttgttttttgttttttgtttttttttgagacagagtctcgctctgttgcccaggctgagtgcagtagcatgatcacagctcactgcagccttgacctcccagactcaagtgattttcccacctcagcctccacgagtggcaaggactgcaggtgtgcaccaccatgcctggccaattttttttttttttttgagacagagtcttgctctgtcacccaggctggtgtgcagtggcgcaatctcggctcactgcagctctgccacctggattccagcgatcttcctgcctcagcctcccgagtagctgggattacaggtatgtgccaccacgcctggctaatttttgtatttttagtagagacagagtttcaccatgttggccagactggtctcgaactcctgacctcaagtgatttgcccacctcagcctcccagaatgctgagattacaggcatgagccaccgcccccagctccggc

SEQ ID NO: 37198 - DNA, 1108 bp, Homo sapiens
ctcatgagtactcatggaatgcttttgaaacttagtgttttattagtcatgtgtgaaagccacatacatgatttctaagtagtggtaattccagccatggtgaaaattgatctgtgtaggtctgtggtggagagtaattaaacgaatggaaaaactgttattttatacagtgataagtcctgaatttcagcttactccagaaagtggagttagctacactctagtcacctttttattgctgaggtcttgggaatgattactccacttataaaaaagtagagttaatattcctaaaacttttttttggggggggacgtagtttcactcttgtcgcccaggctggaatgcaacggcatgatcttggctcactgcaacctctgccttctaggtacaagcgattctcctgcctcaacctcctgagtagctgggattacaggtgcccaccaccacgtcgggctaatttttgtatttttagtagagatggggtttcaccatgttggccaggctagtctgaaactcctgacctcaggtgatccacccgtcttggctcccaaagtgctgggattacaggtgtgagccactgcacctggcccaatattcccaaaacttttgaatgaccttaattatacatcctcatttgtataaattctgttatttgaattgctcttggcgattaaacaggcagcaaggaaaaaccgttgtgtaatacttctctatatcctccctctccctaaaccaagcttgtccgacccatggcccacaggctgcatgcaacccaggatggctttgaatatggtccaacacaaatttgtaaactttcttaaaacattataagatttttttgcaatttttttttaagctcattggctattgttagtgttagtgtgttttatgtgtgccccaagacaattcttctagtgtactccagggaagccaaaagattggacactgctgcatctaaactctttttcaaacattgtgacatatgttaaactcaaattgtttttaaaattgtgtgagcacaatgttgttttaaagtatttgacattgcatcattttttatttatttattaagcagacattatttgctgtaatacaatgctaggag

SEQ ID NO: 37199 - DNA, 1067 bp, Homo sapiens
aacattttttaaacttggtttaataaaaatgttaattttggaaaaggcgcgatgttttagcccagtgtattaaaccatatcctgaatacaacttattagtgtttaattgctaagggtcatttcagattttagccactatggcattaggctgccgattaatggacactgagtccattaatttattcaatgcatattgatggaaggctagcttcgtggccagtaccatgttaggtactagggatacaaagatgaataagataatccctgccctgaagggctcagagtctaatgatgaagaaataaacaagtggttataatacatcatgataagtacgataatggaggtttggaatatgttccctttgagcaaagacgagagccttgtcttagatctgctccattgtagataaatgatttgtctgtttactcttagagacgcagaaaggtcagaagttacctggaattactcgtagctgctgctgcttttttttttcttttccaacttgatatagggcagtaggaacccaagtaagtaccaatgtttatgacttatttgcgggcagtcccacaatatctagaagatttagctggaactgacaaaactttgattccttatacctgtgttttgctgtttttgacaatcatttagaatatctttctgtgctgtgtgtgttccatttgcccttccagatcttttctccactctgctctgtgcttctgggaaatgaattacatggggtacatcaactgagcccttcctttttggtttcagattagctttgcccagtgggagggacatcagaaaggatctccctaaaagctagttccctcttgctggatttagtgttgccaaagctgttctgtgagtagttcacaacttgtattcaataatggccctctctgccagccatctatagttacacatctttctgggttctaataacccttccctagcccctttagacctggagatgataatggcttcctgacgttgctaacctggagttataccaccatcttttgctgttttccctaaaccctgcctgtaccttttgaaatggttcctt

SEQ ID NO: 37200 - DNA, 1033 bp, Homo sapiens
tctgtacggtagaggagcctggtcactggcccatctcagtagtgaaactggaggtttgatgcacaggggattctcagtagcaggcgccagtgcctgatttatcgtgagaagcagtttaatatttcggctataaaaggctagaactagttcctaattagaaggtgtgccaggttgtaaattgtcaggttgcaagtagggatgagcacgccaagtttttgcgtataggtctaaagaagttttgggggtgggggaggatgcggtaccccagacctgtttccttgtctgcccagaccttgccatggtgtagctttccatctcttgtgacagtgtctcaaggagcagtagacattctttggctgcagcagatttcgcattgtcttcctgattggaagagttcagttatgaggcttctggttgccagttactcctttcttttgaagagaaagaactggaatcatttggataagggatgggcgttggaaggagtagttttcactttttatgtattgtataaggcagttatgctgtgaactatttatatatgatggaataaacaaaaacaaagcaagagctgctggaggtttggatagtcctactcatgttgaagtaatcagaatagtagtagtattggcaagttctcagggtgggagatctgtggctttagccacctggatggaagtctgcgtaatggtttctcagtgacaggagattccctcggttttaatccagtagttcctagttattccactctccagtttccaaccgggtcatttaggcccttgcaatcttgtggaattcttataaattctgttaccaggttttgttgttgttgtaaggaaaaattccattttgttatcttttttttttttttttggatacagtctctctctgtcacccaggctggagtgcagtggcgggatctcggctcactgcagcctctgccgcctgggtccaagtgattatcctgtcttggcctctctagtagctgggattacaggcaccgccaccatgcctggctaatttttctgttttt

SEQ ID NO: 37201 - DNA, 1129 bp, Homo sapiens
tactgctataattgttaacctcttattagggatgaaggagttgtgagttcttttgaaaatcttttcaaagctggttaccctcatccaagagaaatttctttttttttttcaagagaaatttctatatgtcatttcagagtttcccagcagccttcttgtggacctttggttaactcctacccttacattaagtctttttataggttcatcttagtgaaaagaacctagtccacttttattaggcatatgttcttttaaagaaagataacttaaataaaatttgaaaaaaattgcatttacagtaagcaactaaacaagtggtcttaatcagttcttgtttaaaatgaactgatgtagtctgcttcttcgataaataatttttgccataaatatgttggtttcaaaacaaagcaaaagtcaggagttaccaggtctcaagcactgataagtatagcagcagctatggttctagtgttattatccagaagattggagctcaataaatgtaagcctctgattgtgtttctactctgctgtatttatattcatcaaagaaaataaatacagtgaagtcatagatgaaaaaatgctaagcaaatacattattcctgttttctaccattattttgcagaatgtggctatctttacaataatgttttttcttcttggaaaaagtcagagatttcccttttgttttcacattacagttcttcccctaccaccaagaacacattgtcattttcatttatccgacagttataagcactttatagagtgtgcatactttggagcataatttttggtctcaggaccctttatgctcttaaaaatgtattgaggactccaggagctttagtttatgcaggtatagctatcagtatttaaatattaaaaaatagaatttaggttttttgtttttcgtttttttgagacggagtttcactcttgtcgcccaggctggagtgcagtggcatgatcttggctcactgcaacccctgcctcctgggttcaagcaattctcctacctcagcctcccgagtagctgggattacaggcacccaccaccatgtctgcctaattttttgtgtttttagtaaagatggtgtttcgccatgttgggcaggctgg

SEQ ID NO: 37202 - DNA, 1028 bp, Homo sapiens
cataaagcaatgctttctcgatctatctgtggtgaaggacaaaattgtctttgctgttgctttaatgttaaataaattgcaggctgatacttttgtaaaatagaataaaattgtggcaatgtcagattcctgtaaaagtttctgaacactttcggtttctatacttacctcattgaaaaaatacttaacaagtagttgtggatgggcactagtccacaaaccacaatcggagtagcacctgtgttcaaaataagcagaagacattccattttatgaatgtgtgtactgaatttgatttttaacatgacctcattatctttcttggattagaattttttagacaacttccctagcagtgacaccctgtccttcattgcaaggatattcctgctgttccagatgatgactgtatacccactcttaggctacctggctcgtgtccagcttttgggccatatcttcggtgacatttatcctaggtaagggctcttctcttgaccagcaggatgtgccaagcaacaaatgactgtgcaagcaggtcagtttaaagtgtgactgatccttttgctataaaaatgcctaatgcaagtggtgactaaagatagatcattggtgtcctcttccctgaagagctttaaaaatagaagccactcccttgtctagaatgatttaaagttcattccttccagtatagttaattagctccgataccatttatatttatcttattatttaattgctattgatttacatattgtcaagaagtttatagtgtatagtacctatgttggcaatgtgtagctaatgagaagcaacacttttaattattggtcattgaaactatcagggccaagggaaaacttcccctttgccctctgaagttttgttgaaaatgaccgacaagaggcagattaataggcaaaaagggcccggctcagtggctcatgcctgtaatcctagcacttttggaggccaaggtgtgtggatcgcttgagcccaggagttcaagaccagcctgggcaacatac

SEQ ID NO: 37203 - DNA, 1033 bp, Homo sapiens
ggtcaggagattgagaccttcctggctaacacagtgaaaccccgtctctactaaaaatacaaaaaattagccgggtgtggtggcacatgcctgtagtccccactactcaggaggctgaggcaggagaatcacttgaacctgggaggtggatgttgtggtgagccgagatcgcgccactgcactccagcctgggtgacaagagtgagactccgtctcaaaaaagaaacaaggaagggaaaggggaaggggaagggctcaaaatgagttagattacaggcagttctcatgttgcatggttcttacatgcaccagtttcattaatctggtttagttaaattacatcagttcctcctaacaacatttgttcaaatctcagttaccaaagaatttgaactattagtacttgtaaagtagtagctgctagccctcacttcacaaagcactacataaataacaagtgcacgtgataattagtaaccaatcacataacttctttcaaagtctgtcaatgactggtcactgtgtatgtttttcactgtacagtctgcaaagcagatagttgtgttaactccttgtctcccagtgataaactgacatgatattttacaaaaaatggatacttgaatggggaattgtcaaacaaagtgctacaatgaaacaaaacaataatgcaagaagtgaaatttgaattgaactctatatagagagttataaaagaaatagccaactgtggaaatgttgacactgctgccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgaga

SEQ ID NO: 37204 - DNA, 1025 bp, Homo sapiens
gcaacaagagcgaaaactctgtctcaacaaataaataaataaataacccagcatatcaaggaacaaggcagtggcttctaggtttccagaagaccaaaggaaaagttaaaattatttctctttgcctgtctgcctcaggaacaggattcactgtaagctgccatagacacacagaagatgaagagttgtggttatataagctctggcgtcctgttttcatcctttctgaatcagctaatctccaaacccacagtactgcttatatcgctcattcgtggtttcctgatttgcttgccaacttttctgtgaaacagatcttttaaaagaatataaacttatagaaggatttgctcaattgggcacaacaatcaccagacttccaaccaggttgattgttcattcttcagctccttaaggatattctgcttttgttcttttccttggtactttccctttctcttaaaaccatagcttcattagaggaattagcatctaaggccttcctgaattttctgactctactccataatgactagacttaatttcttaaaaggaataatcttctaccttctacactactaaaatattctgaatgcccattttaccttgtatataatacctgagaatggagtctggaatctctgtctagcaagtagtgctacccagtcaaaacctcatctagatactagatcaggattgttcatgtatttggcttctcacctttctcaaatatgcttttgatccacattcactgcttttctttctttaccctcttaccatctcacattaaatactgtgacagactgactctaacacttccaattcaaagaataaaagtaagtttcatgttgtttttttcaatcctatgtaatcctataattttgtaatggactctctgcttgtatcttctgcttaaactcaactcataagtaaatgaagcagttttgcattcagcattgtatgagctaccttcatctgattcttcttttcttattcttttttttttcctttgagatggagtctcg

SEQ ID NO: 37205 - DNA, 1047 bp, Homo sapiens
gattgaaaatacagccatcatcttttgaatgaccagtttgtgtaaaccatttgttgacagtgtctttccagtggtaaagcagaatttctctttgtctgtctgcctttcttgagagctatgatgaggatttctaaggcttgatgtatagaatcctttccttaagtgccttgtccatttggtgctgtgtaaggaatacttgagactggataatttataaagaacagaaatttatttctcacaatctggaagctgagaagtctgagatcaaggcactggcatttgatctgacacgggccttgttgctgtgtcatccatgtcagaagagctgaagaacaagctagccaaatgctatgctaagcctcttttgtaagggccttaatgaggggggacccctcccggcctaatcacctcctaaaggctccacctcttaatatcatcacattggcaatgccttaattttggagggaacacactcaaactatagcattaagatatgggaaaggaacaagaaagagtctatttttctttggtgatctgtttaaggagtagatgtgtttcgtttgcatcacatctatgtacagtattaaaaataaaatgtatctctctctctctatatatatatagatatatacactgaaacctttactgtctttcattgtctttctagtttttaaggataggaaattttagttaaaatgctagcctggcatttttcttattccccacttttatttcccccatggggaattgggttatgaaactggaaattttattaattttccagaaattgttctggtgggtttgtgtaaggaggagagtaataactggcatggcattgcagttactctttatttataattaagacatgctctttatttcaaaatattaagttaataatactcttaacttattgcacttaagtagattgagacaatttgcgatttattttgacatcctaataaagtggataaaaggagaagctgcttggaaaactttcccacttgggaattttttccacattcctaattttcctttgtggaatgtcac

SEQ ID NO: 37206 - DNA, 1047 bp, Homo sapiens
gttgggcatggtggcaggcgcctgtaatcccagctactcgggaggctgaggcaggagaatcgcttgaacccaggaggtagagactgcagtgagctgagattgcaccgctgcactccagcctgggcgacagagtgagactccatctcagaaaagcaaacaaacaaacaataacaacaacaacaaaaaccagagtctttgccagcctatagggctagaggaagaaaatttggaatccagggcccactaagagagacttcacgtaaactttaggttggaagcccaaagggctacagcctagaaatgtgaatgaatttgaaatagaatggcctcctttcaggaactgaagcccaactttaactcatctcaatcccccaaactggattaaggtgatctaggattgctcctgtctcaaattgacttcccaaagccaatataaactctttctaaagaaaatactttaggtttcaagttatttatacagtttttttatttacaatgtcaggaacttgctaaaaactagccaagtgtaagagaagccaggacaagatgattggaaattaagaaactcaatacacaatagaaagagacttacaggtgatccagataatggagttatcaggaacagacttttaaagaactgtctttaacatgttcaaggaaattaaaataagactgagaatttggcagtgactagagataaatatgaaaaaaataaatttgtggaaaatgttttttcaaaaagaatcaaatagaaattctgtaattacagtacccaaattaagaaatcagtgacaataatgaatgttgactagaatgtggaacagtgggaatgctcatatagtactagagtaagtataagtacagtcattttggaaatgagtttgtaattatctgctaccattgagtatacaccacgtttataatcagtaaaaatgtatgcacattgcacaaagggacatgtaagagaatataaattagaattgatttataagagctccaaagaaacccagatacccatcacaggaatggataagtaaattgttgtgt

SEQ ID NO: 37207 - DNA, 1098 bp, Homo sapiens
ccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacaca

SEQ ID NO: 37208 - DNA, 1049 bp, Homo sapiens
acacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttaattatcccaattagtgattaatttgatgaacaagtcctcttttaaatgcagatgaggatttgtgtggtatttagggatcttaggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtatttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaa

SEQ ID NO: 37209 - DNA, 1094 bp, Homo sapiens
caaacatagggggaagtcaattctttgcactcctgagacacatacaagattaatgatgataagtcaggaatgcctgtcctttgatataggtgtcatacacacaggagtcatgctgcccttttatgatgaactcgacccacagtcctttttttaagagacaagttctcactatgttgcttatagtcttttgatgaaaccagatcatgtactattcttcccaacccagagaatactgggaagaattttccctatggtgccaattaggccacagatcaatagctgctatgaaaatatgtccccatttctagttaaaataattactaccaatgttttcaatttataagaaccctgaagtctttttttaaaagtcatgattaaatttgcaaatagataaacacgttaagatagaaattgaaatccatttgggacttaagaatatttaatctaaatcttcagcttatatgtaatagtctgttatgggtttttttcccctgaactgtttttaagacccttgctttgggctacaatggtggctgttgttctcaactcattgaaaaacaagttctgatcttttccttttaaagtattctgtttccaaatgcttgtcttgtttgaaaaaaaagaaaagaaagaaagaaacgaaaaaaaaaagcccatatcctggtgccatgaattggaggctgcatttttctctagttaatggcacactatttactttctagatgtgtaaatgagtaatgagtccctggggggaaagatagtattgaagagcaaataaattccatggataagatccatagaatttttaaaaatgattataaacccatgctttcagctattaatagtaaaggttttgttgcagagtaagaacactgaattgaattacacaagtggggaaagagcaatgcatttccatagttcactttgaattacagaggttcaatttctatgttcccttgttctggtttcaaaaaaataatgttaaatataaggagaatgattctttggagaaggcaaagttcttttctatgagatttataaagcctgggtgttgtttttttcccccactctgggcattgcaaattgcttctgtg

SEQ ID NO: 37210 - DNA, 1044 bp, Homo sapiens
cttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtg

SEQ ID NO: 37211 - DNA, 1767 bp, Homo sapiens
tctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaa

SEQ ID NO: 37212 - DNA, 1060 bp, Homo sapiens
aataattacttttttagagatggtctcactctgtcacccaggctagagtgcagcggtatcatcatgccaactgcagccttgacctcctgggcttaagcagttttcccccactcagcttcccaaagcccagggattactggtgtatcccaccaccctggctaatttaaaaaaaaattttttttatagagaaggggtcttgcaatgcccaggctggtctccaactcctgggctcgagcaatcctaccttggcgtcccaaagtgctgggattacaggcagcagctaccgcgcttgtcccaggtcaccaataattcctgattgccagatactaagatttcttgtctttctcttgctcagtttctttttggaatttgacccaagtgaccattcttgattatccatacttgtttctgccttaatttaagtaatcctactttttcctcgttctattttctggcttctccctctttcttattttatgatcttttctttctttgcccgcattttaattaacattctccagggttttggctattatcgtctcactctgtgtgccttttctgggtgttctcactcaaacccactgctttaactttcaccttaaactcatcgttaccatcccatccttaagtttatcttgtgcttctgtctcatagtggtgctatagttacctaacttctcaggccagaaatctggcaatccatttagactcctgtgttgctttcattccttgtatcaagtaactcaagaaagggatctttccctaaatttcactcaaataatccccctccttagttcaggctctcattctacttcccttacaacattatttccaaaatacaaatcatgtttaagaattttcagacatacccattgcccatagtgtaatacatctgaaagttcttctgataagcatagatcccttcctcttttctctctaccctctccgtgggtgagctcatcaacttctgtggctttaaatatcatctagatgctaatgaatgccagatttatatctttagcccagcctggttctctgagctccaggctcctggccaacct

SEQ ID NO: 37213 - DNA, 1113 bp, Homo sapiens
tcttgaaaagggcaagcacattcttatatatatcatctcctctgcttagtagctttgtgaggcaggagtggagtattattttatttccttcttcatgttaatacacagggaaacagaagagtgacttaactgcccacttgctctgatctgttgttcttatctgtagtgaagtacaactgtatacatgtggtctctattctttttattgatgtttaatgaaacatgaaaatgaataaaagaaacagtagagacacaaatataaagagtaaggatcaagcttttagaaggaattttaaattatgttttgattatttctatatcacttgaaatagtgtattctcttaatcttttttagtggaatagggatttaggtattggtgcatgttaacagtcttaggggattgatgttaatgttcattttcaagaattataagtttttatgttcatagtaaataaactcagttgtgtgttgactgtaatgtggcccatattttggtgtttacaaatttttagtacgtcgtgttatggaaaataaggtaagtactaaagcaattttctcgtagtagcactttgagtatagaatatgtggctagattttagttactaaacatactaaaatagggtttatgtaatatctttatatattttaatgtatgcatattactgccatctgagagcttttaatagacctagatttataggtagaactttttttttttgagacgaagacttgctccattgcgcaggctggagtgcagtggcacaatctcggctcactgcagcctctgcctcctgggttcaagtgattctcctgcctcagcctcccgagtagttgggattacaggcatccaccaccacacctggctactttttgtatttttggtagagacggggttttgccatgttggccaggctggtcttgaactcctgacctcaggcagtccacctgcctcggccttccaaagtgctgggattatagcatgagccaccacacctggctggtagaactttttaaagagttcttatttctacttttattaatacataattacccccttgatgttcactgtgagaaaaattcaaaaattcagaaaagcacaaatgagaaagtaa

SEQ ID NO: 37214 - DNA, 1283 bp, Homo sapiens
aaaaagaaaatttgtaatggtggatgtgagctaattaataaatattcttatttcttttttgttgtttttttgttttttgagatggagtcttgctccattgctcaggctggagtgcagtggtgtgatcttggctcactacagcctcgacctcccaggttcaagcgattctcctgcctcagcctcccacgtagctggtggtattacaggtgcccaccaccatgcccggctaatttttttgtattgttagtagagacagggtttcgctatgttgaccaggctggtctggaactcctgacctcaggtgatccccccacttcggcctcccaaagtgctgggattacaggcatgagccaccaccccggcctatatttctttttaaattaaaccacatgtaaatcaacaagtttttaaatgagcagatatttttcaacattaaggaagataacataatgtaaacctgccaaaaaataaagtcctgtagaaattgtatttttagaactaattagagttctctgaacccagaatcaaaaataatgaattatgtgtgtggtttttccatagtgaaaaatctttggcccagttcagtgttttggtaatgatctcacactgtcctgaaatgtttgaaattttaaaatattcagtagcttgactaagaacagattaaactttttatgttgagtatgcttccatccacttcttccttcccccaacctcagtttctgatactttccttccttgctctgagggttacgggtctaattgaattggatactagagtaaaacaagtggagaaaatcctgtttttttataaatttgatttcatttctttgggattatggattttagtcatttcttctcttggtttttggagtttcctattgacttcatatttgctattaaaagatattatagttttataaacaagtatgaattatccaaaacaacttgcaatggatatatcttccaaaaccttcagatgtgattttctgtattccctacacataatcctaagaactttgttagtaatccaaagtaaagcaaagtcttacagtttaatgcttgtctgattaatgctagggaacttgaagtactgttagagaaatgtaaagtgatacaatgcttttaaaagctgaatggctgtatagctgcttcacagaaacttatatttgttttataaagcagatttttgttgtgttttctgtctttatttgagggttagaatttgagtaaaatttatattatcctgaagtgtgcatcttagtgtatagtcgattcttgtgaaa

SEQ ID NO: 37215 - DNA, 1049 bp, Homo sapiens
attattatactttaagttctggtatacatgtgcagaacgtgcaggtttgttacataggtatatacatgccatggtcgtttgctgcacccatcaacctgtcatctacattaggtattttgcctaatgctgtccttcccctccctacccgctcataggccctggtgtgtgatgttcccctccctgtgtccatgtgttctcattgttcaactcccacttatgagtgagaacatgtggtgtttggttttctgttgctgtgttagtttgctgagaatgatggtttccagcttcatccatgtccctgcaaaggacgtgaactcatccctttttatggctacgtagtattccatggtatatatgtgccacattttcttaatccagtctatcactgatggacatttgggttggctccaagtcttaagcaaagagttttttaaacctgtgtatgcatgacattttagctgtgcttttgagacatagctatggtttcccatactaatgctattccaaattctttatgggatttgagaaagaggagctagctatttaagtaactatttttatggttataactacagtcaaatccttcatctgtctgacctgcaatgataaaaatcagctattactttaaaaggcccaaaagttatggaccaagtgccagaaagtgagctgggagaaagaactcaaataatattgagcatctactatgtgccaggctaaatagaagacacttctatattagctcattaaattatatgatagcccataatttactcaagaaaatataactttgtaaagagggacagaaaaaattttgaactctattataaatgtctacaaatattcttagaaggcccaaagtttatttttttcagtaggttataagatataatgctgagtgaacacaagcagtaacctatgttctgtataccacctgatgccagttttaaaaatatgtattcacatacaagggtagaaaaaaggcataaaaggaaatttaacaaattatctgtggttatcttccagcagtggggatttacattattttcttt

SEQ ID NO: 37216 - DNA, 1046 bp, Homo sapiens
ctactgtgttttcttctagaagttctttagttttagattttacatttagttctatgattcatttcaagtagatgttagtgtggtgcaggataaaggttgaagtttcttgttttatgagtggatgctcaattgttcaagcattctttgttgaaaagaatatcatttctcttttatagctcaaattttattacttaaaattattttaagatgcacatattaaagtgatatgtgtaaaagattatatatttctggaagcatgcctatttacactagttattattactttaggagacagatattctctttgtttaaattgtttccacaaagcataccacgaagtacagaggggacattagtaactattttatgatgattatggtattcatttaggccaatttaagtgaattggagatcctaattttctctataaggagacaatactttttcatacaagattatttttgtggaggcttcatttatgtgaagtttttgcacccatttattgtcatgattattcttcagtgaaacaaaagtctgtagtagatatgctgctgctgctggttttaggtaaattgactaaatagttatacaaaactctgtctctaccatatatgaattcaaactgtatcaacaattacagaatactatgctaacatctaataagagagttagcccatgtagaagagaaatataaatacagctatcagatcagtctcatgttatttcagcttcaaggagcctcttagcaaaaatggtttcctttctccatacatgttgcaggtgtttactattttaaatgagacttttttgttaaaaaaaaattaaaataagatcatttagagaacgattctcagcttgttcagatgattatttggttttaaaaaagcagcctggagttcctcttaatctcaaatctccataaaacttacaagagatgttttcatttactgaaaggaatagttttttcttaatcaaatgtagagccattatcactagagggcagtaaatacaaacagatttagtggatttactggcactaacgatgt

SEQ ID NO: 37217 - DNA, 1025 bp, Homo sapiens
gcttttaactactagcctgcgattcgtataatcatgttagtttgagaaacactacagtaatcacacatgtaagggctttggagtaagatggaccttggttatccaacgcttactgtgtgactttggtaaattacctaaacttttctagccttggattttaatgtgtaaaagatagataatactaactcagtaattctttatgggttccatgagacaatgtatttaaagcacccagcatactatctggttcatagtttacagtcaataaatgttaattccattatttgatcacaatgtaagactattgaggtttaattttgattgttttttcaaaagtttgtaatctgttaggaacaatttctaaagtaaaattcagaaaacaaaaccatcaaaatttaattcagctaacatttttgaggttctatatagtctcgaacatatattatctaattcgattatcactataaaccctgtgtatagtagatattatcattcccattagtggatatgcaaaccacggctgtgggatagttttacatttagtaagtggcagatccaagtctagacagcccaggctggttctctttatactctgcctggcaacatttgccttcatcactgtctgttttcaaaagtaactaacctctacatccctgctcacacatacaaatagctctaaaggtacaaaataaagctaattttctgagcaattcattttattcaaatcagtctaatgatctgttccatgaaaaatgattatgtagctcaaaggtcttcaaactcgtctcaaaccaggggtcaggcagatcatattcacataaagggagaagcttgccagccagaagtcaataaagattcctgggactggggtgacctggaagctacaacctgtttaaaggagacagcttctgcctagctccaggctagtgctcaagtgccaggatgtgggctccctattgtcaaatcttttttttttttgcttttttaagactggaagaaatccaatatttaatgcgaaacttccc

SEQ ID NO: 37218 - DNA, 1032 bp, Homo sapiens
taacctttacactagttgtgaaactcactgaaaacaaaggagaaactcattataattcatctaaacattcctgaaatatcactttaatcaaaaaattaagaaatattgctcagatttaaaagaaaaatggaaactcccttggcaagtgggtttgaggtttggtcattaggttttgaataatcaggagctatgtgttgtagtaggaaaagcataccatttagagagagacagctttagtttgtcagtcctgcctcttaataggtggatgaccttgagtaaagcatgacgcagcctttgggcatcagtttcctcacttaaaggtagaagggttgaaccaggtgtaagctgctgttcttccatgttatgattctaaatagttctagatggaattatgttgcacatttcatatgttgttaaacagcttctctctggaacagttgctcctaatctcctaataagcttactatgggtcactcagcaatcttcaagagaaacaaacattatttggttggtggataccaagacaattctgatgtgtttgtgtcaaagattggtcagatgaaatctaactagacatgtatcattccatcatcaagcgaaatgaccttgactctaaacatcttaatttgaactgtagacatttcccaaatgctttagggtagatttggaccataatacactccactgtaaatggagaaagttcatcatccccataataattgcccccaaactgctaggtaggaatgcatactgggtttagtatgtattaactcccttgtgaattcagcttttgagagcagacctcttaacaagtcatgagtatttagagtgaaatatttaattcttagtgatactattttcctattctgctattattattcagctatgattattttccttctcctcccaacctcctatttctttttctttattaaaaaaaggagaggaggtgcatgctgccatctggggtgaatatgggcttcacgtggggacctgggcgctggttctgatccagagagtgagctaggagca

SEQ ID NO: 37219 - DNA, 1061 bp, Homo sapiens
atgtacaaggtaatgcattactaagcttgtcagagcttcccaacaacaacaacaacaacaacaacaacaaaactagttgctaagttacaagggacattgcctgtgaggctgtgtcgtaaaacattccacatggagaagaaagggtgagcaatttttctgtgcataggtcttttgtctctcattggtcaaagtttgctccatggtacccttggccctcccagagtccctggggaatacagagcctttgtccatctcacgtgtagctggatggttcctgtcaagtcagaggccattgcccacgctaagcccgcaaggatggggaggtggaaaacatgaggcaattgcagtgataaccgctgctttactggggctgctgtggcatgcctgggaaactgggagagtggcttatgcccaaggggtagggtgggcagagctgacctggggaggccacaaacaggacctagtgtacttttctacagtatactagcagaattagaatgaatcagacaagagatttattaaattaagcttttgtaatgtcctgatgtagtgcactgtattttaatgctgtgtcttctgttgcttgagttcctaatttgtaccaggtgttgtgccaaatgcttcaaataaattaccttgtgaaatcctcacgactctatggactccaatttacaaatgagaaaactaagacttaacttgcttatcttcaccaagctaggaagtggcagagttaaaatttgaatccaggtctaaagccattggtcttctatgccatagaatcggcatccattttgctactcttactagaaaatcatgaatcctagctatgaattgtagtgaggaggaaagttttttctgtttcatgtttatgaaaaaatctctacctttttcattttgtgtttcatgcatgtgacagcattttcagagattttgtgtaagagtgtgtgtatatatatattgtatatttacagacagaaaaaaattgagattaatttttcaattctctaagtcataagagaatggaaaaacagaaatggacaagcagaattttttatcccaat

SEQ ID NO: 37220 - DNA, 1035 bp, Homo sapiens
tgcctccctcaaattttatctcagttcatttgttttctccgatcttctccttttcacatgttctctactctattctcttgcctttttcctttccttatatctgcctcttctttttccagtctcttccctcactccttcccttatttgtcttgtttcccattctttgtctaaatctcctcttttctctccctcttcaccctattcattcccagctccctaaaattatatcattcttccttcatcatgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggaaaaagataatgcctccttctatggtcactaccaggaagtgagctccatgcagcagacagaaaccaaccagataactgtgagatcccagccaagcacaatttctacatgttagtcaattgcaagaaacactgagatgtaatgtagtactttggactcatattactcaggtgactatgttttcaagcagccagtacaggacagaagagattcatttccttgaatcaaagctatttggtgacttttcctggaaacactctgaggcttacaggaagggattccagattcccaagctactggcacagagtaagcatcttttctttacatagtaattcacaaacgtccctcatcaccatatgacaatatcctcactggatcagctcggttaccagaaataactagatcaaaataaatgtcattctcacatggacacaggtggactagggtttagaagttttgggaaccatcacagttctaggcacctgaaacttcttcttttgcttgtagtaaatatggt

SEQ ID NO: 37221 - DNA, 1049 bp, Homo sapiens
tgactcttctgaagtgcccgttgtcaccagagtgcccaggggcagagcattgacaaggaaaggcccaggtgtgtgtgagaagtcaggcagatggggtgtttcggaggaaccagggtaacgcagtgcttcagcgttagcactcaccttgcttctgggaccacttaccacgaaggcctgaaagggcaggccccaactactgggaatattaatcttctctttgggtgaagtctcttcatgccattatcatctcttagctaccattgctaggcaaaagtttcctagctcaccatgtcctgaatgcacttccttgagatatttctgatgcttaaatatccagtgctttctagtgtgccgtcttccttctgtatttttgttttgttttgttttgtttttttgtggttccttttcagcactgttggtcctgtggaagtatttctaattgactgtattctatatgccacacaaaacagatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaataaagaagagagaaaggaagggagagaggaagaatggagcagatgcaggtgagattgtttttctaaagagctaagaagctgcctacagtgttagcttagagactgaaaatggtttgggaaaataattcagaaatttagggaatacttcacagcatgagaaagtggagggctgagattggtaaaagaagacatgtttcaaaatagccaaaaggaaaatagaaaagaactggtcgtgaaaccgagacctcagagttgaatgacaa

SEQ ID NO: 37222 - DNA, 1070 bp, Homo sapiens
taatatacaatgcagaaaaagttcaatgagatcaaaacgttgggatctatagatgtttgggaaagaaaaataggaggaaagatgagaggagccaagtgcataaaaataaaattatctcaattcctattagtctgttttaggcacaggacttgaccccagctgaaccaaaaacagaatgcatgatctcattttgctgaacctgaaaccaaattgaactcttttgactatttcttgaaaccccaattgattcattaaaataattgcctggaaaagaaaacctatgttttctaaaattattaccagaagaaaattagcatattctccaaactaaaacaattcgtcattggattcaagtgtcttccttgagctccaacccataatgtgctgaggagctcttattaagttattagtgagtacactttgcttgaaatttaactttatcatgtccagacgtctgtctgtgtttgtggtcaccacattagagttgattctggaatcattgttaatgtcatcttttctgaatgtcatcaagtgaaacttgtatttcaatgaatgttaaattattgatctcttcttcatgtttctctttcaacatattattggtgatgacttccaattatcattttatagtacatatatggttaaccagttttgttcttgatattgatcaagagatgaacaatagggccaggagtggtggctcacgcttgtaatctcagcactttgggaggccaaggtgggtggatcacttgaggccaggagttcaagaccagcctggccaacatggcgaaaccccatctctactaaaaatacaaaacttagcatggtggcgagcacctgtaatccaagctactcgggaatctgaggcaggagaatcgcttgaacccaggaggcagaggttgcagtgagccgagatcgcgccactgcactccagcctgggcaacagagtaagactgtctccaaaaaataaagagaaagagagatgaacaataacaattcctatatgctaaaataaatactttgagtaactgatttcttctgccaaaattcaaattcaacataaatgagtc

SEQ ID NO: 37223 - DNA, 1067 bp, Homo sapiens
tgttctataaccttattatacttgaatattgttatatttctctaggtttaggaaggtctctgttattttccctttgaataaattttctacccccatctctctttctaacttttttttaaggtcaataactcttagatttgcccttttgagactattttctaagtcttctaggaatgcctctttcttttttattattttttcttttgtcttctctttgtattttcaagtaggctgtcttcaagctcacagttctttcttctgcttgattgttttgtgctgttaagagactctgagacatttttcagtatgtcagttgcgtgttttaactccagaatttccgcttgattcttttaaattattttaatctctttgttgaatttatctgataggattctgaattccttctgtgtgttatcttgaattccattgagtttcctctgtctaaaaggtcacatatctctgtctctccaggactggtcactgatgccttatttagtttgtttggtgatgtcatgttttcctggataggctttatgcttgtggatgttcgttgttgtctgggcattgaagagttgggtatttattgtagccttgcagtctgggcttgtttgtacctgtccttcttggtgaggctttccagatgcttgaagaaacttgggtgttgtggtctgagttttgggtcactgcaggaatatctgcattagggagcactccaagcccagtaacactgtggctcttgcagaggtaccaccttagtagtcttggataatatccagagtcattctctggattaccaggcagagactcttttttctcttctcttactttctcccaaacaaacagattcagtctcagtctgtctgtctgtctgtctgtctctctctctctctctctgtgtgtgtctctgtttcctggatctgggggaggggtaacacaaatacccctgtggccaccaccactgggactgcatagggtcagacctgaagccagcatagcactgggtcttgcccaaagcctgcagtaaccactgcttggctcctgcctatgtttgctcaaggcactagggc

SEQ ID NO: 37224 - DNA, 1037 bp, Homo sapiens
aggtccaggggaaacaggtgtatgttttcttcacatttgggtagggaggtagatattcctgtattgcagaatttctgctcctcagttcagctaaatccaggttctgtgtcacgaccaggaaaagttaggcatgcagacacgtggaagggtgaggggaatggaatttattatttattgggcgaaaaggaaaacaagaaaagaaaaactttcagcaaagtgagaggggtttctgccagcaggctcccatctcacagattggattccaagcccccacacacgagctaaagttcccaggctctttccccccaacaaggcatgaacttcctggtagctttaccccatcgtcgcagtgcacaggcgggcgggagattctccagggatcctccctcttatctgcctcctgcatctatcacctgcattattgggaacttggtttgaaattgttatatcctggagaagacaaatttatctagtaggttaaaaggcaggggccaaaaagaagtagacgtatggagacagctggttcgagcaggggaggaaccatgtgagcaatgggagagcagattttacagagttccagatggaatctgctgagggattttctttcccagagtcatgaagccacttagcgtggtcacagattctctttatatgttcctctacttgcccactattgttgacacaagtgcaatagggtttattgatgacagcacagacgactctgttctgcaaggaggtaatctagagctagtctgttgtccatgactgcattagctactgaattcagtgaagccttgagtttagagattctgttcccagttctctgacctaggtctccaatttgtgtagagaggttttggagggtgactttatgataactgaatcctctgtatggggcagctaatcctatggcagcccctagccctaccattataaggccaagagctctccttttttaagaatttgtaatgttatagatggttacacctgttccttgtggccccaggagtcctagggcacatcccctgtatgttggg

SEQ ID NO: 37225 - DNA, 1002 bp, Homo sapiens
tattgaagggacccatgcaccaccaagtattcaaatcacaatataatttcattattctctaccctcccttgcaaatgtaataactctgaactgataaacacattgtacctgtgtagaaaaatgccacccagaaggaagctgactgctaatctaggcctgtgctgtccaacaagagagctagtagccatagagcacttgagctgtggctaatccaaatcagatgtgctggtaatgtaacatgcacaaaggatttcaaataatagtgtgaaaaaaagtaaaaattttctcatttgtaattttcataatgattacatgtttaaatactaatactgtgtatagggttaaataaaacatatttaaattaatttcacctggttgtatctaagtgtccatcagccaattaacggataaagaaaatatggtacatacacacaatggagtactattcagccacaaaaaggaatgagatcctgtcatctgcaacaatatggatggaactggaggtcattatattaagtgaaataagccacacacagaaagacaaactttgtatgttctcatttgtgggaggtaaaaatgaagacaattgatctcatggagatagagtggaaagatggttatcagaacctaggaagggtagtgagtggcaggggtgtgggagtggagatggttaatgggtacaaaaatatatttagatagaatgattaagatctagtatttgatagcacaaaagactgattgcagtcacaataatttattgtacattttttaattaaagagtataattggattgtttgtaacacaaaggataaattattgaggtgatggatacctcatttaccctgatgtgattattaggcattgtatgccttatatcaaaatatctcatgtaccccataaatatacctactatgtacccacaaaagtaaaaagtaaatacattaatttcacctggttgtaaaaataactttttgtaatatggctttttaaaaatttaaaatt

SEQ ID NO: 37226 - DNA, 1050 bp, Homo sapiens
ctgacatcacgcccggctaattttttgtgtttttagtagagacggggtttcaccgtgttagccaggatggtctcgttctcctgacctcgtgatccgcccgcctcggcctcccaaagtgctgagattacaggcgtgagccaccgcgcccgactgggaactgaaggttttaaacctcctaaacattcaaaagaagcccaaatctcaactttaatgtgacattttctgtgtgctttaaatgttggatcaaaaggaaaaacaaaattaaaaatatgttggacaaactcaggcctgctgtccatatttgatccaaggaggaccaatttacccactctatcctacacctttcaggtcatagcattttcctttgttatctttcggcattaatgtcatattccaatttttccatatctatgagcaaggcccaaggtctgtagccaagcccagggtttgcatgtgatatctttagaaaaaccccagagaagctttctcttgttttctcactatgctgtaagtatgaatagcccaaagcaaaaaagacaagtaccctgactatcatgatcttctaagtattcatggagctcgctaaaattatagttccctgtgaagagcgtgtcgttgcagaaaagcactggagagtgggcttagataccttcctgtttgatctcaatagtttaatgtttactagctcactgagaagagactgccaccttagtgttaccctcttgtaccaccctaaacaagtcatttatttctcttgttttctctctttaaaaaaatttccatatgaaattctgtgattttttttcccctcattacctattttctatcatcattgtatccaaaaggtcaagagagagaaaaggccacttctccattgactggttatctcttagactgtatgacagcaaaaatataagcaagggttaaatttcaaatgcatccactctgctcatacacatttgtgatttaaaaaacacacttcattgaataatttaaaatatggttgtaccatctgttcttgtggggattaacattgttcatgatggcaaa

SEQ ID NO: 37227 - DNA, 1035 bp, Homo sapiens
tttaatcaatgtaatcttaaaatgagatgaccttgtagccaagcattttttctttcctttataagcaatattaactatattaaatcaagaaagctaatagtttttcgtatttctcaataaccattaagttcaaacattggaagagtttaatattttacatgaaaaatccacaggcaataattttaagtgacttagaaaatatttaccgtattttaaccttaaatgactgtgtatgtgtgtgtgtgtgcctatgtgtgtgcctatgtatgtgtatgtatgtttataatctagtagttctcaaggagtattggagaaagaatatgtgatcacatgtagtttataaaagctctcgtgttttttgaaagacaaattttttgtcaatctagtggtaacatgatactaattttttaattaattttaatttccctgataatacatttaagccttaaaaatattgttagtgattcatgtttctttttctataaaaattatttctaagccttcctcaaatttcttccagactcttttttctgattgatttttaagaattttaaaaatattctgcaatttctcttgatcacaacaagtgttggaaatatcttctcccgaagaaaagaatgattcttaaaaaaatactttagtagcagtttttttctatgaaaaaattagaagtagctttttcttggcagcgttttcttctagagcaatagggaggaaaacagaaagctgtagactgttatcttcgtccatacatatgttagtgctggaactcaactccaaaaactttgttcctttgaaaatcatatccctccagaattggtggagtggtgatggtgtggtgttgaaggcctattgccaggactgagaaggaaaagctaaagaaagagggaaaaaaaatccagagaaagtgactgcctggggaggagggataggcaagagaccaaacatcgattctaaagggaatcttgcaaatgctctggcaagtctatgtatgggaacatcatttgcctagaagatgctcccctttactccctt

SEQ ID NO: 37228 - DNA, 1055 bp, Homo sapiens
gaagggaaggtaaagaactataagttgatagacttgcaaaatggagaggctgcttttaggaaaccattgataatagtatcaatcccattgataatatatgtgattgcccttttataaggccatgtgctttctgcacaattatgataaagtatttagccaaacttgtattccctatataaagggggaggagatagtatcccatggggaattccttcccatattataaactggtagacaacttaagcaaaaatgtttttactcatatgaacactgttgaagtataaagccaggtatttaagtcatgataggtgtttatttactttgaacatttgccagaagtttgatgatgggtatatttgtagactgggtgttagaggttgttatattctaaaaagatatcttctgattaattttcttcatttataaaaacaatctattttgataacatttaatttatgaactttggtgtcatgttacactttatacattttggttgtacattccctgtaatgcttacagagacagccagtcaggcaataattgctacatactgagcgccttctattttctgagtactattgtaaattatagagataaagcagtgaaccagacagagtctccatcctaaaagagcctagtagaggatgggaactgatgtagtatcttgtaattgtcacagcatggtacacttgcttcttcagatgccattattaagggcgtcgtttctttaaattctgagatccctaactcagcttatgccagaactgatgagaattagaccttcctaaggtcttctttcttcctaaaatgaatattgaaataaatctataagataaaaataatcctaccaccaagccccaattaagactggatttttaacttgctcttctcagcacaatgacacaacagaggacacagaggttaatggaatgtctttggagcaaaggagatttcaaaaccaccagtttgttagatttgatgatcagctctgcaaaatgtttaaagaagatttcttactcatatcttataagttaagactataaatggtttaaatg

SEQ ID NO: 37229 - DNA, 1075 bp, Homo sapiens
tggttgtgaggattgctgcaggccctctcatgatttgattgagcgtttgtctctgtctttctctttctctccttctgtctcactgtgtttctaagactttctctatgtggtagcaaagaaagctcagacagcacaaggctgcctgtagtaattcttgtgacatgagagcatacatctcccagtagttccaaggaaaacccagggctgacttgaaacgtgtgcacttggattacaggtcaaccttgagtcaattgtgactgactgaccaggcctctgtgtgtcccggttgtggaggtcagttccatcagtaggagggggattaatcaaaggaaaatcagaattctttatcagaataagaggagaagatgcatgacaagtattcagagatacactgtaaccagaaaaaatggtcatatgtgaagagtatctcattacaacagggaggaatgtagttctaagtcttttaaagttctgctttcctataatatcagatgaccacatatttcacagcataattgtgaaaatgatattttgaaaggaaaaaggaattcttatctgagataaaactgtcaaaaaagtcaaaatttggctgtgaaaaaagtgaacgtttacttgaggttgtcattacttatttccttcttatataattcatataattctatattattatgacattcatataggcaaggtgttaaattctaatttgattttataatttttcaaaagagacttagaatgtgctagaaatcctaaaaatttctgttccaactattggtatttgaattatgtatatactgcccctttttttcctataaaaaactgatagaagttcatagataaataaaattcacagataatgttacaaatttatttcaaatgttacttcttgcctttttctatgccaagatacttaacaaatacttcaaaattgaaagtatttttactccttattttatctattccacagaatagttagaggtagaggaagaattagataatatatttattaataagtcaacatcctattaatggatgaacatagaaccaactcataggcaacacagtcagaaaatca

SEQ ID NO: 37230 - DNA, 1112 bp, Homo sapiens
ccaggtggggtggctcacgcctataatcccagcactttgggaggctggggcaggtggatcacgaggtcaggagtttgagaccagcctgaccaacatggtgaaaccccgtctctactaaaaaatacaaaaattagccaggtgtggtggcacgtgcctgtaatcccagctacttaggaggctgagataggagaatctcttgaacctggtaggcggaggttgcagtaagctgagtcatgccactgcacttcagcctgggcgacagagtgagactctgtctcaaaaaaaaaaaaattcttagaaattaataaggaaaaaaatgacctttcttccaggaaaatgaacacaatccataagaaacacaattggtgagttacatgaataaaaccccaactttaaagaaatacaaattaaacaatagtgaactaacattttctctaaagagtattcaagattaaaaaacaaagtcaaaactagatgataacaaattcagcgtattgactaaagtcaggacattcttattcattagcaatgaaagtgaaagtttgagtagctttctagaagagaattcaagtcacactatgaaccaacaattttactttgaagaatttatcctaagaaaaaaattaagaatatgtgaaaagatttagttacatcaatgtttattatagtggaaaactgaaaatgtgccaagaaaaaaaatgagccaaatattcagcagcgggaattagcacaatataccttgatatgttatcaaggtaaatgtgtatgataggatactgatgcataaggataatttttaacatggtagattttcattatgttaaatgaaaaaataaaaaatacataaaatgagagcccatttttataataaaaaatatatagtcattcaaggaaaacatgtagacggacatcacaaaataccaacaacaggtatggttcaaagtgttataggtggttttcagcacatagattacccctagcaaagagacctctgtgacacttcgtttcttcatctgtgaaataaaggaatcatactagattagttctaaatgcttttagcaaaaatatttcataattctatgagtattgatggttaataaccttgagaaaat

SEQ ID NO: 37231 - DNA, 1068 bp, Homo sapiens
agtggagcaagagacagggattaatttgcatagccaccttggaatcccaaactgtcaatggtgtcagtgatgctgtttgcttgagtccctaaagggttgaatgaaagaagttaactagatacagagttcacagaaggtcaataatcttagctttccaacaagttggagatcggggtaaggagaagggcagaccttaagaaaagagttatacttattgccaggaaacagtgcttccttttgctgtttttccacaaacagatttacctttgccctatgcatttcatcttattttaaaaaacaaaacttttattttaggttcaggggtacatatggagattttttttaatataggtaagctcctgtcatgggggtttgttgtacagattatttcatcacccaggaactaagcctactacccaatagttattttctctggttgtctccctcataccaccctccaccctctggtaggccccagtatgctgatcctctttgtgtccatgtattttcattatttagctcccacttacaagtgagagcatacagtatttggttttgtgttcctgcgttagtttgctaaggataatgcctctagctccatccacgttttgcagaggacatgattgcatttttgtatgactgtatagcattccattatgtacctgtaccacattttctttatccaatctgccattgatgggcatttaggttgattccatgtctttgctatggtgaatagtgctacaacgaacatatgtgtgcatgtgcctttatggtagaattatttatattcctttgggtatatacccaggaatgggactgctgagttgaatggtagttctgtttttagccttttcagatgtcaccaagctgctttccacaatatttagtcttcttacacccccaacccccttggaagtttagaatggaagcacatttcttcagatgattattaactctttgctttttctgtttttactgcatcatttaaattatggtgtggaacatcgaaaagggccctaaagcctctattgtcaagtatgactgacctctcttggtaaagcgaga

SEQ ID NO: 37232 - DNA, 1440 bp, Homo sapiens
acccaagcccctctgaagctaaagcctgtagagtacatgctcccttcctccacatcacactgcccctgcttgttcacactcaatgtgagaatccacttctcaagtttgtcttgcttattccaacctgttttgcaatgaatctctttcaacagctctatagttcctggcactcacttggcatccatcattttctatgttgtcatgtttggtatcttttcatgtatgtaatgtgcatctcttcttaggagtaagaccagaacttttctgctctgcagttttctccctgtgagggatggtgaaacttggtggctaagagcatggtttatacagacagacttcttaggtttatattctggctctcctctgtacttgctgtatcagctagggctgatgtcttcacttttttatgattccatttctacctctgtacaataaggcaaatatgaatacttacctcagagtgttgttgtgaagatggaatgaattaatggccataaagcacttacagctgtgtctggtacatagtgaccactcactaatggtcacttataattccttcacaacctgtaagggtcctttccacccaggtgatgtccctatgtctcaactgaatgactggttagggatatctttccatgggctactgtggctgcagataattgcattcttatttgagagttatgttaactagtgtgggcttttatttgcttctctctttctatcaatgagtcctgctgcttcaaccctgggttaactgaaatttgaaacctttttctactcaaattcctttgatgctgaaattcctctgcggtcacagctaagcactttgtgtggtaaccttctcttctgtcctcaggcctgctgagatcatctgctcagcagcatgtctgacacctgttgccacctcacccagccacttccttggtgacctggcaatgcccagaggggccctgccagcttggagccctgtggcaatgctgtttgattcagcaaactgatagccttctgacatcctttcttcattttagcagccaaatcacatgcaccttaatatttatcaatagctaagcaacaccggaaggaagtgagacagagcctctgggctagtcactatctctgattttacagaatggttaagccaggtgtaaaatatctcacaataacatgccctgttgtcctgaggattcaattccaccgagatataattaccatatgaggaagtgagaaatagggtttctttctaatacacagaaaatagaaaataagatgcttttcttggccactgttatcagtttcctgttaaggttctgctttgtttaaaacagtcctgttttgcttaaaaacaaactctaaggaatttttctaaaacatgactcaacctaactaggtatatatactgtactttaaagtgaacatatttgaaataattgtgagtgacaa

SEQ ID NO: 37233 - DNA, 1051 bp, Homo sapiens
agtgaccatacatgaatatgtgcctaagaaagaagaaaaagcaatattcatttctaaaggacagcatggcaaagcaacctgaagttttccatttcccttctaacacttctttaacaaggatatcaagaaactgtcttttgactcctttcttcccacattccagagtccttccttaaggatgcattaatttacactcaaggcggttagattttaccaggacaatatttgccaccatttaggattattagttgaactggttattttagtatgttgactaactagtggaacctaaatggatggacccatacctgcagtgctctgtgatgtttcttttttcaaatcctggaaggccttttgtaattgctatttgtttttattggtggggggagattttttttttttttttgggattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatggtgagtaatcaatattcccttcagtttgtaaaactcagaattatcaaattccgtgacaggtaccagatgaggatttgtcttgaactagagtattggtatcaagtgagaatgaaaagtaaactgtgcaaaaccgaatattgtctgagaaagtaatggttatgcaataaaaatactttgttaatatgaagcatccccaaataagtcaagcatgaggacttgagaacatttaaattgctaatatttcatggaggaagaaaaaaactttgagaatggcaacaatttaataaatttttttaaagatgaggcttagggtttgttttttgttgttttgctatttttatttgaaaattccctggggaagggcacacatgaatttctgatatatcaatttgtctgaatttctaaaagaaggttaagggaaacttagaatgttgactcaattttaaaataatgctaaaatgtgttggt

SEQ ID NO: 37234 - DNA, 1046 bp, Homo sapiens
atttatatgaacccaatatgtagaatacagggaccaagtgttttgtttttgacatctaagggacaaaagtaatccagcctcttgaaagaatggagactttccaaaaatatctgaactgattattggtattcatataagataaataagtcatcttttaggtctttattctttgatgtctaaatatacaggagttttatttcatcaagttatttaagaggcaaacattgacattagctattgattataccaaaatgcaatgatgacaaaaaaatataccttaacatttgacattaaagttactttctgaaagtgaaactcagggaaaatcaatgaagtaactcatcacaccctctgataagtacaagtgactaaagagtctaggaaatacccaacctcaggaactagggtgtgactttattatactatgcttatactagcataaaggttgaacttaatcattcttttatgctcattgtgaaggaagtgtgtaagttgaaggcattttaagaggatgaaatactgaaactgatattacagagataagaatttgtgtagaaagtattaattctgtatttctactgttacatttttgtaattttttttaaagagccagactttttttgtatgtattatcaaactttgagataaaactagttaaagcagaagagctcttgttgaaacagcacaaagtacctggcttcctagacccagcacaaagtaccttgcccctcagctgacctgatgcaactttgaaaaaccatagggttcccagaaacttagtttgaaaaccttcactcttatgagcataaccctataaccatgagagaaaagggttttattggaaaaggacgtgggacaccggctagttaatacttctggctctgattctggatgcattaagcgatctttcaatgaaaatgttgaaagtattttggtttgctctgagtttgtagtttatcaattaattgagctttttattgaatcagcctcatttaagggtagttaatataagttcacttactcttgtgcttgctgtgggattaaaa

SEQ ID NO: 37235 - DNA, 1043 bp, Homo sapiens
ttggcaactacagtaggtcttccttaagattgggcatggaagagacaaatgtcggagaaaaatacccctcttgttttgagtggagaaaatcagaagaaagggagagagatcggggtgtgccgaaagcaaagccaatgtgatcatcaagataataatagccatacattaaggtagtcaagatcatagacttgagatctgaacttggatggagatgatgaactacacagttttagtctcatcaaaaagtcagctacatcagatggaactgaagttgtttgttttgttttactttttgatgctgtaataactctggcatgacttttcacagcaaattagaattaagaccttttaaatttgtcccaaatggttattgatacctgcaataatacttttccccctggaattatattttcctcttaaaatatatgtgtgtatgcatacattcgtatatatagtgtgtgggtatgtgtttgtgtgcatatgtgtgtgcatatatatatataaagaaaatagtgtagcggaaagaactctgttttctaagtcaaaatatctgattttgaacttggggtccagtgagccacttaatttcaggtttaacttctggcaagttttatcttctgaagccagaagtcattttcttttaaaaagaggcaatacttgtaactcttttaaagatcagatgacataaaagatatgaaaatataaactataacgtataaatatactgaactgtaaagtcatacaaatttaagtcattaatgttactgattggagttcatttctcagatttcacatagttgttgggcacagaaaatttggaaactttggctttcattcttgcacagactaatttagcatcatattcttgttctttgctgatttatcaggtaaggaaaaagtcaagtaaaatgatttggatgcctcactgccagggaatgcttgataaattaaaagcctggcttcctagggacattctgactactgttgtttataaccaagatcttttgcaaccttagacttcccaggaaaagcctgggctttgt

SEQ ID NO: 37236 - DNA, 1034 bp, Homo sapiens
catcctgcctgtggtttagatttgagatagggacccctactttctttcccctaagagcagatctgtgtcattggctataactgctttctggtcagccacatgacacgtggacttaacagatggtttctaataagattgaaagcatatcttgactccacttacctggccagcactggagaaaggaagattaagagagatttggatgagtgtccttgtcacataacttcccctccctagaaaacttggtccaatacgttgtaatctggtggtgcaaactcacaacttttcttcccttctgtgagtgtgtatatatgtgagtttattgtatgtgtgtgtaaggtgtgaatgtgtatgtgaagtctgtgtgtgatgtgtgtatatttgaatgtcctgtgcatgagtttttttgtgactgaagtgtgtgtgaggtgtctgtatgtgggatgtgtgtgtctgtgaggtgattgtgtatgaggaatgtacatctgtgtctgtggtatatagaaaacgtgtgtgtggtgtatgcacttgctgtgtctgcatatgcatgaattgagtatgtgacttgagtattgtgtgtgtaggaggaggggggaagtaaaaaggcaaggtgacagtagagactggacaaatgaacatagccgggcactattcctttaactcctagaacagacataacttgaagtgatctagacttgaactttggagtatgaagttccagccagctgtgtaactatctatttaatatttggaagcgcttagcctgcttaaatcttgattttatcatttctattagagaagttttaacttaaatgctctaaggtgggggtgtccaagggagaaaatacagtcatgggttcttagtttctgtttctggttgggccagaaaagctccttcctcatccctcttttccacttatcaacagagacagaagctaaaaaccatggcttctggctgctaaagcctaaaataaaacaaaacagaacaaactcatcaacaataacagcaaaataaagcaggttggaaatgactg

SEQ ID NO: 37237 - DNA, 1048 bp, Homo sapiens
atctccattgctcatctgccctagatggttcaggttggttgctgtctctattagtgtgacaagagttaataaaatgattaattaaaaagagccttaaacgtctacttagaaaacactagataaatgctaagtagggtgctttttggtggatcaagagagtccagatcactaatatatggatggcgtataaattaaatcactgtgtaagactgcaaaatgtcagagaaacattttaatatgttccccccagcatttgcctttctgtacatatgtcttagaattataatgcctacattttaactatggttttctgtgggtatatatacaaatagatagcaactgattaaaaaaaaagatctcaacttttttttttcaattcacaagattggagtatttggagatagggctgttttttctctttttttccttttaaagccatccacattttcttttctactgctttctcactcaaaaaatgtaagctagaaaaagttgatctcatggaagtaaaaaggagaacagagattactagaggctggaaacagtagggagaaggggaggatagagaaatatttgttaagaatacgaaatgacagctagataggaggaattaagtggtagtgttctatagcactatagtatgactatagttaacaacgatatattatatattttcaaatacttagaggatattgaatagtcccaaagaaatgaaaaatgttggaacatatgctaataccctgatctgatcactatgcattgtatgtattgaaacatccctacgtacaattattatgtatcaatttaaaaaatatctaaaaatatatgtgtacctaagtgtatacaccttatatatcctttgatttccttatgaaacacagcatagtttgagatttaaaatgaataaaatggttctttatgctctgtaaaattagaaaatccttcagcttttagaagctctctgttggtttattagttgatcacaaattaatatgtccctttggtttaatctgtatcataaaacaaaagttgactgttcccaaacatg

SEQ ID NO: 37238 - DNA, 1035 bp, Homo sapiens
ggttggtttaacagagatgagatatttcagtgaagtctgagttttaaaaggatatgcaaagaagtgattatgctgccatatttactctaagctcactaaggaaaaggggacataagtttggtgagggtcagaacaacttctaaggtcaatgcactggaggactcattgggtttggaagatttttggagtcagaatactggaggggatgagctagaaagagagaaggtagggagagacgcttaacagtggttatggggcaccgttatctgtcatggcaaggccttgcttatggtaaggaaaggaggtttcaggtaagattatctgaagggagatccagaaactgggagaccgtgggaggaaaagataattatgagttatgtaagagtttgcgctggagagagacagggctaaaatgtttaaagactgagaggagagacctttaggtcagtagaaaactggattaggaggggagcagattaatgatgtgagttacaaagacattttagggcaaggaagagatcatggtctggaagcagcagagaagaatgagaaagactcctacttcactaggggcagaggtacaaacatgtggaaggaaaaatagccactgcatcagagggctgaagtaaatccgtattctcggtgggcagccagtagtgtcagagcaagatggtgcaggaaagtcagagaacatgctgaagatacaggagcataaggagattttgctgatgacagactgaacgctaggagtcacgctggcgagtttgcaggaattggggaaggctggggatttcaaagtaggggatttacagagccatctggtgatgagcaatgacctggcagtcttggactttgtgtggtgacggttgtgtattcaagacaaggaccttggttttaagaccatgtagtcagacaagcacaaactcctctgctgggatggccggtttctttggtctatttaattagttccagaaacagtaattcatcctcactgcatttatagaaattgaggggagaggtggtgggtaccagact

SEQ ID NO: 37239 - DNA, 1044 bp, Homo sapiens
tttctctgtctcttatggtaataatacccggagaagagcattgctgccagtctcctgggaactaggaacccagaggagggctgtaggcaaagtgtaataccagaaggtggggagcaagtttctgggggaaatcatctgagaagcacaccaggaagtgctgctggaatgtttggggaagaccagtcagccctaaccttcagccatgtctgtggcataactggctgttgccctctgtggaaatcatgggaggtggaggcgctgcaagttgagggtgtctgtaccatttgaaaggcatagttggctttccacgaaatcaaaagacctgaggaagattttccttttaaagaacatgccgattggcttgtcatgtttaaggaattacagggattacattatgacaattggcattgagaaaaaagtgaagaaaaccttggataaccttgcagcttattattcacgtgtgcttcccatgaccattgacatttatcttaaagagaaaagatgtgaagcctgttcgtacgagctgaagccgttgctactgatggtaaaatctcttcttaagaagacatggtctttcttgcaaacttggcagaaatgttgataagaagaaaataaaaacttgaatcttaaagttcattaaaataatgaaaatcatggctttgattttttaaaaaatattctttgtgtaaatttctttataattgaaaagctcctatgtattcagataactaaaggagtttcagcactttttttttcttagatagaaagctaccaaatttgttcttcaagtagcactttcaggaagaagctttactatctctaatgtagcaaaataatgtcttttttttaatggttttgctttttaaaaaatcatgtttttaaagctgcgattcattcagtatattgaaatcacatatttccaggtcttctggtcatttgatacttgaccttagttattcaacctttttgacttggagactctattaataagtcatatggttataaaggcatttggcatttacaagtaaaaagtaatgactaatt

SEQ ID NO: 37240 - DNA, 1045 bp, Homo sapiens
gaaaggacatgaactcacccttttttataatataatgttaattttttagagagtaagacctaaaactatatatacgtgtatgtaatacgtatatagtataatctcaactacataaaaaaagacaaaaaattaaaagattgcaaaaaaagtcaaagtattaataaatattatctctaggatttgaataattattgctattttctcctttatactcttcgtattttcactttttccacaatatgtctattattttaataatcagaaaatcaatataatttattttaaatcttggcagatgaacatagtgaatgaactatgtcaaaatgcggttggaattttgttgaacttctttacagaagactatatagatgagtgtttttctaaaaaatctttggatagataataagatcaattaaaattgagtaaattcatctgtttgcgtgtgtgtgtttaaactatttatctcttgtgtgctacttagctcctgtattgctttcgtaataagactgaggtagttggtgaaaatttgaacaattcttgcataaagattttattgcataggttataggataaaatgcaagagaaatgttttgtggaaagagtacttagtagagaatcagaaaggctttatgggtccttcattttggtcactgttatacctttgtctaatagaccattgatataactttctactctataagagattgatacctagttaaggaaggtcatgatatattcactttgttacaggaaatttaaggtgcccagaaaaaaaaaatcaagaaccaaaactaacgaatagagagctctattgttattgactgaagtataaacttagatcccttagcaaagcgaaactcacagtccatacaaaaccccttgctatgtccgttggagaaggattggcagcaagatagcaagtatgtggaggatcattgttcatgaagcaggggtagataggagccttttcatatacttctaaccttttttattgtctaacctattgttatgttgtctcattaagaagaggcaatataatgtagtg

SEQ ID NO: 37241 - DNA, 1049 bp, Homo sapiens
tagtttttcaagttcggttttacattgcagacataaaggaactacttttgtatctcttagacaacaattctgttatagaagtttacaggctaatggcaaacacatctcataattgtccttccagtttcttgacccatgtttacttccctttaatttcatgccataagtcagtgctcttgacaaagtatactctgaacatatttataaatcattattttttccaagcagttaatctctaactccctttttcatttctgtatctccatcagcattttctttgcagggttcaatactcttaatttgacatacagacccatccctgagagcaagggagagagaggaaagccctggcctttctttttgtaccttgattttttccattcaaactcatcattgttggtgcattgaaatctggaggtttgagtgagagatggaatcagagagatttaggaatggattcagattctacaactaaaaaccattaggatgcctatgagctttgttttctgcataatatctgaattacaaattgtatttaacaagtaaaactaagttgtgtccgactaattgaaaaccactttggttaatgttacctctttttgtgtccatttaaatccattaaatctttcttacttttgcctttaaaattagagtaatctatacaattcatgctactgactctgccttttaaaacacacaaatattaaaaaaaaaagagacatgttctggtgtcttcccctcagcccagtgagatgtgttacacagtagtctttgttatcagcctttggtttctgataatttagaaagctttcaatccccatcacttatgaaagtctgtgaacaataatttttatttaaagatttcttacagtgccgaatcttacaaccatttataaattcatgtcatgttttcttaaagttacagaactcttttcaatttttaagccttaacctcttgtctgcatagcaaatcctatttattttttaaaaagctgaattcaagtgtcatctcttaaatgaagattcctgatcatgtcaatcaaagagag

SEQ ID NO: 37242 - DNA, 1041 bp, Homo sapiens
ttttatttttttgtaaagttgtctccttgaatactggactgtaaaggtgtgtggatgtgttctagcaaattgagaattgtagttaattgagttctggttatttaactttttactgtagtttgtacttgttgcttgttcagagtctaggcaattttacatgggcttattttatcctttctccctatctccattagtcttcaagatcaggaaaatgatttatgtcattttaaaatagagccttcctctgtctctcattttccttcttctctctctctaaggtatattattgcctactatatcctgtgccctgtgctggaatttctcttgtgctaatttttattgataacatatgatggcttaaaatgtcatctagtgtttagtaaattcataatagaaaataactttgttccctcacaaatttttacagacatttaaaattagcacttcaatatccaagtattttgctttttcttttctggagagaaactaacacctgtaggtatttgttgacatgcaaaaaatgcatgcaagaattttaaaattttataccctataattggttgtatactattaattagacctcttctttagctctcttactgtatacactcttctgttttcccaaattctctcctctttctctaaattcctcaccctgttccccaccctttccctgccttgtctctgggtttttgtctctcttgcctcatttttccttctttctctctcactttcttcccccaccccttctctcttgtttacactccccgctcatgtatgtgccgcttcgtctttgtgtttatatctaccaggggaaagaccaaccatctttatttttaaattttattttactttaagttctgggatacatgtgcagaatgtgcaggtttgttacataggtaaatgtgtgccatggtggtttggtgcacctatcagcccattacctaggtattaagccccgcatgcgttagctatttatcctgatgctctccttcccctcactgcctcccaacatgccctggtgtgtattgttcccttccc

SEQ ID NO: 37243 - DNA, 1093 bp, Homo sapiens
cagacattatgtcatgccaacgcaaaacttcaaatgttaaagagagaaaaaaaaataactttacctcctggaaattaaagaacactctctatataatttttcagtctcatagagaaagtcatcgctaaaaatgcagaatatttggaaagcaacacgaattaaaacactgtatattagagactatgagatcttgttacagcagtacttagaggaaagttcataactttaaatacttgtaacaaataagaattaaatgaattaagcatccaatatcagaatgtattaagtaaaataaagacaaggcagaatagaaattagtaaagataaaaacagaaattaattaatttggaaaatttaaaaaatgccaaaataaagtctatgagttgtgtttgaaaaatttttaagtaaaaatgtgtgctatgctctttttttgaaatgataactttttaattgtggttaaaaatataaacctaaatttgctattttagctatttaaaaatatacaaatcaatggcattaattatatgcaaatgttgtacaatcatcaccagtactgatttctgaactttttcatcaccccagcaactctgtgtcctctaagcagtaactccccattctccctaccccctagcccctggtaaccttcagtctacattttgtgtctatgaagcctattctagatgtttcatataagtggaataatataatatttgtcattttttgtttggcttatttcacttagcatgtatcagaacttcattcctttttatgtatgaataatattctgttgtacataacataccacattctgtttatacaattgattttgttatgtgctcttggatggttctaccttttagctattgtgaataatggtgcaacacccatcttttttttaaagggaaaaagcagaaatagatgatataagaaaacaagaattgagaaataattatagatagagaaaattaaaggagattataggacttatatgtaccataagcaaataaatgtaaaaacctggataaaatatgtaatttctagaaacgataaagttctaaggctggccccagaagagttcgaaaatctaaagaga

SEQ ID NO: 37244 - DNA, 1005 bp, Homo sapiens
attggaacatagacacactcattgattatgtcttgtctatgggttttgttctgctatagcagaattgagtagttgcaactatgatcatatggcccataaggcctaaaatatttattatctggccttttacagaaaaattttgctaaattctgttataggaaatcctgaattttaagactaatcatgaacataatttgttaatcgttctcagaaaattgacagcactaatgatttataagacatcaaacaatagaatatttaatttgatttactagaaaattatgaataatgcagaataatatatactctgaattaaacttattgatctcaatttggaaaacagaaaacaatgaagagatataatcaaatctagagccaaaagtggccaataactacctaaatattaccatatattaaacatcagatggaatcaactgtcaagaatataattaaaaaggtggaaggactatgctgtgaaaaaaatctatcatcttaacaacttgaactcatttttattaaatgtatatacatttagtttaaatgaaaatatagtatttgtgttatatactttatttctcactttgactttttaattaaatatgtcttgatttcatcagataagaaggcatctggtgtattaagttttgttaattgaaaaatctcaacttttttattgcccagcagggtagaggcttgctcagaagcttggactagcaaacataactagctttttttttttttttttgtctttccttctcttttctctcctgccaccttaatgtagggtgaatgaatttgccacctcaaagctatctacaatgggtcaggcaaaataaccacaatatgggtttgtacataatttgggaaggagttcttctcctgtcccttcttcctttggcaatgcctcttaaatcacagttgtgttggttgaacagctctatgaatatatgaaaagccactgaattgtgcacttaattgggtgagttgcatggtatgtaaaataca

SEQ ID NO: 37245 - DNA, 1025 bp, Homo sapiens
agcttgaggaggctttaatttcccacaccttaaataaacataattaagtaaactgtgtttgctatgcaaatacagtctaaaagcaagactcctagttccttctttcgaactaaattattacccaacggtccttcctattagaatttgtagcaccaatattagttagaaatcagaatatttggattttaacttgtggcactgccagttgggcaagtgaccttgagcaagtcacaacctctctgagatttgtctttttctcagtaaagtgaagggattggatatggaaggaacaaactccagtgttttccaggacaggaagatattagaagttgctgagaatggaggggtcagtggagaaatggagtgtgcagaccttacaataaggtatctgatagaaacaaagtgttgaatgctctatgttggccaaacttatgctttatgtagaggtgggcagacagatgcaggtaagaaaactgggagagaggtgcccagttacaaatgcaaaacttcaactctggtcttctgtccgatgatctggagttcttcccacttcgccacactaagtcttgtcgctgacaggagtgtgtgggcttgatctaagcaaatctctgaaagagagggcttatatttggttccctttatcctccatctatgccccttctttattttttgggtccctttctctttatccactacatccttagttgtgctcaggtgtttcctgagcatgagctttgtaggcgacacatttcaggagctgaaacagcccagaccccacctctcttttcaggctccccactatgatgttgacatttgccctccacagagcttataccaggctgcattatgtttcttcatgaagactagttagctaagcaagtacttagagccctttcattcattcagtttattgtagagccttaatactgcagatgctaggctgggcaatgatgaagggagaaagacggctttaactctgaaggagcctcagcccaatgaggaaagcaatatgtctacgtgtaact

SEQ ID NO: 37246 - DNA, 1023 bp, Homo sapiens
gtaaaatgtttagagtttaaaagccgttggttttagatagccactatcaaattagtttcttgcctcaggtatcagtacaagtttttagttcctcttatgttagggaacacagcttagggttccagcgaatcgtttttaactcacaatatgttacttttgactattcataaaggttgatccatgatcaggtgagtggtttttgtttttaaagactgaactctacatagttggattcagggaacaccgtacatgtgggattacacacagagcaccagagttctgggcttctgatcatattattctcagagtaattttggaggagagtttagtggtaaagatcaacagaaagtatactgcctctcttttaagcttttcacaaagtaatatacaccagaatattccctcttccatttgagcagaagctggtggggctgagttggagaaacagagaaatgatgaaatgtaattgggccaaaattttatttaactgtgtagaacagaagttattttgaagtcagagttacttgtgaatatataaaaagtgaggtctatttatagttggcagtggggggaattttcagaaacatgattaaaaggggaacttatttgaagcttagatcaaaggaaagatggattagctctatagaaattggaatgaaatgttttaacaaaaataaacaaaaacaggaaaatacaggctcagaaactcttaaaatttggctgccaaattttattggcttttatgtgtctttttttactcttcttggaccattcatttttttagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttgg

SEQ ID NO: 37247 - DNA, 1050 bp, Homo sapiens
ttcaggtgtggtattggtatcttactgtaaagtcttcctgtaaagtatattgatatttagtgtggtgttggcataaggatagatatttaggcctatggaatagaatagagggtccaatagtagattcatgtatctgtagtcaagtgattttcagcaaagaagccaagggaagggatcatcttttcagggtagtgttggaacaactggatatctattatggaaaaagtgaacctttatactgtatactgtatgcactcaaattttactttggactggatcacagattcaaatataatagagatatctaaaaaccttccaaaagaaagtataggagaaaaattcttgcaattttgcatagacaaagatatcttagttcctagaaaacataaccataaaataaaaattacatcaaatagacttcatcaaaattggaaatttctgctctttgaaatatactgttaagaaaatgaaaagacaagaaaattcccattacatagctcacaaaatacttataactaggatatgtagagaacacttcaatactaagacaatgcaataaaaaaacaaaaaaactggacacaacaagaatatatatgaaatactcataagcacatgaaaagattattaacatcattaatcatacaggaaatgcagattaaaaccacaatgagatactaccatgtacacactaaaatggctaaagccaaagacactgacataaatttttggtgagtgtggggctcctggagccctcagacattgctgataggactgtgaaatgacacagccactttggaaaatgagttcatcatttctaactaagttaaacatacacataccttaatttcattcctaggtatttatctaagggataagaacacatgtgttcacacaaattgtgtggtgttcatagcagctttattcataatatcaaaacattggaaacaatctacatgtctatcagcaagtgaatggaaaaatattttgtagtatatccatgcaatgaaatattacccagcaataaaaataaactatgggtacatacaacaa

SEQ ID NO: 37248 - DNA, 1032 bp, Homo sapiens
ggaggaggggggtagaatgtatctttttttgtcccctatgactgctgttaagattttattattgatttttaggaattgcattatatcttggtgtggttgtttaaacagaggtatagcttatcaaccaatggtggagctaaaatagaatacttgaaagtacttatggatgcacagaatctaagatggcccccaattttcctgctaccttgtacccttgagtatatgtgggacctgttacttgcttctaaccaataaaatctcacaccagttagaatggtgattattaaaaagtcaggaaacaacggatgctggagaggatgtggaaaaataggaacgcttttacactgttggtggaagtgtaaattagctcagccattgtggaagacagtggcaattcctcaaggatctagaactagaaataccatttgacccagccatcccgttactgggtatataaccagaggattataaatcattctactataaagacacatgcacacgtatgtttattgcggcactgttcacaatagcaaagactcggaaccaacccaaatgtccatcagtgatagactggatgaagacaatgtagcacatatacaccagggaatactatgcagctataaaaaatgacgagttcatgtcctttgcagggacatggatgaagctggaaaccatcattctcagcaaactatcacaagaacagaaaaccaaacaccacatcttctcactcataagtggcagttgaacaatgagaacacatggacacaaggcagggaacatcacacaccggggcctgtgtggggggtcgggggcagggggagggatagcattaggagaaatacctaatgtagttgacattactttggtttgacattactttggtttgtgggtgccacaaaccaccatggcacatgtatacctgtgttacaaacctgcacgttctgtacatgtaccccagaacttaaagtataataataataaaataacatgtatgtcaagggtgacatgtaattaagcaaagctcagtaaatt

SEQ ID NO: 37249 - DNA, 1026 bp, Homo sapiens
ttccaatgcccagtaatgaggaagctgttccaatatttcctcaatgggaaggttttcacttgcttttgagtctaccttgacctcaaataaggtctcctcctctgacctgtcatctggaggctcctccaccaggtcttcagcctgagcttcaatgaattgttccccagggtgtattctgttatgtgaccagatgtggatttttttcacccactgcttggcgtgggcagcggatcttctggaccactgaagacacattctcatattctcaaggcaaaattctgaagaaatcataaaactgttcccaccacaaaatgttctttgtaggtggttcatgtctgatgcattcttctaacattatccacaatgtagaggtatttctggaggttcacaccctttcaataacaggagcacaatattctgctaggtacagatgtcttcagcagtaggagttcttgcgctcatttgtcttctgagaatattgttgaaaatttgaacatgtctttttgattctcaaagtcagcaagctgtggatcagctcctaagtgctaaagagcccacagttgcagagttcctgagtgggttgagtgcagtttcagtctgtggctggtttttatttgtgcttgcagaatttctttcatggcaaccagagttttggaaacttctaaaggcttttctgcttctttgttttgttttgttttggtttttggttagaaatgcctttctttccagaacagccatgcttttcagggcctgcacagtgcctgttgcagatgtgcaaggcatcccaagaggaagcaaagccctcactgcttggtggggccaggttgcctgctcttggtctccatgtcctccctttccccgtccaaggccgtcactggcttgggctgctccgttggtccttgcagccgtgccgagcgcacatctcctgatagctcctactctgggcaaggagctgactcggcagtggacaaattgaggcaaccaaataataaacacaaatggatagtcaacacattttttgaaaga

SEQ ID NO: 37250 - DNA, 1028 bp, Homo sapiens
gcaatctggatgaaattggagaccattattctaagtgaagtaactcaggaataaaaaaccaaacattgcgtgtcctcacttataagtgggagctaagctatgaggatgcaaaggcataagaatgatatgatagactttagggacttggggaatgggtgggagggtgatgagggataaaagactatacattggttacagtatacactgctcgggtgatgggtgcaccaaaatctcagaaatcatcactgaagaacttattcatgtaaccaaacaccacctgtccctcaagacttattgaaataataaataaataaaaaggattctacaaaaaagaaaccttataaactgagttcctagccatgatgggatagggggttggacaagcctcagtatgtcccttccttagtaacctttaaccagatttctttcctaagaaataaacagaaaccagctctggagaacaagaaacagatgactcattgctttatcatcttaagccaatcatctgaggctgtgactggactcttcctactttttttgcaatttcacaatacatcccttgctaaaaactgaccaccatctccagaccggttttggctgactggtggaggatacacggtgatggttttgtgtcctctgcttcatcttttgacatcagtgggctgaaaactccattttcagatcatgctaatgccaccattttttgaacatgcaacccatgaaaggtgcatgaagcgcaattgcacatgtgcatatttcttctttcataaatattcatgactcttcctttagcttattaaatatgcatatttggctacctcactcagcataaattcctgttccctttacccctccctcaaagtgcttgctctcagctgctgttggaggctttgtttcccatcctgtgggatggccagcatacaggctgaaaccctttatgagaaataaagctcttcttttcaaatttatccacctcatcattcttaaattggcacaatccacacctggttattgcagctgttataaaa

SEQ ID NO: 37251 - DNA, 1052 bp, Homo sapiens
cttacatgacaaggtagagctggagtctcttctggaagggctgactgaggagatcaacttcctcaggcagctgtatgaagaggagatccaggagctgcagtcccagatctcggacacgtctgtggtgctgtccatggacaacagccgctccctggacatagtgtcatcgctgaggtcaaggcgcagtactaggagatcgccaaccgcagctgggctgaggttgagagcatgtaccagatcaagtatgaggagctccagacgctgtctgggaagcacggggatgacctgcggcatacaaagactgagatctcccagatgaactggaacataagccggctccaggctgagactgagggcctcaaaggccagagggcttccctggaggccgccatcagagatgccgagtagcgtggggagctggccgataaggatgccaacgccaagctgtctgagctggaggccgccctgcagtggaccaagcaggacatgggcggcagctgcgtgagtaccaggagctgatgaacgtcaagctgccctggacatcgagatcgccacctacagctgctggagggcgaggagagccggctggagtctgggatgcagaacatgagtatccgtacgaagaccaccagcggctatgcaggtggtctgagctcgacctatgggggcctcacaagccccggcctcagctacggcctgggctccagttttggctctggtgcgggctcctgcgctttcagccgcacctgctccatcagggccatgattgtgaagaagattgagacccacgatgggaagctggtgtccgagtcctctgacgtcctgctcaagtgaacagcggaggcggcagcccctcccagcctgtccgtcctgcggctgccccagagcacgcgagggaggcggctgtgcaggggagcacagggaatgggagacccacctgaggctcagccctagccctcagcccaccttcaggggagtttcctgcctggggatcccccatgcccatgtctccagctacaaaacaattcaattgcttttttttttttatggtc

SEQ ID NO: 37252 - DNA, 1044 bp, Homo sapiens
tgagtagtaaaaaggttgctgcactgcacagctccagggaacatttaaatatagaccctgcggttgtgcaattttgtggttctgaatagtggatccatacttccaactggcttttgacattataccacccattatcactctcagggaggctagatttaaagatggacttctttgcccaatagtgcactccctgcactttgggagtgcataaacataggtaggtaaagaattgttaactcttcatatctgaataattttttttcacgttttcatttcttaggtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaa

SEQ ID NO: 37253 - DNA, 1032 bp, Homo sapiens
tggaagtctgagatcagggtgccagcacggtcgggtactagtgaggaccctcttccaggttgcagactgccatcttctcattgtatccttacatggggaaagagggcaggagagctccctggggtgccttttataagggcactaataccatcatgcaggcgatcagtgcataatacagctcctctcccactgtttctagccccaggatacttccttattcctgttgatttctttttcacctttctaaagatactagtgatcactgcccaaatagctcacagttaatagtaggatctgggtgctcagttaaagaaatgttggttgctgttagttaccccttggctaagcaggtgtgtactcacatattgtttttctcttagatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgaggcaagtgtcttcagtattcctaatgggagaattttgcctgagtttttctgtttatgtgtcattatgttttctgttataagggtaaactttgcaatttaaggaattaagaaactgatctcactagagcaggtatttgccaaaatagtgttaggtatagaccaaataataaactcatttgaggatctcagtataatctgtctcacagataatgagaaaaactaacatctattccatggatttgtacataattgccttaatggattattgaattaatccataaattttagttttgaggaaactcttaaagtaacatagctggtaagtggagggctgatatttgaacccaggtctgtctgacatcagagttcatcttgactcagtaaaaagttgtcatcatcatggtaggcacctttggtttctggatactctgatgaactatgggatggtagactgttttggtt

SEQ ID NO: 37254 - DNA, 1020 bp, Homo sapiens
ttcatctatcacctgtatttatctggcttaagattctgtgctttccatgtcttcttcagttttagtgtaacgtctgtcagtgcacattataatattccgcttggacttgcccggcttttccccaaaacagctccagatgctcatttccattaagggtcctgccattatcctggtctccaaggtgccgtgccattcctctcccattcgttaaatatcttctatccaatttttacatggtgtcttctagcctttatcagtctcgcccactcccatcctctcttcaccactctccctcttccccactttgaacacatatgcccttctctgctatttgttatcatcttttatgtttgctttgcacaaaaagattgcaaacagcttaggacattaaatcttcaggccttacagctagtagttgcttgataaatgtagaagatgatacagtataaattttggtagcacacatcaggcaggtttgatgatggaaatttttaagccaggttttacaggaagttacggagtttgcattggtaaacgtgtaggagctggtagacattgtacatgaaggggagaaaagcctgtgttcactccattgtcacaaacaggtacccagctgttctgatgaaacattacatttagaggtataatgaagcaaatcagcagaaaaccatttatccttatcttgacaaaacaaaatatgaaaacacataaagttaaaaaaaaacctttttattgaaaaacgtagcacatacataaaagtgcataaaacataaatggacagattaacacagtagatgtattcagcaatagaacgacagtgttattctggccatagataggctacagtcaggccaaataggaatcttttcacaaaaacctgtataaggtgaagtgggcctggactgctcccaagaggcattgccaagaaagaattggctgtgcatggagaggcttgaggagagagaaaataagactggaaattggtaccaaaaggataagatcagggagccaagaagagag

SEQ ID NO: 37255 - DNA, 1026 bp, Homo sapiens
gaaaaatatagcagggaaagctaattacagaaaggaaaacaatcactttgctttctattgtaatgaatttctggacatcggaaggttaaatctagggctcaggatagtgctagttcttctgttttaattctggaaaagtattaaattcagggaagaaaactaacgaagtttaatcataaacattttttcttctttgcaaagaatatgtgtgtagttcttaatgtgctacctagaatcactgttgtaaacctcctgggtgcttagaattattacaaatcatttattataatacaaatttttctatcttgctagctctatcagcaacatcctcagatacagaaggcatacttcttttgctgccatgtggcttcttgttttttgtttttattaaaagtaatcacaaaaactgcaattacttttgcaccaacctaataattagacaattaaaatttcaaaggaagggggtaaaattaaagaactatgttgcgacctctcttagttctctgtgtgtaggacttttcaggtgcccaatgtcctcttgactgaccactcctcatgaagatactggtaaactttgtgctagtggattgataaccgctctccgagttcatgctcttctgaggtctagaaagaaatgggtgtctctgtcccaacctggttagttattctgtctctaaaaacacaattaagtcaatgttaagactaagttcattaagctgctcgtgtttttatgccttgacagtttgttaatggtggttgcataagttttacagaactagtttcgtcttgttgcccaggctggagggcaatggtgtgacctcagctcaccgcaacctccgcctcctgggttcaagcgattctcctgcctcagcctcccaagtagctgggattacaggcatgcgccaccatgcctggcttattttgtatttttagtagagacagggtttctccatgttggtctggctggtctcgaactcctgacctcaggtgatctgcccgccttgacctcccaaagtgcagggatta

SEQ ID NO: 37256 - DNA, 1084 bp, Homo sapiens
gctctttgttttttttgtcttagggaagcggtgttaagatgaaaaagactttcacttgtagtgctgttgggaatgagccagtggggacagaggttatagatacccagaagataatctatagggtgagatttctgacagtgctgaagggaatctgaacacaagtagggggattgacattaaaaatggggaggaatctcaagaccagcctggccaatatggtgaaacctcatctctactaaaaatacaaaaattagccgggcatggtggcgggcacctgtagtcccagctactcgggaggctgacacaggagaatcgcttgaacccgggaggcggaggttgcagtgagccaagatcgtgccactgcacaccagcctgggcaacagagcgactccatctcaaaaaaaaaaaaaaaaagaatcatgtttctatgataacaggagtgaagaaggaaaaaggataagtggaagcaaatgtgtttgtaggtttgttggtaagacattaaggaaattctgattgactgcctcctattttctccttgaaataaaagatcaaattacctgttgtgactgagttggtatatttgtggagaagatttgaaatagctgaggaatactgcagagaagaatacaagtgaaatatagtgggactggcagtcattactgaaatccagaggaaatgaataatcttttatggtgatgtcacactgccctaattataagattttttacctgaggagagcaagggattggctaagtctgggctcatgggcaagtctggctcatggcctttttttgtaaataaagtaggttttggacacaaatattgaaactgcctttgcaaaacttatatcagtgagaaaactgtggcagtaggggagatctgatctagccaccaccccctcttgcctttagccttcaagctgccttaattattgctgggctttggccaagctaactttggaagacatttagttaatactctattttttttattttatgtatgtatttgtttatttatttatttatttatttatttatttttgagacagagttttgctccgttgcccaggctgtagtgtagtggc

SEQ ID NO: 37257 - DNA, 1556 bp, Homo sapiens
agaagtagggggagggatagcattaggagaaatacctaatgtaaatgatgagttaatgggtgcagcaaaccaacatggcacatatatacctatgtaacaaacctgcacgttgtcacatgtaccctagaacttaaaagtataattaaaaaatatataaaaataaaaataaaattctctgcatactaggaatagaagagaaattccttaatttgatacaaagtatctatttttttaaaaaactaaagcaaccattttatttggtggtaaaatgttgaaagctttccctttgcattatcctcattatttcctctgttcaacattgtactgaatgtcctagtcagtgcaataaagcaaaggaaataaaagggataggaactggacaggaagcatttaaactgtcattcacagaagacatgattatgaacgtagaaaattcaaaagaatctatagccaaattattagaattaatataagtaaatttagcaaatttgctggatacaaggtaaattatatttctgaattccaaacacaagcgattataaaatgaaatttcaaaaccaacattgtttaccatagcatcaaaaatcatcatatacctagtaatatatttaatgaaaaatatacaagactattccgaatacacagagaactttagaacattattgagagaaattaagacctaaataaatgtggggtattccatgttcaagaattaaaaggttcagtgtgataaaaatatcagttctacccaaactgatctatagaatcaatgcattttctatcagactcttagaagatttctttttttgaaaattgactagctaattctaatgttcatatggaaatgcaaaacagcagggcactcttgaaacaaaagagtgaagttggaagacttcactatcagatatcaagacttgctataaagttatactagtgaaggcaatgtgatattggtaagtaaaaaagaaaaacaccatacagtggaactggataatcaagaaatgtacccgttgatgacattaatttgatttatgataatacaggtaacccttgaatagtgtggaggttagggaagctgacccccatcacagttgaaaatctatgtataatttttgattaccccaaaagcttaactactaatagcctagtgttaattggtagccttctggattacataaacagtcaattaacacaactttgtatgttatatgtaatacatactgtattcttttattattattatttttttttttttctagacggagtctcgctctgtcacccatgctggagtgcagtggccagtggcgcaatctcagctcactgcaacctccccgtcctgagttcaagtgattctcctgcctcagcctcccgagtatctgggactacaggcgtgtgtcaccatgcctggctaatttttgtatttttagtagagacagggtttcgccatgttggccaggctggtctggaactcctgacctccgttgatccacccacctcggcctctcaaagtgttgggattacaggcgtgagccaccatgcccggcctatatactgcg

SEQ ID NO: 37258 - DNA, 2088 bp, Homo sapiens
agaagatggcatactctaattgtagatatgtttgagtggcccatggtaagaccagaaggagctatagcagtctggactctaatatctttccaaagagctaaccagtcaaagtgcgcccccagtacagaactatatactgaggaaaactgctggaaatagaatccaaattgagcagtacagagacaatagaaacaaaggaaaaagatgtccccgataaaattggaaaggtgaacagaaacaggaaatctctgaaagtaagcttccatattttgaaatcttaccccccaaaaaaaatttttaagggaagaagaggatgttttaatatataaaatttaaacattattgtaagtcaagcctccattctaaaaggttaagaaaattaattttacataaaaatgagcaaaggaataggattaaggtcaaagttcctacaaaatcattataaaaacaaagagaataagaagtggactaaagctgctacagatagtgaagtcacaccggaaagaagtatctataaaacagatgagaactctaacctaatatttcaaaactaggtaaaagttgttttataaacatataataaatgagagaataatgttaagttattagaaaacctcagaaatgagatgctcaaactcagaaaattagaaataaaaatatttcagaaatgaagactgactaaaacttaaagaacacaaataaatggaagaggtaatgccttagaaatagaaactagaaaggaggaaaattttaaaagccaaaaagaaatgaacagaggaaaataattcaagaggtgtatatatagaacataggcaaagaagatccagcataacatatgatagaagttcccaaaaaagaaaccaaggcaaaagagcagaataaatattaaaacaataattcaagaaagcttttctaggataaataagatctggaactttatataagagggggggatttatattgtcactagactttgactttgggctttctggcagaagaaatgaagcttcttatccaagatgctcaaggaaataaaatgtgagtcaaggattttatatccagccaaactgatttcagatacaaaaaggacggataaattgtcaacaacacaagaattcagagactgttgttctcattagccattccttaggaatcaaccagagaatgaaatcattcaaccagaatgacaagagagacagcaacttaaggattgacggtgagcaataatattagcagatagcaacactttatataaatgtataaattgatggatctagatattggtttgtctgctaatatcacatcacaacaaagagcaatgggaaatagaaattattttaaattatagcacatgaatgcagtcaccaaagtccaggctggaaattacaggacaaatgatctggtttttgcaacaaataaattacaagagaggggaaaagtacaggagggaggaagaaaggtagaggagacctatagcttaaagttaaaagacattaaaatttttttaaaaagcaaagctaatattcatgtgtacactctaaggtgatgaactatgaactatacagaagagaaagacagtgactacgataaaaatcatgataatgagttactttgaggtgaaaaggaaagagtgatgatgtagagagattgcattgtttggatctctgtgaagaatttttgatggttcccctatttttgattgggataaatgtatatttgtaattgggataaatgtatattttgtaatggaataacattcacaatgtctaagattttataatatttaaatttggtgtaacttccaaaagagacataaagaatttgttcaaggagaattttgtcttgtaaaaaaataagtatactaaagaaaggtactttgaattaaggtaaaaacagtgaaaataacctgaaatatttgcacatttcaagaatatcctccattttgcagaattttctctgaacttatcatatacctcatcaactattgttatttcctaaattaaacattatggcttttagggaagtcagttaaaggtgtcaacaactccagatttaaagatgatttttagacaattttatgccaaaaaa

SEQ ID NO: 37259 - DNA, 1103 bp, Homo sapiens
ccagtgctccagccggtgtgaggacacgatatgctggggtttttgtccgcacgccaaacgggtttggaggaccctcttcgccttcggagagcagagtcaacacggaggtaaagaaaaccttactttttggctaacaggccagttagaatctggaccaatgactgtaagctttgccccacactttcccgtctcatcgctctcctgccaccaaactattatttgccctctaatgctgtgtggcttgctaaaataggatcccttttatttactggtaacaacttgcaggcggggggcggcgggggtggggggggttccccgggggtggggggggggttcccccgcgggctcaggtgaagacactataaacctaaataagaatacttcgttgtactgtattccttctctcttaagttactccaaagaataactgccctccacggactcgttcattcattcagtctgcatatttagtgaattcctacagtgtgccaggcagcctattaaaggcagaggacacaggccaggaattgaacaaagttcagaatgactagagcggagaattggggtagggaccattgacaagagatgaagtagacagaaactagatgaggaagagccttgtgtacttgagtagaggtgtgaagatgagaataaggtaacagctattgcattttgttttctgcttggagaatgggttgcaactgagaacaagagtgggagccaagttaggtaactgttgtgattacacttgtccgggagagagttgttggaagcctgggccacagagttgccaagtagaataaagatagtggagagatttgaacaacgtctgagaaatagaatcaacaggccatggaaattgagtggatacgtgaatgacaaaaagagaagaatgaataatgattcccagatctatgccttgtataagaagttgaatgttggtaatatactctgagagagggttttccaaagggaagaagcaagttgtacttttaattttgcccacattaattgaggaacctgtgaagatatttacttggagaacacagttgcttatgagttctgcgttctggagaaatttaaatattagtttccaacatttt

SEQ ID NO: 37260 - DNA, 1080 bp, Homo sapiens
aaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacatt

SEQ ID NO: 37261 - DNA, 1012 bp, Homo sapiens
tccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgatagggtaaggagggaagagtgagcaagggagaaacgtaaggaataagggaaagacaaaggaggaagtgcggacggccgtcaagtgctacccgttgcagccgcaggggccacgcgggtctggttgggagatcgagcctggtcgatccgttttgggcggaagagtaggatttattcctgaaagtgtggaggcgcgagcgtttgggtccgaagttgagttgcagggagatgtgtggcctgtggaccatggctcttttactgcaaagttcttttgcttatttctgaaacttacattgtttattcgctactgggctggagaaggtgaaggcagatcgatctcagtagtacctaattctaactgtatgggtgaggtcgtatgaagtccaggagctaagatatttaacgtattaggcactttcatgtgtgttcagttgaaaatcgtggggaagatataattaaaactagtcacagttttcttggggtaatgggactgtgggtgaattactataatttgtttggttatgtcttctaattttttaagtaaaggacacaaattgtatgatggacccaaaaaaacctttataaagagtaagatgagctgtttgattttgtagtggtgtacctaatccagtaaataaatgagtggcaacatttttagtataaaaattgaaaatctaggaacggatacgctgtgtaagtcagtcagtgagccaacttgtctcccgtatgtcaatgaactaaaaaaattttattattgaaataagtaacttagtaaaat

SEQ ID NO: 37262 - DNA, 1048 bp, Homo sapiens
acggggccagctgtgggacttgtgtatgcgcaatttgggtatattcaggcagtcctggaaccaatcctccatgtataactgagggacaactatatacaatatattcatattttcgtcctatagcaagtcagagcttctctgattccaggccatgttcagatgatgattaaaaaacaaaacaaaacaaaacaaaaaacaaaaaaaaacttcggctgggtgtggtggctcactcctgtaatcctagccctctgggaggctgaggcgggcggatcacttgaggtcaggagttcgaaaccagcttggccatcatggtgaaaccccgtctctactaaaaatataaaaaattagctgggcatggtggtgtgcgcctgtaatcccagctactcgggaggctgaggcaggagaatcactttaacccgggaggcggaggttgcagtaagctgagatcgtgccattgcactccagcctgggtgacagagcaagattccacctcaaaaaaacaaacaaacaaacaaacaaacaaaaaaaacttctccgatctctagagcgtgtcttagatgctgttccattttaatctactttgttaagacaatatagcaataataatatgtacacacgcaccaatacttaactaaaggctaatgctgagtcatggcaagataattccctgggtgtggcaaaggtgacagaaatgcacactctctcaaacatggaggctgtaaaaactcatgatgtcatactcccctggattagttctggtcatctaacctctccaaattaaggctctacagaggcccaatagatgcaataataaaatggaaagatatgtatagggagtacttatcttgctctggttttccacatctttgggaggtaacatatctagatgcaatgcagggtttactttaaagagtctaaaagcaactacagtctctcttaaaaattctggacataagtgatggactgaggccagaatctcatttttagtttttatggttcaaagtttagaactcttagtttgaaccaggtttttccagtcttggaacta

SEQ ID NO: 37263 - DNA, 1976 bp, Homo sapiens
tgcccctttgtttgccttttaggattttgaatgatatgactgcatgaaaaaccaaaaatcacagaaaaataatttcatccttattgactttaaaactcattacattagtattgagtggaatagatactagttttgttggtttctgtgaccaagcagcaaaaattctaaattcatcgttttaagggaatgcaaatatatgaagcattttttaagtttatgtttatactccctaccttactccaagaagaatttaaggcagttcaaatcccacttaaatttatctatcagtcataaatgcaattctcagtcagtatgtattattatccataggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaagaattgagaattttattctgtactttttaaaatttaagagccagggagttgcatcatgaaagcctttgtataataatggaaattttatatgggtaagcattttcaaacacatattagtagatacgttttttaaatttctattttcacattgatcagtgttactttgcttaatacttaggtagcccttatgtccactaaagtaaatgcttatgttgtagaagcatcgaacatcaaccaatgtcatggcacagcaccaaagattgcaaatacctcactatggtgcgcttagaaattttcaaattgataacctatagatacggctgcaggtgaattcatgatagtgaaatcagctaagtatacttaacct

SEQ ID NO: 37264 - DNA, 1106 bp, Homo sapiens
atagaatactatgaattgctatagaattactatgaactatagaattactatggttcagaaccctaactttgtttaaacctgcacttcccagtattatttgaccaggttctttattctgtggcagcctttttgaacctccttctacagatagctgttattggaacactgtgcttttgtactaactgaagtttgcggaggagtacatctggagctgtgagagaggaaatgtacactctttattaagcctactgtgtgccaggcactggtactgggcattggaaatacagtggtgagcaaggtagacatggttacgcttcacacagaacttagaatttagcagtgaagagagagaaatttacagaaagtgggacaagtgccatggcaaggaaaatacaagaccttagcacaaagtaagggcaccaaacacatacaggatgggcagaaggactttccaaaggaggtagcacttaggaggagatctgaattgtaggaggggtggcttgaagggagaggagactgcagtcggaggaactggatacgtaaaggaagaggaaatatgtgaaaagaggaaatgaaagatgttttctatggatggaactcaaatacagatgggagataagtgagaaattaagtacagaggtagtagctgtagctaatattgactaatatttatgtgtcaaatatgtcagaatgaaagatgttttctgtggatagaactcaaatacaaatgggaggtaagtgagaaattaagtagatagtaactgtagctaatattgactaatatttataagtcaaatatgtcagatactatatcaaacattgtattctatctcatttaatattcacaactgcactgtgaaatgagtattaatattcccattttacagatgaggacactgagggacaaagaaatcaagtaatttgcctattatgagacagctggaaagcaagaagtcagtctggttcctctagactgtgtacttcattcattttgccatcgtataggataacttacaaggtagtttccagctctttaaggacctgtaggccatgacaagaggtttggcattatcctacagatggcaggaagccatttaaggatttta

SEQ ID NO: 37265 - DNA, 1052 bp, Homo sapiens
ccagctcctccggaggctgaggtgggaggatcacttgagcccagtagttcaaggctgcggttagctgtgatcatgccacttcactccagcctgggtgacaaagcgagatcccatcttaaaacaaaaacaaaagaattaaaacaggaaaactatcccatccctcaaatatttaaatcaaggttttactgtatataccagatatggttactagaaggaaaatgtactacacatgtagtaaacgtgtagaaatgtacaaccaatttaaatccaccttgcagatacatccccacatttgctttactggaagacacttgacttgtaagccttgctaatttgtacaaatatagccaaatccatttcaaaagtcctttgtttattccatgtttctaaatgctggttcatttttaaagatccatatggttttcctttatattttatttcatatggtgttttattcttctgtaaaaatgtactggaaaaggagaacaagacttgtctagactacattaatacaaagcaataggtgcttccagagaactaaaacaaaaatacacttttgggataaactttcttagaagagttttgaccacaggtgcctgcagttcatggcattcttggtggggtgaaggccattgcagttgtcctctggtttggtattttttaaagaacatgaaccatgattagaaaaccactaatattaatatattgaaacaataattttagatgaagcaattattcttgcttccttctgggttaagtcagtttccaatttgccatcagaaaagaattttttcctcaggatatctattcttaaattcttctttgggatctacacagttcttcctctgattctgggttaattttatgtattactaaaagtaattattttaaaatttaaataaaataagttggtgtcaccaaaagctggtgtcacttaggtgaatatatcctgcacttttttggttatgccattgtaaatattttttgcctattggatacctacttcagtacacaatttaaaataaatattttccataaaaaagatttatagt

SEQ ID NO: 37266 - DNA, 1086 bp, Homo sapiens
gtgttttggtcagtttcttctgatagccatgcctaggcaaaagtgactagaagattaaagagttgaaagtatccatacccaaaaagtataccaacgttacagtctcaaccaaattctctagttttgatcttgctcaattgtccaacgtcattatgaatttagggtaaaagaatggcaacatatgcattcatctactcactcaaaagtggaaccctgatttccctaaagtactgggctttatgtagattccctatgaccaactttcttaattctttttcatctgaagccgttattacactttcacgaaaagaaaaccaaaaaagtaccatagggataaggtgctatttttctatccaaattcagaataaagaacattttccaattttatttcagcttttcttttaattcttagcattccagtgtacttcttagcctagtctgaagttaggatcacaggcctaagtttgggggcttctgccacctgtgggttggtaaggatttagtagtgactgatttttgtaaagggtgttgagagtaagcaattagaattccttttcctcaatctcttctttcttcaatttgtactgctgcaataaaagtcctaaaagtataccaattatatatttgggataaagcgagactccttgcattatttttctttgtaatttttcctgaagtggcttggatctggaggaaaataaggtaaacccacagtatggcagagaagagttgatgggatgtagagtgaatatgatgcaaagtaaaaatgagaaagttaggtaaaagaaagaaagagggtgtgaagttagtgaagattattattatagcataaaatttaaaaatgatatttaaatataagatgggagacgactgagagttatatcgaggaactgaaataagctggttcatatttggcctactttaagagacattggcttaagtgtagtagagcttgaattaaatgatttctcaagatttttacatttgtaagaaatatggggctgacagcacagagaatagtttgtgggaaaggaaagaatcaggaatttatacatgaagaagaaggaaaataggaataagagaatg

SEQ ID NO: 37267 - DNA, 1092 bp, Homo sapiens
ggcgtacaatgttatgttctgatatatgtatatattcattactggatgattaaattaagctaattaatataattatcaccccacatacttttatttgtggtacaaacatttaaaaatctacttccttagtaatttttaaatatacattacattcttaactatagtctccatgctgtgcaatagatctcaaaaacttattcctcctaagtgaaaccttgtatgctataatcaatatctccccattcccttctctcccatccctagcctgtggtaaccaccattcaattctctacttctatgagttgagatattttggatcccatatatgagaccatacagtatttgtccctctgtgcctggcttatttcacttaccataatgtcctacaggttcatctatgttgtcttaaataacaggatttccttctcttttaaggctgaatagtatttcattgtgtatatattaacacattttcattatccattcgttgtagatagacagagattgatttcatgtcttagctactgtgaattaccccacaatgaacatgggagtgcagatagctccttgacatactgactttggatatgtactcataaatgggatagctggatcctatggtagttataattttaaaatttggagggtcctccacactgttttccataatactaatttatattctcactaacagtgtagcagggctccctttctctacatcttctgtaacacttgttatcttttgtctttttgatgatagtcattctaacaagtatgagatgatttctcattgtggttttaatttgcatttccctgatgattactgatgttgaacattctttcatatgtttcttggccatttatatgccttcttttgagaaatgtctgttcatgtcatttgcccactttttgttctatggatcagaagattctttgtacatttttaatagggtgattagttttcttgccattgagttgtttatatattttggacattaacccctgatgagatgtacggtttaaaatattttctcctaatctataggttgtcttatcactgttaaatttcctttgctgtgcagaagctttttc

SEQ ID NO: 37268 - DNA, 1088 bp, Homo sapiens
tggactcacacttctaaaaaaatacagatttggaggtttcctttctagggctccctactttttgggattttccgtcactttccagcagccctcccatttctgtagcattctgtcctttgattcctcaaatcagaagactgccatcttctgctttatattttaccaccctgccagtaaatagcttcaataaactgaggatagggaagagaggagggagctaaatgaaatagattgtctcctcttaatctttcttgtacagaaattctagagttcgcaccttgtgttttcgtttgtttgatagtttatttctgccaaatctttatgacctttggtctaataaatggttataaaatcttttcaaatatatttttatgttctgaataaaaaatgtattaaatgaagggaagtagctaatgtaaaggcaaattaagtgaaccccaaagtacatactatatctgcagcactgtccaagggagaagatggccaacagcaaaaacaagtatttcaagatataatagcagatattttcttgtgtgggagatggattcaactatagttttctgacactgcctgttaaaatatataggtacgatgtaggaatctgtttcttatttttttatgtatgtatgtatgtataagatggaatctcactctgttacccaggctggagtgcagtggcgtgatcttggctcactgcaccctccgcctcctggttcaagcgattctcatgcctcagcctcccaagtagctgggattacaggcacccgacaccacggctggctaattttttgtgtttttagtagagatgggtttagctatgttggccaggctggtctcaaactcctgacctcaggtgatccacctgccttggcctcccaaagtgctgggattacaggcatgagccaccacgcctggccagaatcttttttttatactgagcattggtgaagcctctggtaaaatattatattccattttgaaaatcagtttgaggtgaatagcaaaatgaataaaaccttgggaaataggttttgtgttgagaggctaatccatctaggcttatgtacctttggaggtgacaaaaccaa

SEQ ID NO: 37269 - DNA, 1028 bp, Homo sapiens
ggagtagttttcatcatgtttggggtcagtgagcttcttagatctaatttaatcagattttcaccattttagccaatattttctcaatatattttttggttttgcccttcttgccttgctttggtgactttaattgcagatatatttggttgcttgaaggcaactcacgtatggtctgcttatgattttaaagtctctcttctctgtgtattcaattttgggtagtttctattgctatgtcttcaaggtgacttttttctacaatgagtaatccatcagtctggtctaatatgtattttcatcttatgtagtataatttttttcatctctagtggtttaatttgggtcttttaaaaaatctttcagatctctaggctttagaaaatacaaaaactattttaaacattttgtctactaactttattatatgtgtcagttttggattggtttcaattgacaatttctttattatgtactgtattttattgcttctttgcatacttcgtgatctttgattgggtgcctgacattgtgttattttaccttgttgggtgtcagatatttttgtgtttctgtaattattcttgagcttttccttggggtgcagttaagttccttggaaactgattctttcttttaaaatttgttttgtagtaccaattcagtgttcagtttagggctaattattccccagtactgaggcaagtcccttctgggtactctacccaattgccctgtgaatcttgtggttttccagttggtctgggtggatctaggccctatatttaatgttgtgtaagtgctaggcattattacctctaatccttttgggtgataatttgcctggccttaagtgcttctcttacgtcatatgagccagattcacactcaactgaatagttaaggggaatcctttgcaaatctccacaattatctctttgtgtagctgcctctgctgctgtacttagtcctgtaaattttaactgtctttgtctcctgtattttctgttctgtctcttcaactcaga

SEQ ID NO: 37270 - DNA, 1034 bp, Homo sapiens
acattaggttctagggagggaatacaaagtatatgagttagaatcttgagatccagtaagataatgtaaactttagaaaaagttcccgggtaactgagtcatacagtgaaatttctgaatttttttaatagttatacttactttaattgactttatctacctggcatcattggtgagaaaatttggtttatgacatgcttgctgaataaaatcgtatggttctatattaatatatgttgacattttagtctgataaaatgtgcaacaccttagagtcttgtggtctggaatattcttaaatatacttaaggaattaaaaatatactaggaattgtgcgaatgtggaaacctttctgttaaaaaatatggacattgattagtgtcaatgaaattactagaagaagatatctgttatatatagctaacaaaacgatcataaatatttacatggcttttgtatttatatttgtaaagccctgtcttcccaaatatgacgcacagtgggctcccaatacttcacatttgcattattatatctccattggatttttaccttttgcctcaaatgacagaagttacaccaagcacatatataggtattcaagtagtagagtacatctgggcaattagcccacctttctttgcactggctacaacattcagctgtccaactttttattctgaattcgccttgatattttcccgattctctgcagggctcttctttgcttttgtaagctacttcgagtgcctttttgatgtttgagatttaaacataaatttttattttttatttttattttatttatttatttatttttgagatggagtcctgctctgtcgcccaggctggagtgcagtggcgtgatctcggctcactgcaacctccacctcctaggttaggttcaagtgattctcctgcctcagcctcatgagtagctgggattacaggtgcgtgccaccatgcccagctgattttttgtatttttagtagagacgaggtttcaccatgttagccaggatggtctccatct

SEQ ID NO: 37271 - DNA, 1025 bp, Homo sapiens
gttctgtccctctagataaccctgactaatatagcttctattttttggtttttgaaatatatacatgtaaacaaatttcttcccctcaccaatttccacttatttcacctttggtttcctgaatggggttcacttaagtatatcagttttctaaagactgctagcttttttttttttttttttttagatgtgacgaaggagtttcctgtcaactctattctgcccataatcttcatttcttaaacgaagaaggaaaagaaaagctggagtgaaaagttttgaaagagaaaaaattgatctctgtaataattttcaagaatttttactgcaactaaaattcagtgtttagtttatgaagaaaaaaatgaatggctatagtacatacatttccatggtaacagaagtgctaaatacggtattaaaaatggcaagatatgcctgtaatcccagcactttgggaggccgagatgggcggatcatgaggtcaggagattgagaccatcctggctaacactgtaaaaccccttctctactaaaaatacaaaaaattagccgtgcgtggtggcgggcgcatgtagtcccagctactcgggaggctgaggcaggagaatggcatgaacccaggaggcggagcttgcagtgagccgagatcgcaccactgcacttcagcctgggctacacagtgagactccgcctcaaaaaaaaaaaaaaaaaaaaggcaagttgtttatataggatttatattgcaagaaaaagaagaaggggaaacaagatttaatagatttagtggctgggtacagtggctgatgcttaaaatccaccactttgggaggtcgaggtgggcgtgagaggtgacagctgctggcagtcctcacagcccttgctcgatctgggcgcctcctctgcctgggctcccactttggcggcacttgaggagcccttcagcccgccgctgcacagtgggagcccctttctgggctggccaaggccagagctggctccctcagcttgcggggaggtgtgga

SEQ ID NO: 37272 - DNA, 1713 bp, Homo sapiens
gcctcctgaggtagctaggattacagacgtctgccaccatgccaagctaattttacaattttagtagagatggagtttcaccatgttggccaggctggtctcgaattcctggcctcaagtgattcacccacctcagccttccaaagtgctgggattacaggcgtgagccactgcacccagccttttgtaattatttttgtaactgtgatttaatcttaactctgttaaattgattttttttcttattgctggtccttttatatgtcaatttctcccatttttgagttgttattttttatatcacttagactgctgatatatgccttcaataattactttcaaatacatatcttatagtcagtattcaataaatattgcctgcataaaataataaatgaatgaatgaaggaaggaaggatgttaagcctttacacatcatagaatgtctttctgttctgtggtaaaaagcgtatgactttttgttttatgaaaagtctactttttactcttgaatgatggtctcatgtctctctctttttttttcaacaaacaattttttagctttttttttcttttaaacatttaaacattttaccaggatatgtctaggttttggtttctttacattgattttaccaggaaaagaatgaaacttttaatcttctaatttaagtcattcttaaattcaggaaggtttttttctggtatgtatttgtctgtttttgtacagttgttctgaatccatttttcaggaatatgactaattttgagattggatcccaggttctaaccctcatatcaataattaattttcatctgtttgctcattttatgtatatttagaaggatttttggcaaatgacataagatgaggaattaagtttttttttctaattagcttgccttctcaaaactgaaaaaatacacgtttattttctatatctttcattctgtttttattttttaatttattttttattttttatttttatgggcacatagtaggtgtatatatttatagggcacatgagatattttgatacaggcatacaatgtgtaataatcacatcagggtaaatgtgatatccatcacttccagcatttctctcttgtgttacaaacaatctaattatacttttttggttatttaaaaatctaccattaaattatatttgactgtaatcaccctagcaaatactaggtcttgaactagcaaatactaggtcttatgtattcttttttaaaaattttattttaaattatgttttgtagagacagggtccccatatgttgcccaggctggtcttgaactcctgggcttaagcaatcttccaccttggcctcccaaagtgctgggattacagccactatgcccagccatgcatttctttattattttgtacccattaaccatccccacttctcctcaaccccctgccccccactatccttcccagcctctggtaaccgtctttctattctctgtctccatgagttcaattgttttaatttttaccttccacaattaagtgagaatgtttgaagtttgtctttctgtgcctggcttatttcacttgacataatgacttcctgttccatttatattgttgccaatgataggatctcattcttttttatggctgaagagtaacttcattgtggagtactccactgcataccacatagttaggattgctagtgagattgagcact

SEQ ID NO: 37273 - DNA, 1050 bp, Homo sapiens
atatgccctcaatccctagatgtattccttgaaggttgggaatatatctatatgtgtatattgatatatatttacataacattagagagatatataatatataaaaatgtttcagaaattattaaagatattttaaaagtaaattatttctaggctagggtagcaaatgataatgtaaggaaattgtagcctagtcttatgaacgtagatgcaaaatccaacagaaaatactagaaaaacaattcataccaattatacatacagtataagaaatttataatgctgaaattcaatttcttccttcttggcatttttgttattgtcagatcttttattttgacagatgttacaaactccacactatattgtttttattctaacttaaatagacttttgaatatatatgtgtatattttatttatttatttatttgtttgtttgaaatagggtcttgctcagttgcccaggctgcagtgcaatggcacaatcatagctcattgcagccttgaactcctgggcttaagtgagcctcccacctcaccctcaaaaagtgctggaattacaggcgtgagccactgtcctgcctttttattggaacatttcgttcatttatatttacagtagacagacttctaaaaccctgttcaataattttcacctcctggtatccctggctttgtgttatccccttcccattaggtgtggaccggggaacttatgacttgtttgtaatgaatcaatagaacaaagggacatcacttctgagactaggttacaaaagactgtgactcctatcttgctgtcattctgttgctctttctcctttgcttactttgatgaggtcaactgccatgttgtgattgtccatattgtagtttcttatcactaagggtgactgcttctaacagcccgtgaggaactaatttttttcttttttttttgaaagggagtcccactttgtcgcttaggctggagtgcagtgggggcaatcttggctcactgcaacctccatctcccgggttcaagcgattctcctgccttagccacccg

SEQ ID NO: 37274 - DNA, 1100 bp, Homo sapiens
gagacaagggaacagctggttggtggaacagtcaaaatacacacaacatttattatttaagtttgctgttttatatagatgtagttcttgattcctccaaacaattacactgatctgtgattacacatcaacataacagacataataataatgaaaagttttgaaatgtgaaaattatcaaaatgttacagagagacacaaagtgagcatgagctgttggagatattgtagtggtagacttgctcaacacagggttaccaaaaaccttccatttgtacaacagacaatatctgtctgtaaagggaaactcattaaaataaagcatgcctttatatgatctagcattacactcctaggtattgacccaaatgcgttgaaaatatgtccgtacaaaatcctgcatatgaatttttatagcagcattatttgtaattgccaaaaattggaaggaacaccgacattcttcagtaaataaatggataaacaaaatgaggtacattcgtacaatggaataatattttgcaaaaatatttggagcgatgaagctatgaaaagacatggaagaaccataatgccagttactcagttggagaagccagtctgaaaatgctatatactatatgattctaactatatgaattctggaaaaggcaaaactatggaggtgggaaaaatatcagtggttgccagaggttgagactgagaagggagagtggatggaagcaatgcataggttgtcccagtgaggactgactttcttaatatagaggtgagaccaagcgtattgtttataactgagaatctgcctgactcacaaagcaaaacccaaatgcactatacaggagatacgccaagacaagatgattcagaaagggtaaacataaagggatgggaaaaagtgtatcaaatggaattcttttgcccatgtttaaagtgggtactcttattgagttttaagagtttttttgtattctgaatataagtcctttcttaaatgtatgtttacaaatagtttctcccagtctgtgtcttgtctgtttttattttcttaatggcatcttgaagcacaaaaatttgaaattttaatggcattgtattta

SEQ ID NO: 37275 - DNA, 1052 bp, Homo sapiens
tttttttgtagagatgggatttgcaatgttgcccaggcttgtatgcactcctgggctcaagtgatctgcctgcttcagcctcccaaagtgctggaactacaggcatgagccatggtgcccgacttcttttcattttctctgtggtgttttggagaacttaagttcataatttgattaactccatttaatcaagttttctattaaggtctgagctcaaatctaagaactgtttgcccaactcagaatcacaaagatattctcctgtattttctgttaaaagtttttaagttttaggtttcagtatttaggttcatgatccattttgagttaatgtttatgtatatatagtatgagttagtgatatcgggtcatttgttttcatttggatactgactgttccagcggtatttgttgaagaaactatcttttcttttttgaatttcctttacacttttgttgaaaattaatgaccatgtatatgtgtatctatttctgaactctgtttttctctattctgtgctttggatatttctgtttttttgttctgtgtttctgtctttaagccaataccacattatgttttttaccaaagctttaaaataagtcttgaaatcaagtattatgaattctctaactttgttgttcttttcaaaattgtttcatatttccatgtaacttttagaattggtttgtcattctgccccataaaaagctggaactttgattgaaatttccctgaatcataggttaatttgtggaagattgctatctttaacatacttagtctgaatgcagatccattagcactgtatcatctttgtatttatttaggtccccatttatttgatatttaaacattttgtctcaccagtgttttgtagttttcagcatacaggtcttgcacatcttttgtcaagttcatccctttattatttcataattttgactattaaatggtattcttttaaatttcaatttttttctttttcctttttttttttttttttttgttgagacggtgtctcgctctgtcacccaggctagagtgcagt

SEQ ID NO: 37276 - DNA, 1048 bp, Homo sapiens
caaagtacaaaaaaattagctggtcttggtgatgtggtcatatgatcccagctactcaggaggctgaggcgtgagaatcacttgaacccagtagatggaggccgcagtgagctgagattgtgccattatactccagcctgggcgaaagagtaagactgtctcaaaaaaaaaaaaaaaaaaatagaacaaaggcggctaactttgtgttaggtataatagtcacagatattttactatctgtgtcgaatctgaattgattttactcttggcctaaaaaaaggactgacattcattataataatcagaattatggaattgctgtaggaatagatcagtggatcagtgaaacagattaagaattaaaataaagttgcctctggagcagcgtgagagttagggatgccacccccctgcaaagttttaaaatattaagaatgtttatattttcatctatgaataggtatgaatagtccacagaaaatgactttgttttcttcttttgtagctatcattgttaattatgcaagtaaaatgtttaaccgctgaactcagtcaatggcagaaaaaaacacctgaaagtaagattcttattttaaatttgaattttttgtaaacctattaatagcaaattaatttaataattgtaggaaaaattacaagatccatttggcctttttgaaattgcccaaatttcattgataccgagaagccactttttttctgtgaattattttgtacttcttttattattattgataaacatatcttacattagattataataagcttgattatggagacgttattatagctattatgttatcctcatagacactgccttatgctcgctagaaatggtaaattgttcctttttttttttttttttttttttgagacagggtctcatcgtgttgtccaggctggagtacagtggcacaatcatggctcattgcagccccgatctcccgggttcaagtgatcctcctacctcagcctcctgagtagctaggactacaagtgtgtgccaccatgcttggttagtggttgg

SEQ ID NO: 37277 - DNA, 1377 bp, Homo sapiens
ggcatattttatgtctttttttctagctaatttatttatttttattttttacttttttaatttctttgttaagaacgaagacacaaacacattagcctaggcctaaggcaaggtcaggatcatcaagacatcagtaggcaataggaatttttcagctccattggaaccactgttatatgtgcagtctgtgattgaccaaaatgtcattatgtagtgtgtaagtcttatctgtgtgatgatggctgtcaaattcatattgctagctcaaaactttgctttcaactgcagacatgtatatctaattgcttaatcagcagctccaataattgacacctcaaatgtagcatatcctaaactgagtttttaatcagcacttctcccatgtttgccaaatctgtttcttttaccatctttctcacctcagtaactggcaacgtaataattcacttctctctgacagtccatatacatgctgttaagaaattctgttggctccatcttgaaaatatatccagaatgggacattctgtgctgcttctatcaatattatcctggtctacatcttgcttgggtcattgcagtagctttctaattggttttcctgcttctatccttactgcctgtagttaaccagagttgtattgttaaaatgtaattcaaatgattcattcctctgtttaaaactaattgcttatcatctcaaagtccttaaaatagcctaccaaacccacatgatctcatccctattgtctctctgacctcatattctactctgtcttacttaatctgctgtaatcacaccagctccttcactactgtggaaacatggcagtcatattcctgcatcaaggcctttgcacttgcagttccctctgtctgaaccctctgcccctcttcatccttgacctcatttctttatcttcttcatgtcttcttactcagttgtcaatttctcagtaaccttatatgaccaccttatttaaaattatattgtccttgccctagcatttcctatgtttcttccttgtcttttctccatggcacttataaatcatttgatatactacagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaa

SEQ ID NO: 37278 - DNA, 1024 bp, Homo sapiens
acaaccatgctctggttttactttaaactcatgatactaatctcaggtgagcctgtaatgctactactgaataatcctgtaactttatcctctcccatttttttatatatctgttttatacatctcttttcctgtgctcttaaactcgcagtactttcttcccatcctttcatagctgataaccgtagttaccattttacggagaaaagagaaacaatccacatagaatttctacaagttcctagcaacacgtctacttacctacctgcatctacactcttgatattctgatgaccctcccattaaaatggatgaactgcatgtccatttatcttaagccaacacctctacttatgtactagatcccattctttcttctcccctttctctcttgtattagcaacatttccttcttttactgtaccgtataaagatgctatattttctcccatctttaaaaaagaaaaagtctcttttaaccctatatctccctccagctactaactgtatttctctcttgtgctttaaagaaaaaaaaatgtgtgtgtgtgtgttttctttttgtttgttttgtttgtttgtttttggtatggtcttaacggtcttgctttgtcacccagggtggagtgcagttgtgtgattgtggctcactgcagcctcagtctcctgggttcaccgggctcaagtgatcctctcacctcagctcctgaataccttggaatacaggcatgtgctgccatgcctggctagagaaaacgttcttgaaaacgtttcatatacttaatatttttaattccttgccttccattctttcttgaatccactccaatcagatttttattcttgccattcttctaaaactactcctatgaaggttatctgtggccttcatttttgtatgtttactccaagaaaattgttgtgataaattaccccagaatgtagaggtgtaaaacaactatttattacgctcatgagttttgtgcattagaaattcagacaagacacagcaggagcagcttct

SEQ ID NO: 37279 - DNA, 1030 bp, Homo sapiens
gccagttctacattgccataatagtgtagggtatgtcctcccatcttatttttcatgaggatcttaggctagttttggccctttgtgcttccatgtaaatttttttttttttttttttctgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcacccttttagccgggatggtctcgatctcctgacctcgtgatccgcccgcctcggcctcccaaagtgctgggattacaggcgtgagccaccgcgcccggcccttccatgtaaattttacaatttgcttgtcaagtcccataaagagaaacaaaaactttcaggattttggttaagattcagtagctcaacttgggggagaattaacgtctttacaatgtgggtctttcagtccatgaatatgaagtatctttccatttatttaggtctgccttagaacttctctgttaataagttattgattaagcagtataaaatgcagaagttccatatgaataaagatattgaggaggggtattctgatttgcgtttgatgtggggtagacatcctcatcattctttattgcactgtctacctccttaaaattgcccagttttgaatcttatgccaccagactctaatcctcttccattctttgcaggaatcatctagcaagattgttttactcaccctcattccttgaagatttttagctcctggctcattgccctttgcagtactactatcataattcttagtgattttaatatccttatagatgatccaataacttggcctctctttttcttgaccttctttcccctagtgattatgttctctcttgtcttagctacttattcctatggccattctttcactttgtccctgtctgtacctgtggtgctacacca

SEQ ID NO: 37280 - DNA, 1035 bp, Homo sapiens
atgtgcagagttttgcattacttttgcatattgataatgtattttggtggtcagtaaagaaatatttatgtttgactttttcgcttaaaaatattctaaaattcatgatgactgattttggctttgtgaacttaaactgtatcttatgggtatagcaggtgagattttcagccttctactagttgacattcaaattgttaatagctaacactgataaagctctttatatgctagctacagtacttatatatatatatttatatactcatttaattgtcataaccctagggagtatttaatattatcttcattttataggaaaggaaactgaggcatagaaagtttaagtgacttgcccaagtctcatagcttttaaatatcaaaacagatttaaacctgtatagtctggttgcagagttcatacctttaaagtttttttttctctaagtaatgtgccagtaaacataattgtatagacttatgcagacatatctatctttaggattattcctaagaatagaacttctggatcacaagaaatgcatgtaaaattttgatggatattatcatacaaagtgattgttccaccaacagtgcaagcctcttatttcacatgcttgccagtattatctcttaccaattttacattattgccattctgaatgaaaattaatgcttgtttaatttggattttcataaattatatatgagcttatgaatgtactttttctgtatttaaaaggtatttgttttttctttgaattcctcatttgtgttctttgccagtttctattgaattgtttttgttgtttacctttttattgtaaaaatgcagacacaaaataaacgtaaagtttactaattattatgaggtgaacacccttaccatcatgctagtcaaaaaataaaactttgataattacctcagaaatctctccatttggcccatcccagccacaacccttttcccccttccactcttcctccaaagtaattggtaacctgacttttttggtaatcttttttaaatttttt

SEQ ID NO: 37281 - DNA, 1299 bp, Homo sapiens
tgttgtaaggacttttatatgtattcttaaaaattaatcctttcaagaatcctatgtaaattttgtactattttaatcctccttttatgagatgaaagaagtgaagcagagaaatcatgcagctagtaatatataaaaatgttcattatagcattatttgtaatatcataaaatcagaaattacctaaaatctatcagttgggggtttagttaaattgtggtttatgaaatgtaaagaagccattaaaagaaaaaggttggtcaatatgtattgacaggattccataatatactgttgagtgaaacacattagtttcaatgtgtgggtaatacttttttaaaaaaaaatttgttttgtttgtgtatgttggccagtatgtgcatggaaagtgtctggagggatatacatcagattcatagtagaaatttctgggaattgagcagcactttttcattttaattgatttacccttattgtgatttttttagtatagcataaaaacatgtttaagatttagaggattcatttgagttagaaaatctgagaaaattaagtgggtatgtatattctgttatacaaagacaaagtggtcagttttactaaggcaagatttagccatggggaaggatttcatcttcttgagatcagactcagtattttgaggaatacaattcagattgcaatggttgaggaatgaataggagatgtagaaataataaaggtgctaaatgctattactttctaactgcatgtcaaacatatttaaaaatatttaaattgtaggataatcgagttcacattggaccaaaaatggaaattcgggtcgttacgttaggattggatggtgctggaaaaactactatcttgtttaagttaaaacaggatgaattcatgcagcccattccaacaattggtaagtatgaatattggtttttaccttaatagacaaaccctagcttacagccaagttcttggggtcttatttgatactgatctgtcatggtggtgggctcttttctggctctaagatatcagcatctcagagaaaaaatgcaagattgtatgactatgggattgaaatgtggatggggataaaaagaagaaacagagtattggtgggacagttggaaggaatagaggattggtgatcctggctgagggtgtggggtggggggtagttgtggaacagagctggaaggtacatggatcccaaggtcctaaggaccttggtggaggtttagagggctaggagctgttacaggtatacattcaccacgtaggagtaggaatggggttga

SEQ ID NO: 37282 - DNA, 1030 bp, Homo sapiens
ccaaggggaaaatgtctctaggccatgtcagagaccttcatggcagcccctcccatcacaggcctggaggtccaggaggaaaaagtggtttcatgggctgggcccagggtccccatgctgtgtgcagcctggggacttgatgccctgagtcccagctgctccagctgtggctgaaaggggccaatgtagagctcgggctgtggcttcagagggtggaatccccaagccttggcagcttccatgtggtgttgagcctgtgggtgcacagaagtcaagaatagaggtttgggaacctctgcttagatttcagaagatgtatggaaacacctggaagcctaggcagaagtttgctgtaagggcagggtttggaggggcgaggggcagaatgatatgcttgagattttgggtgtgcccccacccaaatctcaacttgaattgtatctctcagaattcccatgtgttagggagggacccagggtgaggtaattgaatcatgggagctggtctttcctgtgctattcttgtgatagtgattaagtctcacgagatctgatgggtttatcaggggtttccgcttttgcttcttcctcatttttctcttgctgctgccatgtaagaagtgctttttgcctcctgtcatgattctgaggcttccccagccatgtggaactgtaagtctaattaaacctctttttcttcccagtcttgggtatgtctttatcagcagcatgaaaatggactaatacaatgtgtataccacattttgtttgttcattcatctgttgatggaaacttgggtagcttccacctcttggtttactgggaatagtgctgctgtgtacgtgagtgtacaaatatctcttcaagaccctgctttcatggtcttttggatatatacccagaagtgaagttggtagatcatatagtagttctgtttttaattttttgaggaatccccatactgttttccataatggttgcaccatattacagttccaccagtggtgcacaagggtgcagtttctccaca

SEQ ID NO: 37283 - DNA, 1053 bp, Homo sapiens
tagtgactggatatttagaaaattgtcaagactatatttttaaatgatcacttagtgtacttcttaacctttatgtaaatagatagaactcagcttgttgtagaatatgtgttaaaaattaaggagaaagccttctaggggcaaggctgaggatagatatgttcagtccagtttttttgggagaaccacaacacagaatggcttttttttttttaagagccaggaggaaggggggccctgcaggcaatgactccatcaaccttttatatatttattcatttaatgaatatgtattaggtggcagctatatcagatgttatttgttgcataggagtttaccataacaaatattccttctgctaaaggatctgacttttattcataggttcaggaagagtgtgtatgttgtcctgggttacaatgttatatgtatttcttaaggtaggttgctgcaaaaagtatttgaaaatgcttgttttagcatgtatagtaaaagtcaatgacaaaataggacttgtaaaattaaatgatagagaaataggctgggcacggtggctcacacctgtaatcccagcactttgggaggctgaggcagtcagatcactttaggccaggagttttgagaccggcctgaccagcatggcgaaaccccatctctaccaaaatatacaaaaaaatcagctgggcatagtggcacacacctgtagtcccagccacttgggaggctggggcacgaggatcacttgaacccggaaggtggagattgcaatgagcagagatcacgctactgcacaccagcctgggcaacatagcaagactctgtctcaaaaaaaaagtaaaagagatttaaataatttttttaaactgtggcaaaatatatgtataacataaaatttgccgttttaaccatttctaagtttagggacattaagtacattcatattgttgtgcagcctttaccaccataattttttttatgtgtatttagattttttttttttttttttgagatagagtcttgctctgtcatccagattggagtgcagtggtgtg

SEQ ID NO: 37284 - DNA, 1028 bp, Homo sapiens
agtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaattctaaacaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttctatatatgcaaatgacattttcatttaatgtaccaaattgtgtatctaacttttataatataggttaa

SEQ ID NO: 37285 - DNA, 1054 bp, Homo sapiens
caaaaaaaaaaaatagccctataggacagcggtccccaacctttttgtaacagggactggtttcatggaagacagtttttccatggaccataccgggtgtagggggtaggggcaggatggggagaggagcgttagattctcttgaggagcactcaacctaggtccttcacatgcgcagttcacaatagggttcttgctcctatgagaatctaatgctgcagctgatctgacaggaggtggagctcaggcagtaatgcttgctcgcccaccgcttacctgctgctgtgcagcctggttcctaacagtctgtggcccaggggttggggaccgctactataggaaacaaagcagtcaatggtgcctcttttctactacaaccggtcagtctgtagcaggcccatgctaggaagggagaagttttacctgtaaatgaagctttatgtatttgattgttacactgagacattaattgctgaactggaggtcattttatagaacttaaagtgacaggaggattgcttactgaaaagtgactggaaaagcatagatctgttctaaatttcctctaggtcctagattgtgggagaaggggaagaactactgctgcagaactagtttaaagggattgcaaaacacagcatttcatgtttatagctcatacatcctgcttttcctgtgtaatgcctttagcacttatgggttggctcagaggcaccaatcctgactgggacttgaggaaagttttgaattacttacgaatcagtcagtgatctttctggtaatataagcaagtggtggcttttcccaacacctcatagagagtctgtgaatataatctattgtctacaaagatttagactaaattcaaattttacataaatattgtcgacattaccaatttgagggaaaaaatgtgatgctttcaaaatagaatgttttaaaagtatgtgtgcacataaatataattccttgtgccactgtaagcatgggaaggattgaaattgctgggccccatggagcaaagtcacatctcttaaaagctcgtttggaatgg

SEQ ID NO: 37286 - DNA, 1025 bp, Homo sapiens
tctttaatccatcttgagttgatttttgtatatatatggtataacgaaggggtccagtttcaattttctccatatggctagccaattctctcagcaacacttattaaatagggaatcctttccccattgcttttgccaggtttgtcaaagatcagatggttgtgagtgtgcagtcttatttctgggttctctgttctgttccactggtctatgtgtctgttcttgtaccagtaccatgcagttttggttattgtagccctgtagtacagtttgaaattgggtagcatgatgcctcagctttgttctttttgtttaggattgccttggatgtttgggctcttttttggttccatatgaattttaaaatagttttttctaattctgtgaagaatgtcaatggtagtttaatgggaatagcattgaatctataaattgctttaggcaatatggccattttcacgattttgattcttctatccatgagcatggagtgtttttccacttgtttctgttctctcttatttccttgagcagtggtttgtagttctccttgaagagttccttcactttgcctgttagctgtatttctagatattttattctttttatggcaattgtgaatgcgagttcatttgtgatttgactttcgacttgcctgttgttggtatgtaggaatgctagcaatttttgcacattgattttgtatcctgagactgtgctgaagttgcttatcagcttaataaacttctcgactgagacaatagggttttctagatataggatcctgtcatctgcatatagggataatttgacttcctctcttcctatttgaatatgctttatttctttattgtgcttcatttccctggccaaaacttccaatactattaatttgttgaataggagtgatgagagagggtattttgtcttgtgctggttttcaaggggaacacttccagcttttgcccattcagtatgatattggctgtaggtttgtcatatatggcttttattattttgaggta

SEQ ID NO: 37287 - DNA, 1047 bp, Homo sapiens
atgacttacatatttgtcctttctatagcaaagcaaacagtgaaaggcagcctgcatacttttttctgcacagaagtttctgagcttttttttttcattttattacataattatcttagacagtttgacttagaaatttagtgggagtgatctacaaattggaacaagaaaaaggtagtattattagtacctgaaaatctaaattagtgccttgaaaactgcctttaataaaattctgttttctttctcttagggctgctgctcagagcaaattaggtcactacacagatgcgataaaggattgtgaaaaagcaatagcaattgattcaaagtacagcaaggcctatgggagaatggggtaagttctgggaggatgttccaagtagtaccatgtagcatcaggtatgctgttcttaatggcttggttttgaatttcctgcttaatgttttaccctctgaactaataagaggataaataaaacataagggaggaaatgactacaatttctttgactaggaagtgagatgattgatgactgatttgattgttggagaaaattatataaccgtaccacaaatctcagatgagcactcaatattgcagacagttaggcagacagttctattatttttccttctatagtcacctttccactcgctgatgtgacgatttcatacctcttcctctcccttcaaatttccactaccccctctctggtgactctcaactgatgctattgccttacacttaattgagaagctagatgctttttgaaggaaaacaactcattttcctccttgcaaatccatcagtctgcctacatttgtatctacacagaatgcccttttttcttgttaaaatggaagcattctggctgggcgtggtgactcacgcctgtaatcccagcactttggaaggccaaggtgggcagatcacttgaggtcaggagtttaagaccagcctgcccaacatggtgaaaccccgtctctactaaaaatacaaaaattagccaggcatggtgatgagcacccgcagacccagctact

SEQ ID NO: 37288 - DNA, 1132 bp, Homo sapiens
aatggtaactctacttttagttctttaagaaatctccatactgttttccatataggttgtattaatttacatttccactagcagtgtatgagcattcccttttcaccacgtccatgccaacatctgttgttttttgactttctaataatggccattcttgcaagagtaaggtggtatctcattgtggtttcaatttgcatttccctgaaaattagtgatgttgagcattttttcatatgtttgttggccatttgtatactttgagaaatgtctattcatgtcatttgcccactttttggtgggataatttgtttttttcttgccgatttgtttgagtttcttgtagattctgggtattagtcctttgttggatgcacagtttgcaaatattttctccaattctgtgggttgtctgtttaccctgatgattatttcttttgctgtacagaaggcttttagtttaattaggtctcacttatttatttttgatggttccagactctgtggattctaatttctggctctgacacttactacctatgggaccttgagcaaatttcctagtgcatctatgccttggtttccctatctgtaaaatgtgggtaatactagtatttaccttgtagggttgttatggagatcaagcagtatagtacatttgatgcatttcaagtcaacttgcagccatcaatatacatcctccctaaatacttagcatgcatatcattaactagagtttagtatttacttttttgggggtaaaatttgcttacaaaaaatgcataaatcttaactgtactttcatggagttttgacaaatacatacacctgtataacctaaaattctatcaagatattgaaaattaccatcctagccaggcatggtggagggtgcctgtaatcccagctaccatcagatgtccaggaagttccttaaaccccttcacagtctgttgcctacaacactcaccagaggtaaccactgttttgatagattagattcatttcctctagagtttcatatgaaagaaatcatacatattttctgtgcaagactttatttgctcagcgtaacggttttgagattcaaccatgttgtggcatgtattagttcattcttttttattgatca

SEQ ID NO: 37289 - DNA, 1028 bp, Homo sapiens
tattagtatactgcagagatatctgccctcccatgtttactgcagtactattcacaataactaatatttggaagtaacctaagtgtccaccaacagatgaatggatagagaaaatgtggtacatatacacaatggagtactattcagccataaaaaacagtgatatcctgtcatttgcaacaacatggatggatctggaggtcactatgttaagtgtaataaaccaggcacagaaaaacaaactttgcatgttctcactcatttgtgggagctaaataattaaaacaattgaactcatggagatagggagtagaatgatggttaccagaggctggaaagaatagtggggtggtggaggcagggtagagtagggattgttagtgagtacaaaaattagttagatcgaatgaagatctagtatttgataacacaacagggtgacaatagtcaacaataatttattgtacattttaaagtaactaaaagagtataattggactgtttgtaacacacaaaaaaggataaatgcattgtgtgcctgtataaaaatatctcatatactccataaataaatacacctactatgtacccacaaatattagacacacacagatacatgcatgcactgactcacaaaactttctaaaatgctctgcttaaattcttaacccacagaatccgtgaacaaaatactgatttcttatgccactaagttttggagaaacttttatagcactatattttgtagaacagttattatatttaactactattaagaagattttggtaactaatattaattatagtaataatagaagaaaaatggagggtagtaagtagaagttgtttagtagctagttttttgcttgatttgggagaagggtaaagatatttaataaactcgggctttgataagattttatagttaagtttgtaggctaagcttttgaaaacaaccattaaaagaacagaaatttaataaatgaatccaatccagaaatgaaggaaaagaaaggaggtaataatga

SEQ ID NO: 37290 - DNA, 1094 bp, Homo sapiens
tttttttttttttgtattttagtacagatggggtttcaccatgttgcccaggctggtctcgaactcctgagttcaggcaatccacccacctcagcctcccgaagtgctaggattataggtgtggaccaccgtgcccagctgttacagttatctttatacctaaaatgggctcttatcaatagcagtacccttattttccctgatacagcacaactctgcctattctaatcatgacctagacacattcaatgaactacaagttctcctttacacggacacattcatatgcacattatttgttatatagagataacacattcaaaagatatcctcaatgttcaacaacagaggattggttaaataaatgattgactgcccatacaatgtaataatgcagtcattaacaatgtattagaatattaatcaacatgacattattaagtggggagaaaatttataaaacattacgaaagttttttgccatttttattttcaaaattttaatatggaaacaacttgtaaaaatgtttctttacatggctttttgtagaatgggaaggaaacaaaaagtatttctttccaggtggtaaaattatgtgatttttttttttcttttttgcacttttctatattttgaagttttctgcaatggatatatatacatatatatatatattttgttgttgttgttgttgttgtttgtttgtttgtttttttaagacagagtctcactctgtcgcccaggctggagtgcagtggtgtgatctcggctcactgcaacctctgcctcctgggttcaagcgattcttctgcctcagcctcccgaatagctgggactacaggcacgtgccaccacacccagctaatttttgtattttttgtagttttagtagagatggggtttcaccatattgaccaggctggtctcaaactcctgaccttgtgatccgcccgcctcggcctcccaaagttctgggattacaggtgtgagccgccacgcctggcctacaacagacatatattattattgaaataaaaaatactttaggccaggcgcggtggctcacgcccataatccctcactttggaaggcc

SEQ ID NO: 37291 - DNA, 1048 bp, Homo sapiens
ccgaagtccatagtttacatgaggacctgtgtatgtaagtttctgaaggtgacctaagcatatagttgaaattcaaatggttattaagtaaagagaatgagtatgcaaaatggatggtttaaaaatatttctggttctgattatgtctcagctaagaagggttaagagtatgtttagtccaggcgcagtggctcacgcctgtaatcccagcactttgggaggccgaggtgggcagatcacttgaagtcaggagtttgagatcagcccagccaacatgatgaaaccacttctctactaaaacacaaaaattggccgggcgtggtggcgggcgcctgtaatcctagctactcaggaggctgaggcaggagaatcacttgaacctgggaggcggaggttgcactgagtcgagatcacatgactgcactccagcctaggtaacagagcaagactccgtctcaaaaagaaaaaaaaaaaaaaagggtatgtttaaaatcctggccgggcatgatggctcacaactgtaatcccagcactttgggaggctgaggcgggctgatcacttgaggtcaggagttcgagaccagcctggccaacatggtgaaatcccgtttctactaaaaatacaaaaattagccaagtgtggtggcagacacctgtaatcccagctacttggaaggctgaggcaggagaatcacttgaacccaagaggtggaggttgcagtgagctgagattgtgccactgcacttcagcctgggcgacagagtgagactccatttcaaaaaaaaaaaaaaaaattcttaccacattcctttaaattgtttttatttttgtgatacgtgtaaattccagactattttgaagtaggaaaaactatatttagatttttgtgttccaattatggcaataaaaatattctcgctcagcaaggaaatattaatgttttagttatttgaaagccacttttttccaggctaaactgtgaaaatgcagtcctcaaagagaatttgaaagtgaaaacagaagaaattaaaatgctgaagtctgaca

SEQ ID NO: 37292 - DNA, 1027 bp, Homo sapiens
cacacacacacacacacaccccacaccatattttcttcacctgttcatctttgatggacacttaggttgattccatatcttggctattgtgaacagtgctacagcaaacatgggaatgtagacatctctttgacatactgatttcaaatgttttgggtaaatatcgagaggtggggttgctggatctactgatgttttcctaactactgtttttcttaactacagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactggtaagaatgctgaatttcctctcctttctttctcctgtgcatagtatcaaagctataacccttccaaaatctaaaataaataaccatattggattttagattttcttttttttctggacggagtcttgctctgtcacccaggctggagtgcagtggcacgcgatctcggctcactgcaacctccaccccccgggttcaagcgattctcctgcctcagccactggagtagctgggattacaggcatgcaccactacacctggctaatttttgtgtttttagtagaggcgaggtttcaccatcttggccagactggtctcaaactcctgacctcaaatgatttgcctgcctcggcctcccaaagtgctgggattaccggcatgagccactgcacccagcttttagaaatttatctttattcatctcttgggattggtggtagtataaaagtagttgatag

SEQ ID NO: 37293 - DNA, 1063 bp, Homo sapiens
caaccatctggatagttcccagatgtttacagctctaaattagtatgtttaaagcacgtgctctgaaagcatccttgactatacttgcccactcctctgatttctacctcccaagcatataaatacacattcactctctccacacagatccacttggcctttaaatcttgacggtttctcctacacatccctacagtacccctatttcatcaagacccctggtgctgtgcctagaatcctacctagaatctcctgtttgacttcttcagtatctctttcttccctcttctacactatcattttcttaaaagtggggaaggagaatgacatgatttgaactttttactcacatagtccattctccttcaggaaatataggagattctttataaaatggccacagtttacctgcagccgttctctcccctatgtccccttcagtgcagccatcataccctgttctcactaggaattttccacctcgagtatttatgcatgctgttctctttataggtttccttatcttccttacaactccttggaggcccaactccaatgtcatatctttggctgtctaacttcactatgcagaattaattgcccttttcttttcgcataaaaagccaggtattttaaaggcacccaatcactctaaaccagttaatttcttgttctaattgctttagagttatcagcttcttgttgagttgaggtaaatgtggtgaatatgttttcaaaagaagaaatatgaaaataaaaattttaagtattggcagcagtgtcaaaacaaccagcatcccaatatgattaaagaacagctttcacttgagtgtatataagttctaggatggcagttaaacataatgtcatgattttacagtttgacaaacagcagcagctgggaaggttttttaaggtaagaatgagctttaaaaaattttgtggggcctggcgcagtggctcacacctgtaaacccagcactttgggaggccagggcgggtggatcacctgaggtcaaaagttcaagaccagcctggccaacatggtgaaaccccatctcta

SEQ ID NO: 37294 - DNA, 1050 bp, Homo sapiens
aagataggaaaaaagaaactgaaggaaagctgccgccaacttttccccctccattgtgcctagatggggggagaaggggatgtaaacagcagggcagggttcaggtagggtgactagccctcactggttcccagggactgaggggttttctgggacacaggactttcagtgctgaaatcagggcagtcctgagcaaaccaagatagttggccaccctggcttcaggccagaaggaaggcttcctggaactgaacaatttggcagtggaatagaaaacaacttatttactatttaatttgagtctgatagatgaaattaaaatctgtaagtgatgatttcccaccctgagtgctcacatgcttaaccctttaatttctggagggatttcagaatccctcttagcaagcagtgatttctgataggaccattcaatgtagccccatggtttggaggggaaatgttaagatcaaaaggagtggatatgacacacagagggatatcataataactcaggacaggctgctggggtcttttgaggctaaaggaccatctctgcagacaggcagggcccagtcttggaggtctctattaagaaccttatgggcatgttttttgtggccacatggtgggaaactgaagtgccagggcctcccccatttacatgctgccattgtgagcagtctgtgctccttaacatatgctgatcctgctctctgctgagaccctgtgtgagctcttgtctctgcctggaatttacttttggtccaaccaatgcacacacacacacacacacacacacacacacacacacacacacactccagagctcagccgagacatcatttgcggtgcttttcctatggtcacctaagctcgctcttgaattttaggagcccccatcacgatgtggtatcattgcctctgctggtctgtcttcccccaatcagttagggcagcagttaggttatatcttgtaatataacctactgccaggtacagggtaaatgtgtaataatcatttgaatgacagggaggaaatcctcctcttgt

SEQ ID NO: 37295 - DNA, 1030 bp, Homo sapiens
tatataactcatcctgggctgcttcagacttttaagaccctgtggggagctataggaagtaagggataaactgatgagctacaatggaactgtgaagaaggcagtgtgggattgtggatcttggaggacatgaatgttaaattttactcaacttttatttcttttcctctgttttcctttgactcagtgaagagtgtcccagtctctcctaagagccacaggaagtatcactgttactcaaagctgattctcctctacagagttgctgtgctatcctatttttcattttcttcatttgttttaaacttccaaagtttcagcttaagcttcacgtctcttctaatgaaatatctgtttacataatgccatgattagtagagtatttttcccaaatcatttttcataaatctattaaaatgaactgttgaagtaaggggtataaggaatacaatttttgtaaaattttttgttatttattagtttgccttctctttaccatttcagactttgtggttaataagtttcattctcaagtttttatcaactgttgacttttatgaatttctgtcacattgcactctgtaagtatctaagagaaggacctatcgatggaagatgtgttttaacatataagagttaacaccagttttctctcttcttgtgcttatttaggtttcgacacagccccaactgctggtacctgagaaactggactatccacacctggattaggcagtgtctaaaatatgatgcacaagacaaagccctatatacccttgtaaataaggtgagttgttccgtggatctgcagcctgttttcctgagtttaggtgatatggtgtttgtacctattgtagtacagcaaagaataacaccagaaataactttaaaaaattatttggcctcaaatattcttattaacagaatggagctgggtataagttcattaataaattaaaaaaaaaaatcctgtagctgctacttttccaaatgtagtgactcagaaaaggacaggtataagcaaaaggaa

SEQ ID NO: 37296 - DNA, 1192 bp, Homo sapiens
agtcagcatagaggctctgagaaaatgagaaaataacagacctattgttttgttttgaggatcacttaagcaaatatgtaaaatcagatcacatagaataattccctgacctcagtgagtcttctttctaaactgcttcctgtctgcctcacccatctatttctgcagttccacccactgcagttttaaagtgactttggatagctgggtgaaaaggaagagggcaatacattaagactcagttaatataatttgcataatgaaattgtcaaagtgttcttggcccaaaaaacttgtttataaatgaaagtgaaagggttgaatggataatttgaagagagtgccttttcggctctatatattcaatcataggatgtcttgccactgagtcagcaaaggtttttctccaacctactccattaaattttattttacgcattctttttttaatacatataagtatttaaaattttgaaatgtcttagttgtgcttcttaaatgtaaagtgcatgctatcccatttgatagcaatttctgcataagcctgtaggtgaataaaacagaacttcataatacgtggaatatatcggatatacacatttgtggtaaccttagatattatagtcattgaagggatataatagcaaatggtgacatttgattatcaaaatagtagtggaagttctagggctgaggtggcttgccaaatctacttacttcattccaggatcaggagagaaacaagacaatggctttcattcagtatgcttgaaaccaaatgattttatctttaacatttgaaataacagagttttctagacaaacactccttcttccagaggttaatcttaattgagatagcactccctggtttattgattccttgcttgggtcgtgaagaagccccagttgttggttcaaagttgatagagactttgctccctagatcacctattttagcgtcaggcaggacagcttagtagtcaagagctctggagtcagactgtctgggtttgaattttggccttgttcagtattaactgtgggatcttgagaaagttacttaaccttttgatgttcagtttcctcatctgtaaagtgtggataatatacttaccttatatagggttgtttcgataagtaaatgaaataatctttaaaaagcaattcgcatagttactaaaataatgta

SEQ ID NO: 37297 - DNA, 1051 bp, Homo sapiens
tcttcctttccaaatttcaagccttttaatttttcttgccttgttgcactagctaggacttccaatacaatgttgaatagaagtagtgggagcagacatgtctttgctttgttcccaatcttagagagaaaatatttaatatttcaccattaacgatgttagctgtaggtttttcatagatgccctttattgggttgaggaagttccctttcattcctggttttctaagagttttcaatcaaacatgggcattgaattttgttaaatgttttttctacaaatatagacaattacatgagttttctttttcactttcttaatataatgtattactttgatcagttttcaaatgttaatccagacttgcgttcttgggatgaattcccaagagtgtattgtcctgatgtagtattaatttgttaaattttttaagttttcagtaacactatgttgtcagtaagactggactccaaatttctttgcttatgttgccttgtgtagttttggcgtcaggattgtataatgtcacaaaatgtattgggaaatgttcccttctttattttctgaaagtttgtttaagagtttcttcggtgcttgatagcattcaccgaaggtattatctgggcctggagttttcttaagaagatgttaaattataaattaatattttaaagtagatatgacttctcaatgtagttttattttatattgttattactgaggttggcatgttctttttttaactcaactaattcataaattcacaagcatattcttatgtgcttaagagtcatttgtacttccatggactttcttttgccttatcctgtctttctgctaggttattggtcttgtcttactgatttaaggaatagcctttaattaatgagtattttttctttttttattactttgctttatgatagtttttgctatgtaggcattttaatattattattattattattattattattattattattattattgagatggagtttctcttttgtcgcccaggctggagcataatgatgcaatctcagctcac

SEQ ID NO: 37298 - DNA, 1054 bp, Homo sapiens
catatcttgcctacttgaccatacttggactgtttgacaggaactggccacagacctttggagaaagaacaattgccaaaacatacccattgggtcttcctggtgtattggcactagttggaaaattttagaccagatgacctctgaagtcctgccaacttccggaatctgaaattgcaacctggatagactaagtgagtcccttggagccatgtgacaagtccaagctccagctgtggatgaggcctgacttcaagttcagaagctcatcagctagcccagtgtatctctttgtgtcagttttttttcctaagcagtttcagtaatataccaaaagatacagactcaatgaacattttgaaacctcctaacagtgtgacatagaattaattaaacctagaaaaaaattaacataaaaagaaattcaacaatgaaaatgtattatcttgtgggggaggtactaaaaagaccctgaaggagtcaggatgggaagaaagaggtgactggggtcttaggaccagtttagtccccactttgatctgtagctttgaactagttagtgaactctctggacatcagctttctagatgagcagatcatcttggatgcctcccaaggcacttcccatagctaaaacataatgtttcttaatgtcactgataagattttatcaccagatgcctcagactttgaaagcatgtagctctggctttttgtttagtttctcacgcagaattttattcactttaaaattgaagttccagccgccttaactatgaatatcaagagaaaaactaatagatgtaaaagtaaacaacagaaagggtagaagatctcttattctcttctggatttaggtgacagacttcatttactatcttgtttgtgaatatatttagtaaattttgtggtatgagaagttgggtatccactcttatttatcctctaggtaactaatttttatacatatgtacttgcctttttcctgcaaggcccacaaaccacatgtttttgatgccttgtatatacatgagatttaaaaggagaaggctaa

SEQ ID NO: 37299 - DNA, 1052 bp, Homo sapiens
tatgcccttaatggatttctaagtcaagtccagaagtgctaggcatttttagaaagtctccctctttttactctcctctctttcttttatgaggttttcattatattcacaacatgcattgtcttctacgctttttttttcttttttgcctctgagtctctattttagaatagaatctgtgtttggaataatcctttttatttgtttatttggaccatagttaatgagcatactcagagattttatggtttgaagggagagtttgttggtaaaggaatcataggtttactgttgcatagcagagctaaatcaaagtagaaaaaatcgttgcaagactgagttctctaaatttagatgtttatgttctgggcaatagttttttagccatcagagtcttcattttttcagccatatgttcccatgtttggaacataaagaaaataatatcagggtttaaagataaaggaaaaaataggtaactagttataatcagtggaacactctccttgttctgagcaaggttcatgtttggctttcaatccgttttctgatcaaggttattctacacatagaaaaagagaagccattgtatattctttgtttgcattagcataaaggggtttcaaggatggagccataccacgtgaacattgttccactaagcatcaccatcgttccaataaaatgggtgtcctgtgttttctaaggtcaatgtgtgatctaggccctaggccaaatatatgacataatttatattcaaccaaaggtttctttttctgtcttttagcttatagacaacatttcctctcgggaagagatagatcatgcagagtattacctttacaagtaagttttccatttgatttggctatgtactctgtgatttcacaccccttttttacataaaagttggtatatgttgtgtataattttgacaccttctaagtttatattttaaagatcttttcatatgagtatagagagagtttctgattttttataactgcattttattccatactgtgagtttattatttaaaccagttcccttt

SEQ ID NO: 37300 - DNA, 1161 bp, Homo sapiens
tcacaagactcgcttccccggccttcgaggatctcgaacggactatagtctggactcgctgggctggaggaaacttggccgctggccacccggaggagactgagaagcctttggtcaacagggcgcctttccttgaaccaaaacaaaactttccgaagccggaaaggaaacgcccagtgtcgcctgagagccctggagctgcgcgagacccaggcactgagtgcggcctcggcctctgacctctaacacgccgggaacaaaccagctggggcggcccgcaggcctgcgggagcggaatgtgacccgaaaccgacggacttcctgacccatagtccatagttctcttcagcaacttgaacattttggaaaaagaaacaagtcttaacatgccacgacctaatggaaaaactaaatccccttcctacaccttgctttccaaaagttaaaaaaaaatagttaaacgctattagaggtctcaagttcactgtcaccagatcagctaggtccagaatcttcagttcttgaagccaagccctacaaatagatttattgtagcatatcacacctcttcaggtgacttaaaacaatgagaattcatgagaaattatcttcatcctcaagtaaaaatcatgaggtgcctttcacatggatgaaattgtaagtgcttgttgaacaaggaataattggataatggtattgtggtcatactttttaagaatatctgttagaaagatataggatgcagaacatctaggatttgctgaaagtcatttattatggataggggtatgagtaaggtcatagatgaaaagggatgaaacaagattggccatagttgctctatttttgtgtatcttgtttctttattttgtttctttaaaaagtcctcatatcactgacatttacacttagttttagggaaagtcaaatttagaaataagctacagctctctaagctatcggtctaactggatttttctcgatgctgaagaactttttaaaaaattcagccatctaggtcacacagcaaatacatttggcattaaattcctagtatcactaaagtactccctcccaccgccgcgcccccccccttccccccgcacccttagacctgggcaagagagacttctatcctggactccatgctttaaaggaact

SEQ ID NO: 37301 - DNA, 1052 bp, Homo sapiens
gcgaattctcggacaaaactgtcaacagcccgggcgcgccttttggctctgcgggtccctctatttatgcaaagccgacctatgctacagccccccaacccccgacctggggtagggaggaagagggtgccggggaagggagtccgccctgtccaggcactagaggctcccttgacgtttggcagatgaaaaacaactaagcctttttgaggtgtagagattctcaggtccaggcgttaaaaaataatggtcaaaagaataatacaaaaatagtaaaggtcttgaagaatgccagcgaagcaattcttttttatttgaggacacttgtctggtgtactttttcatgaaaaggaaaaatggttaacatgtttacacaagaaaaaaagtcaaaattatcatttatttcaacctgtgttttgtatcataacagacgtgtggatttttttgtacttactgcgtattctttacaaggagtattgtaaattttactggcaattattattgtactattctaaatgtaagatttttacactttttcagaaataaaaatgcttaattttcaaagaaaattcaccaaaatgattggcttcagttgtccccttcttagtttttcttttctacttaaaaaaactttctatgtggggtaagcaggaactcaatatagaacagacttaaatactttcagagagaatttaacaacagcatcatgccatgatttttcacttgaacttcctaagtgaaaaccatggtaggagatcagaaattatttttaaatgactacaaataaaataagttactttggtatacattttcagatctgactctatgccattttaaagcgcattgaagtatgttaaaattaaagccacaggtacccaaagataattttataggaactttgcatttcatttttgagcttccttcctcatttaatttccactcagttcacgacaatattatatctgcagaaactgtcaacataatatgttgtaatggaagtgaaacaaagaggcagtctagttttaaaattctaataggaaaaattagtagag

SEQ ID NO: 37302 - DNA, 1021 bp, Homo sapiens
tcttgactgccttgtacccgacattatgtcatgtctggtagtttatactttaagtaatatgctatctgaacccggctatgtacattgaggcatattttaatacactcagactacaaattacaacaacatgcaataaataggacaccaacataaagtcagcacaaagtgaactttactgagtattataatcagctctttggaatgccagtttttcatagtgatattaagatatggttgttaaattagatcacaaaaattgcttttcttttaaatagaaaatgttatcaatcacacggatgaagaaggatttactcctctgatgtgggctgcagcacacgggcaaatagctgtggtagagttcctacttcagaatgtaaggaaaatgcctcagaaaatgtatatgtatagttacttaagttaagtctttagtagagtttttatatatccagccagctagatataatggtagaggctaccaaaaaaagtttaatgcttttcatattcttgtggaacttggatctagttgggaaggcaagactaatcatacatgcaacagtgagaaataatttaacgcccagacccctctacatcccacgggaacagaagtactgtcagctttgaaggagaaggcttcatggaggagctgtgacttgactccagagtgaaaggataattaggattgatacaggacggaggaaggaaggcatccaggcaatctcaataaaagcatccatgagtaaaagtttccattatttctttattaagcccagaacattaccaggcctagtgttgaactataattattgttgacaggaataacaatattcttgtttaaactaattgagaagtcttttatctctacttcccataccagggtgctgatccccaacttttaggaaaaggtcgagaaagtgcactgtcgttggcctgtagtaaaggctacacagatattgtcaaaatgctgcttgattgtggagttgatgtaaatgaatatgattgggtaagtttgtaatactaaatt

SEQ ID NO: 37303 - DNA, 1026 bp, Homo sapiens
cctgggttgccggcaaagccatctaacaaatacatctgcagcacacttgcactactctgctttctgtcctcaatgtttttatatccaacttaccctgaaaaaagttaaatcatctgtttggaggaagtgatatggctaagccacaaaagtggcaacatcacttttccctaatagtcaaaagataatcagcaggaagagaaacttgaggcttaaatttgataatataaatgacttaaattattttgattagggttattcaactgtgcttcgaacgctaacatcaggctcagctacttttgccttagaactatctacttatcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtacagattgctgtggcctttttcccctccattttttacatgttctcatggttacaatatccagcataaagaggttgtgcagctattccacgtctgtagataacatgaataaagatattttagattgatttagattgatatcattcataaagatattttagattgatattcatgtcatcttagaaacttaaattagaatcact

SEQ ID NO: 37304 - DNA, 1026 bp, Homo sapiens
gctaatacttattatacactagtatatattcttaaagcataatttgaattatttaatctttataacagcctcaagaagtagatactactatcatctttgtgagttactaaggcagagaggtgaaataacttgaccaaaatttgaacaagtgggtaagtggtggaaccatttctaggtagtctgattccagaagctgagcttaaccatcacatataatgctttccagaaggatggttaggtacatttctgctatacttaatcctgttaacagtgtggttttttttttttttaccaagtttgaacgttttgctcccttgtactgttatatgcttttgaagctgttttattaatttgtcagctgaatgatcccatttcgtatagtcggatggtcatgaaaagaatgtgaaatagacaattgcatttttattattgaaatattgcctacgcctcccttccctaacataaatgtatttcttcagtgcgggattacagcaacattaattctcttagtttgactgtcttgggagatctggtgaacattcagaatattagaggaaaaccagatgaaacttttttataaactaaaacctccagatttatctaagaaaggccaatccattgtatgtgctatcattgtaagttgcacattttctttgatttcttttgagcacactgatagcatttaattaagatgctttatcaggatctggctttctgtgaatttaggaaactcctaatagtatctttagttttccatttcttttcctttcaaagaaaaacatttttctttatctctttagaagaagtgaagagttgcttggcctaggtaaggtagctgtcttgaaatatttgaatattgtctgtttatggtgtttggacaaattaatagttaatgaaagtaaatgcaagttatagaactctaaaacctttctttataggttgcagatttggatgatgaatttgctgacttggttttagaagaatttagtgagaattttgatttgttaccagctgaaaaggtaaatt

SEQ ID NO: 37305 - DNA, 1028 bp, Homo sapiens
atggaaaactgttaaatagtgagcgttaaggagaataaagtgagttaaaattttagaaaacattcttaaaacctgaaagagttttttttcctctcttgatacctttggtaaagaatttttaaccatgtttttaactataattattttgctttctacagctttaagtatgcagttgaaagcatcagagagaagttaaaggcaaagcctttgcttttacaggtaaattggttaatagcatcagcttcttctcagtttcctcattaatttattttgtgacaatatatacatttccaaagctatctcatcatttttgaagaagttggggtataaatagaaatagccacagattatagtaatggtgataatagacattttggggaaaatggtacaattagaaaagacttgtcatcattgtagttttcagtgagtgatcatgtaataatgttaatctcactctgacttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagtaaagtataatgaatgataaaatgaacaccaatgtgtgcaccacttatcttaaaatatagtcatactttagcatctctcggggattggttgcaggacctcctgtggataccaaaatctgcagatgctcaagtccctgatataaaatgatgtagtatttgcatataacctattgatgtcttcctctatactttaaatcatttctaaattacttataatacctaatacaatgtaaatgctatgtgccattttttgttcatctctctctcccactaatcatctacctgtcccccaaattattatttcaatatttctctttcatttgcttttcgttgagatggagtcttgctctgcggcctaggctggagtgcagtggcacaatc

SEQ ID NO: 37306 - DNA, 1292 bp, Homo sapiens
tggcacgatcttggctcaccgcaacctccacctcgtaggttcaagcgattctcctgtctcagcctccctagtagctgggattacaggcatgtgccaccatgcccggctaattttgtatttttagtagagatggggtttctccatgttggtcaggctggtttcgaactcccgacctcaggtgatacgcccgccttggcctcccaaagtgctgggattacaggcatgagccaccgcccccggcctgattgactatttttctaggtagaggcaactctaatggtttccatttggcctgtcccaccataatagccctcaccccaccagtcagggagccattgtgggggctctgccagctgttaagtatgtctatgccaattaatgcattctggcactggggaaatgaccacaggatgagtccggggacccactggaccgactgtaagtcagacctgagctaaaactccattagattacctgatcttcataagcccctactttaactggaggaccacagtgacgttttgggtcccccggaatcaacgtcagctcagagccagtgtccagtagtccctgaaatgtctgatcatttccctttccccagtgcacagttaccctggtaaaaggccagaggtctccttggggaaggatgggagaaagactcacagcataaattgtctctactgtagtggggtccttcctcaaggggcttcattcaaggtgttctgggtctataaagtggctcaagtctggaaattgaggggctgtgattctctcttttttttaataattcagattagtcttttgtccactcgacctggaagttttccacttatatgaattaagtaggaattcagtaggcttcctatcaattccacttctgggaacactgtgattaattagccagtgcaaaagctgtacacaagtcagattattctgattgctgctttgcctctgctgcggtccattatggtagctcgcccaccttgcatttgatggttgagtgctcccacttggcctctgccacgtcaggatccaattattcccgttctaaattttgtagttgagtgactgcagttcccactgttagatttggcatacagagaagagtaatcatagagctctttgaagattaacatgctgccctcacaaatctctttcgcaaagcatcggtcaagggtatatcttctggaccctcccagctgggatgagtaggtctaaagtgactaatccactccaccatcccaatctctctaagcctttggatctcttcctctacattaaaccaagggaga

SEQ ID NO: 37307 - DNA, 1050 bp, Homo sapiens
ttcatcacctcagaaagaatccctgtactaattggcaatcacttcccatttcctttaccccacagtcccttgaaaccactaatctagtttcaggctgggttgtcttttttttctttttgagttgtaagagcccttcatatgtgttagatacaagacccttgtcagatacatactttggaaatgttttctcccattctgtgagttgtcttactttctcgatgatgttctttgaagcccagaagtttttaattttgatgaggtctaatttatctactttttcttttgtcacttgtgcttttggtgttatatctaagaaggctctgcctaacccaaggtgacaaaggcttgcacctatgttttcttttaagaatttgagtagttttagatcttatgtttaggtttagaatccatttgcagttaaaatttgtatatgattctaggaaggtacctgacatcattattttgcatttggatatctagttgtactagcagcattcgttaaatatataattttcctccatagaattgtcttggcaccctgttgaaaatcaattgaccataaatacgaaagtttatttctggaccctcagttctatttcttcgatctgtgtatgtgttcccatgccagtaacatactgtcctgattactctagctttgtagtaagttgaaatttggaagtgtgaatcagtcttgacaagttctttgtcaagattattttggctatttgggctccttattttcctgtgtgtttgggatgaacttgacaattttttgcaaaacaattcgctaggattttgagtctttaggttgtattgggaaatatggacatcttagcatattaagtttttagatccatgaacatgagatgtctttccattttttttaggtgttctctaatttcttttaacaatgtttgtaatctctattgtacaagttttgtatgtctgttgttaaatttattttttttgatgctattatgaatggttttcttaattccattttttggattgttcattgctaatgtgtggaaatacaaatgatttttatat

SEQ ID NO: 37308 - DNA, 1021 bp, Homo sapiens
ctgtgtacacatacaatccacaccttgtgaccatcaaagaacaaagtctgccttgttttgtaccttgaccaaaagacctttcacagagaatacacttagtttctttttatttccatttcagattttccaaacttagttcttctggtcacatccagtctaaagatcctaccaaattcactgctgatctaatgaacagttgtgactgataccttgatcccataattagtacacatttgtgatgagaattagtgcgtatagtccataaaaggaaggtcattttttcccaagaataaaaaactgatgtgcagtttaaaatggtttttctttaggtaaatactttgggtgccctttattgtctctgttcttgtataaatttgaaatagaaccagtaacttttgtaacttcagaaaaatactgattatacatgaggagaaagagttttcaatggaaatttagtgtgcattgcagagaagacatcactttgttgtttttaaatgttttaatgtttgcagttggggtgtgaattaattgctttgtgatttattttatataaggcaattcctgtgggaattggaggctttttgtttctaatactggctccaggggagtttcctacctgatagacatttggagcataactagtttatacttttgtattgagggcttctttctatgaaagacacacaaaggcacagccttcctatttagtgtttctgatcagtatttaactgcaggagtgtgctcttcttattatgcatgttgaggctccttctctggcacctagcctctatttctgcttgttctggtagttaactattttatagcattgagtttccaggtgctactgtatctgccacttttagtcccttccatatatctctaattgtcttacatctttactattttagttctttccccgttgtaccagataacaatggagttaagtgggcttatactagcctttgaatcagtagccatttaattcaggctggaagtgttttttctacaaaggaaacctaaa

SEQ ID NO: 37309 - DNA, 1076 bp, Homo sapiens
ggattgctgaacagtgttgaggcccatctgagattttgatagttgtagcagttattttgtcatattcaaaaactcggctctcatagtagaaaaagatgagtggttagaggaatctagcgtttaggaccttgtgtagggcaggagtgatggaagaaaaagtaaggtaaagggattagttgagctgatgtagtacagggcccaggttaattagggaaggaaatgatgttagaaaacagaaaagggagggatcaagagaggaatcataataaggttcagaaataaggttgagagcattgctgattatgttgcctggatacctaacctattctcggtgttggagagaccattgtgagagttaggatcatgaattggattggttgagataattatttttttccctgagaattctttcagctctatagtgtacatacttctttttgggtctgcctctctccacaaagcccccaaataatagcagtaacctgtaagaatcatgaaataacttacgagctgaacatgtagaatatgttcccatcttttcagaatatagttggcatccagtaatcaacaataaatagggaaaaaatcacaataatataaatttgttttctaactcttttcatgcttttcttaaggttatccattctgtcaaatacataatttttttgggaaaaaggaattattaaaaggtagatacaatatagcagatgctcatgatcttagatctcttatataagaggtcttggtattatgtttttatacagcttaccctggattaatgagcataccattcgcttaatttgtaaattagtttggacactttttacacttcgctgtccattctgtgtcagttttttgatgagttcacttaaggctacattaagctttctcattcatgtagaatctagttaggccttttggtttatctcatggacagagcataaagtacttgacagaatttgatctgacagctttacagttacataacatagaacagaagcttaaaaacaacaaaaaagagagagaagcaagggatttatcatagcaacctatatttctctctggaactttaccac

SEQ ID NO: 37310 - DNA, 1097 bp, Homo sapiens
ttgttatgtgataagtatattaaaagatttatgcacaaggtacttaccatagcagcacctcaacttgtctcccttcagttcttcctaccaatccaacctatatgtagctgtcaggtaatttgtcttaaagaatagccttgaatgtctcttccctgcccaaggtcccttaatggcctgctgcttgtataccaagtgaagtctaaattctttaatctgggattcttggcctgctatgttctgtccttaatttattttcctagtacttccaccaccatttgccgttatataccttaactctcttggtaaatccaactacttgccgttctcggtgtactttcagtcatccattcagcatattctttttgagggtcttccccactatctgcctcttgaaaggacatctgttactttttatctagcagcatgttcttgttcatctgtggcagctcttcctcctagcaccagtgtttggtttatttatacaaacttttattcagtcattcatttatttagtaaatatgctttgaagttagataagactactgtctcttgtaccttcttcccatgggcctgctgccaatgagaggtaagaattgtactgaatctgggtaaataagcccacctgagtttgcaagagagtagcacaagcaggttaatgaggccatagctccaagtgcagagttggagaggcccaaaagcacagaattggagagcctgtggttcaggggctgccatttttccaaattgctgagatactctgctatataatggcagcccatggttatatttcttagttgtctagtgaaaatactagggagtttggtcgggtagtgatggggattgtgactcagcagaatatttcgcaaatggtatgccaaaattaagtgccaagttttggtttctttttgcttttgttgtgagttagacatgtttcctttaaaatgaaaacatcagtcttcattgttctaaatgagacaaatctctgtgatattttatgttaaaaatatctacaacagtgaacatatagttagactcgtgtttttaaaaattggttgtatcctggaggtttactatgtccaatccctgttaactttact

SEQ ID NO: 37311 - DNA, 1033 bp, Homo sapiens
tgcaaaccagtagtttgtgttgttaaagatacttctagatgctggcgggcgcttgtagtgccagctactcgggaggctgaggcaggagaatggcatgaaccctggaggcggagcttacagtgagccaagatcgcgccactgcactctagcctgggtgacagagaaaaaaaaatacttctagatgcaaagtgttggatgagtaatttgagagacattcagaactatgatcagagataagctataccagtgatatgtttagataatcctatgacagaaaatgtaagattgtgacaagagatgagattatgttaccctgtgtgttgtcagcttcacccagctatggtaacccttaaaagtagatcagaaatagtgcagtggaaggtggtgcagcagtgacacaaggtaagcaaatcctcctactttcagaagagcatatgtaacaggtggatgtcttactgcaaagatatcttcctgttttcaaaacactgaagattcaaaatagcaaattagactttgatcactgacctaataatcttattttctcaaacttcagtgaatatatgcaagcccttgatgactcacatattttttgagttatgatttataaggtggaaagtagttcctgataaattcagatctgtgaatgtaaaaattagttaaaagtagtagctaaaagtaaggtaatttaaagtacctcatcaaccttttgtatagcaggatataactgttcatctcttgtcctaactcatgtttgtatagtctttaaaaaaatcatctcctttaaaattttgcacattctacttttcgtcctggcctaacatggtacgtgttatgtttggaggaaactaatataaaataattcatacccccaaacaaaaaagtacagttagtatatttatttcatttactatttgtaatgtcttttgcatccaagatgatttttccaagtttataatttttttcattatgaaagtcatacagatatacttcgagaaaaagagaaaaatgctaaaattagctactgtcccatcac

SEQ ID NO: 37312 - DNA, 1087 bp, Homo sapiens
caatacagagcttttagttgttgaaaacagaaatttaaataaatagataatatatagatatgtgcagcagggttacaaggcaaagctttacaagtctactaaggacaaaaaaagaaaaagctgaaaataggagagaaaagataagaacattaaagatcactccaggaaatccagggagaatagcgagtgaacagtagaagaaatcattaaagaaagaatacaagaaatgagataggcatttccatattgaaagtaccacttagtgtctagtacagtgaacaagacacctcactgaaattttagaacaggaataaagagaagatcctgaaagcttccgagaagaaaaaactggtcacataatggagagaaatctaagtatttaatagcattatacttattaatagtaacatcagattccaaactacagtggagtttttgaagaggtttaggatgagtactatttgtttccttttgaatttctatcagattttgttattttatgtttttagtcaaatgctgtacaaacttatgatgttagtaacattgagaagtttttgagtttttgctccaaaatgtatattacatggctaccttctttgctacaaacacaccaggaacaagaatttataccatccacagtaagaattattgggagagtttgttgttgttgttgtttgagacagggtcttgtctgtcacccaggctacagagcagtggcacaatcacagttcactgcagccttgacctcccaggctcacatgattctcccaccccagcatccctcagtaactgggactacatgccaccacaccccgctaattttttttcttttctttttttgaaacggagtctcgctctgtcacccaggctggagtgcagtggcacgatctcgactcactcaccctgctaatttttaaatttttttaagaaatgtcatctccctatgttgcccaggctagtctcaaactcctgctgcctcagcctcccaaagtgcaaggattacaagtgtgaggcactgtgcccagctgggagagatttttctattcaaacttgcagtctgcaggcctgcaatctgagatataatttt

SEQ ID NO: 37313 - DNA, 1198 bp, Homo sapiens
agtctggatgcaaggtatgctcattgctattggatgttattgcttttaggcgttttcagtgaactatatccttttagaaggaaaaaaaatcatgagtttatgctgatattttcatttcagacttcatagcatagatttatgcttaactttcgttctctacctactcgtatgtctttttttaagctaaacatttgtttcttaatacagtaattgaattatttctttatcatctaatatacttacaatattactactaacaatgccagtattactattaacagtgaaactactaatgatgtttattttggtagttctttttcttaaagtatatgctattagggatgaagagtcagaatactgtcttttgaagtacaagttgaatattctttatttgcaatgcttgggacaagcagtgtttaggattttgaattttttttggattttggagtatttggactttaaacctttatgatcacatggtccataccatggaagtgggtacaaaaaattacaactctgaaagcataagacattgaatcacaacaaaggacacaatctaattgtaaaagctataaaatgtcttggagagaaaaatgccatacatatcacagggacaataacagtcaaatcccttaaaaattattaagacacagcaacctaaaaattctacctttcaaactactttacattgggaatttaaggccagctagggaaattgaaagcaatggtagatacgattaaatctataattcatatacaagccatatacaagcaaaacataaagaatttatgcctggatatttacattttgttcagcaaagaaaatacagaatgcattggtttctttcaggaaaaatagttttataaggaggttgctataagagctgtggtgtttatctctggatgttttgtgtcaaattcaggatcaaggagcatgagaaaaaggtacggaggaagggaaaaggcagaagctagagcctcactcttctggaaatccagttggtgatcccaagggagtgaatacattactttggcagtaactaatactttggcagtcctttcgccaactatctacacttaccaattcctctgtagcccaatacttggaattctgacgcctgcttatgtactctctacctttaaaaagctctctcctcaccaaagagtaataaatgactttcagtgagtgtccacctac

SEQ ID NO: 37314 - DNA, 1027 bp, Homo sapiens
aacaaatagaagatactgggttttgtatatcatgtaatatctgtttcttcagtcaggatttagcagttttgatggacgtggtctatatgatatgttatagcagaaaagcagattttaacagtctcacttttaagctaaagtatctccaaattatattcaacaaggaaatcactttttaataatatgtttcatttccattataatactaagctctattgagcagattgtgttttccttatgcaaattacctttggatattataaatgaatatttctgttcatatgctaaatctatggaaatttgttttaatttttagcattggtaagggtttaggaatttaagacaggaagctggatgcttgcggtctctaaagtctgtaccctcaaaataaaatcagattaccattggaagaagttttttttagtgtcagcgttagttctttttttaattttcttaatcttcacatctttgccattcaactttttatctttctggtgattgcattttattggactagattatattatgttaatcttatattaaagacctgagcactctggtcagaatgactcagtttaaaccctggttaggtgtatgatcccagtaagttttctaacttttttgtgcttcatttttatgatttagctagaacctgacacataataagtgctcaataaatgttaccttgtattgctattataacataatttctttgagctaataaaagttatctacatcattattttttcctctgtgagagtattgctataaaagtttttaaaagtcatagtttaaagagatttctattatttttatgtttataaataaagtttacattagtttttaacctgcaatagagaagaatattaagactttaatttttctgacttgtacagcgtttttctccttgaatactcttaagaaaaagatttagcaattctggatcagaaatcatccataaccaaatataccacagtatattttaccttttgcttgtccatttatgcatttttttttaattttactt

SEQ ID NO: 37315 - DNA, 1044 bp, Homo sapiens
ctccaagtgacacttacatcacacatgtttgagtttacgttacttgcaaacatagggaaagaaagatacatgggataaactggtgcatgagaaatgagatcttagcagttggttgaaataaatgagaacaactgaggcaaactaaagaggaagaagggcaagtggcagcttaacaggagtaagatgatgagatgaagggcagaataccttcatggagaggaggcaaagagatatacatgatatgttcttaggaacataactgaagcaaacaatgatattatttctaattatatataaacctgtgagtcagccttccaggggcggcctgctaaggtagaatcattggaatgatttggccagggtttggataggagagaattggcagcagcgttaagattgacccatgataaataatgctatgcaggtagcagggagtctgactaggagcaaaatcaacgaacttatcccttgcctaacatagtatctgtggagtcagaaagaagaggttaaattgggatatctgaggcaagtatcaggatttgccatgtctgcggagtagtttcataattctaatggttataagcactaaggcgttcactaagtgaatgttggtagttccaggttatattatccattcttgagttacaaaatacactttaaaaccttcccatcttaatattatatgtttttttagtcacagagtgaaaaggtgagattacattggcctacatccttgccctctggagatgccttttcttctgtggggacacatagatttgtccaaaaggtaagctaatgtcagagtttactaaaagtacaccttgtattgttcttcattgttggtggaaatatcttttatttgagacggagtctcactctgtcaccagagtggagtgcagtggcgcgatctcggctcactacagtctccacctcccgggttcaagagattctcgtgcctcagcctccctggtagctgggattacaggcatgtaccaccacacccagctaatttttgtatttttaatggagacagtttcaccatgg

SEQ ID NO: 37316 - DNA, 1044 bp, Homo sapiens
actattattatcttcaaagatttcaactctatactcagtgtggatcaaattgaattattagaagagtccctgttcacaaaaaaaaaacaatgtattgaaaaacaggacaactccctaaatacattagactaatggttcaagattatcattcagctagtccagactagcttatttccaactttttggcaactttctctctctttagtctctttttccttcactaagggatcatattctttggtcatatactctaaccacattgcctaaaataattttttttaaacctttgcacattatataccacttcctgattattttagcattcaagtttatttgccatgttgaaaaggggagatagatttttgattgctttcagcattgttaatcttaccagttctctttctttattgggtagcaatgagcagagcaaaccaaagatctgcgggaaaaaaaccacttttgttgcttctccatgcaacactctccaccaaagaacagccagaaaagatggcaggcagtattggttaaaatctggacactactgtgttttatagtcttcttacagatctatctgatgtcaaattttattaaccttttccactgtaattttttctcaaggttgaaataactggatcccagttacattttacatggaatgtaagtgtgtgtgtatttgcacatgtgtgtacacacagtatgtgtgtgttcatatatatatacataatatatgcagggtatgtgtgtatttattggtaagcaactctattcaagaactttctaatcttttgtatgtagagtgtgtgtgtgtgtgtgtgtgtatatatacacactaaagactagaaagttcttaaatagagaaagttgtttatcaacaaatacgtctttcaggtaattcttagaattgagaaagaaagtacaatgataacaatatggtttcactgaaattgtttcattcaggtgtgtgcctgctgtgtgcttgactctaagctaggaatgggaaaacagtgatgagcaggaaatagtctctcaaggggcttaaaatct

SEQ ID NO: 37317 - DNA, 1062 bp, Homo sapiens
ggtgaaataatttgtccaaggtcaatcaactagttagtgaagaagtcagcattcagacctaggtctttctgacccaagaaccagggcttttggccaggaagcaattctgtgctgtaagtatgtatttctgtgaattatgttttgttgacataaatcatgggcttcttgaatcacagtattcttgtattttctgtttgttcctcatatctatattatttagaccataacttcttaaagactcagacatattcttattaaacttctttgtaggaatcagcaaagcattgggcacgcaaattttttatttgaaataatttacagtattgtaaaacagattttatgggagaaatttgtgatatttgaaggcttttcccccttaaaatcctcatggtttgtattacagtgattactgacagaatactttctgtctagctttactgtttttgccctccttggcatccattctagaatggttgctcactacaagaaaagttttaacgaaatgactgtatgatttaaatattctcaatgtattagaaatcacataattcaatgtgacattatacagcagcccctgcagaaaaaagttattcccgaggtcattcttaaattcaaaaattatatttcaatttataacatagaaaaggacatatgtataccagaccagtaattttatttagaaatattgtgctggctttaatctgtggagtccattaatattctgcatttctccttatgattttgagacaatgctaaattatttttaaagatagggttttgttttaaatatcttagccatctttcatgctgtcttgaggtcaaatgagatagtgtttgtaaaagttctttaagaaaaaactgaaagctgtatgaattaaagttaagattgtgtaaagttaagctaacatttttctagtaaagaggtgcctgttgtcaaagggctctgtgagcattttctgtataatttgtcaaagatatataataaaccacttttgatgctattatttttttaaattataggattattttcagaatcttctacaattagaatacatgtgattt

SEQ ID NO: 37318 - DNA, 1072 bp, Homo sapiens
taatgtctattcagatctttcaaccattttttaagtggattactagatttcttcttatagacttctctcatctccttgtatattctggttattaatcccttgtcagatgggtagctttcaaatattttctcccattctgtaggttgtctctttgttgattatttctttatctgtagagacgccttttaacttgatgtgatctcatttgtccatttttgctctggttgcctgtgcatacgtggtatttctcaagaaatctttgaccagtacaatgttctggagtttccccagtgttttcttttagtaatttcagagtttgaggccttagatttaaatatttaatccatttgatatgattttaatgtatagcaagaggtaggggtctagtttcattcttctgcttatgaatatccagttttcctagcactatttattgaagcgactgtcctttccccaatgtatgttcttggcacttttctcaaaaataagttcactgtaggtgtgtggatttgtttctgagctctgttctgtttcactggtctgtatatctgtttatatgccagtaccaaactgttttggttactatagctctgtagtataatttgaagtcaggtagtgggattcctacagttgtgttctttttgcttaggatatctttggctattctgggtcttttgtggttctgtatacattttaggattgtttcttgtggtttggtgaacgatgtcattgttattttgatagggattgcatcaaatctgtagattgttttgggtagtatggacattttaacaatattgattcttccagtccatgaatatgtgatatctttccgttgttttgtgtcctcttcagtttcttgaatcgctgttttatagttttcattgtagagatctttcacttctttggttaagtttattcctaggtatcttattttatttctagctattataaatggaattacttgatttctttttcaggtttttattggcatatagacatgctgttgatttttgtgtatgtatttttgtatcctgcaactttactgaatgtatcagttctaatagttttg

SEQ ID NO: 37319 - DNA, 1021 bp, Homo sapiens
caagaatgcagacaaaaaaatgaaaacgtttattcttgtgttaatttaatgtttattgtatattcttacatggttgatataaggagttgtatagaaattgaaattattagttgggcgcggtgcctcactcctgtagacccagcactttgggaggccgaggcgggcagatcacctgagtcaggagtttgagaccagcctggtcaacatggtgaaaccccgtctctactaaaaaaattagctgggtatggtggcacatgcctataatacccgctactcgggaggctgaggcaggataatcttttgaacctgggaggcagaagttgcagtgagctatatcacactgttgcactccaacctaggcaacaagagcagaaatccatctcaaaaaagaaaaaaagaaattgaaattattttttcccattgacttttaataataaaattaacattgttttcatgggaaaacatttggaattgaaatgaaataaaatccattctaaagaatgcaataggcctcttgaagttaaatattaaaatgaaaaaataactcattacagcattaaattgttaagattaaaaataaatccataatacaaataattttctgcagttcactacgacatgcaaaaaatgcagtcccctgaggtttggcctatgggaaagtgtgttgtacctagggtcactctgcacttcaaatactgaaggtaacatttacattataaaaattctgttaatattgcaggcatgtagtttattttatttttttctgaaagggctgtctgtggctcttaatgtattttgtttaacatcctacataaaagttttacagtaaaaaatggtgtatctttttgtgaaatgaaaatacatcagcaatattcaatgggactggataaaattccccttgtttgaaccttgattttaaggttaggaatgaaagcattttgttgatggagataatagaggtaagaggtaccttttaaaataaattgcacatagcagaagaggtaagtgacaaactttttaa

SEQ ID NO: 37320 - DNA, 1034 bp, Homo sapiens
atgtcttgctagataataaattctaagaaatgattatttacctcatacaagatacaggttctatcagaaactgacagaaaaattcatagccattggatttattcttcctattaaacatatcagcataatgtcattttaccctcaccattgacttctgtgttcttgatgttttaagagtgtttgctttgtaaactacattaaaacatcaccttgtaacccataaatgtataaaactattatgatttgtcaatttaaaaaaaatttttttttaaaaagagtatgtgctaaatgtaagtacactagtttttttctttctaatcctttcttcctaaccttaagcgaacgtgaaggaacgagcattatctacattttaaaccatccttttaggggtcattttaaggatctcacattctttttttaatctctctctttttgaaacagggtcttgctatgttgcccagagtggagagcagtggctattcataggcataatcatagctcactacaatctcaaactccggggctcaagtgaacctcctgcctcagcccctgccagggactgcaagtgcataccaccatgcttgggtttaagcatctcaaattctatctgtgatggatgtgttttcattaatgaaggctttcttcattttattgataaacacagaaaacatcttttatttcactttcctttagcttcttaagaattcgagggtaagattcaagtctgtgctaattttttgcctcctgacacagtacctggagcaaagcagatgggcaacaaatctgtgcccggctataaatggatgtccggaggggcatccacttatggataggagagtggtgttgttcagaagaggaggacttgggcagacacctcagctgcttgtctgcagaagtagcacttaagtgttttcatgaattaaagattataatttttttaaacataccttgatttcgtataaaattgaacattttatagaattttttttgaaacaatggattttaatgtcagtcattttctttgttatactcaa
